(12) United States Patent
Schøller et al.

(10) Patent No.: US 10,336,808 B2
(45) Date of Patent: Jul. 2, 2019

(54) MHC PEPTIDE COMPLEXES AND USES THEREOF IN INFECTIOUS DISEASES

(75) Inventors: Jøgen Schøller, Lyngby (DK); Henrik Pedersen, Lynge (DK); Liselotte Brix, Bagsværd (DK)

(73) Assignee: Dako Denmark A/S, Glostrup (DK)

( * ) Notice: Subject to any disclaimer, the term of this patent is extended or adjusted under 35 U.S.C. 154(b) by 0 days.

(21) Appl. No.: 13/482,472

(22) Filed: May 29, 2012

(65) Prior Publication Data

US 2012/0264161 A1  Oct. 18, 2012

Related U.S. Application Data

(63) Continuation of application No. 12/619,039, filed on Nov. 16, 2009, now Pat. No. 8,268,964, which is a continuation of application No. PCT/DK2008/000118, filed on Mar. 26, 2008.

(60) Provisional application No. 60/907,217, filed on Mar. 26, 2007, provisional application No. 60/929,583, filed on Jul. 3, 2007, provisional application No. 60/929,581, filed on Jul. 3, 2007, provisional application No. 60/929,582, filed on Jul. 3, 2007, provisional application No. 60/929,586, filed on Jul. 3, 2007.

(30) Foreign Application Priority Data

| Mar. 26, 2007 | (DK) | ................................. | 2007 00461 |
| Jul. 3, 2007 | (DK) | ................................. | 2007 00972 |
| Jul. 3, 2007 | (DK) | ................................. | 2007 00973 |
| Jul. 3, 2007 | (DK) | ................................. | 2007 00974 |
| Jul. 3, 2007 | (DK) | ................................. | 2007 00975 |

(51) Int. Cl.
| C07K 14/74 | (2006.01) |
| A61K 47/64 | (2017.01) |
| G01N 33/569 | (2006.01) |
| A61K 49/18 | (2006.01) |
| G01N 33/574 | (2006.01) |
| A61K 47/61 | (2017.01) |
| A61K 38/00 | (2006.01) |

(52) U.S. Cl.
CPC ........ *C07K 14/70539* (2013.01); *A61K 47/61* (2017.08); *A61K 47/6425* (2017.08); *A61K 49/1896* (2013.01); *G01N 33/56905* (2013.01); *G01N 33/56911* (2013.01); *G01N 33/56972* (2013.01); *G01N 33/56977* (2013.01); *G01N 33/574* (2013.01); *A61K 38/00* (2013.01); *G01N 2333/70539* (2013.01); *G01N 2800/24* (2013.01)

(58) Field of Classification Search
None
See application file for complete search history.

(56) References Cited

U.S. PATENT DOCUMENTS

| 4,281,061 A | 7/1981 | Zuk et al. |
| 4,336,173 A | 6/1982 | Ugelstad |
| 4,387,164 A | 6/1983 | Hevey et al. |
| 4,459,378 A | 7/1984 | Ugelstad |
| 4,654,267 A | 3/1987 | Ugelstad et al. |
| 4,876,190 A | 10/1989 | Recktenwald |
| 5,039,487 A | 8/1991 | Smith |
| 5,130,297 A | 7/1992 | Sharma et al. |
| 5,194,425 A | 3/1993 | Sharma et al. |
| 5,260,422 A | 11/1993 | Clark et al. |
| 5,284,935 A | 2/1994 | Clark et al. |
| 5,312,744 A | 5/1994 | Shibata |
| 5,468,481 A | 11/1995 | Sharma et al. |
| 5,583,031 A | 12/1996 | Stern |
| 5,627,037 A | 5/1997 | Ward et al. |
| 5,635,363 A | 7/1997 | Altman et al. |
| 5,652,342 A | 7/1997 | Zimmerman et al. |
| 5,807,552 A | 9/1998 | Stanton et al. |
| 5,869,270 A | 2/1999 | Rhode et al. |
| 5,891,741 A | 4/1999 | Siiman et al. |

(Continued)

FOREIGN PATENT DOCUMENTS

| DE | 197 40 735 | 3/1999 |
| DE | 102 47 014 | 4/2004 |

(Continued)

OTHER PUBLICATIONS

Karin et al (J.Exp. Med., 1994, 180: 2227-2237).*

(Continued)

*Primary Examiner* — G. R. Ewoldt
*Assistant Examiner* — Marianne DiBrino
(74) *Attorney, Agent, or Firm* — Arent Fox LLP

(57) ABSTRACT

Novel compounds carrying ligands capable of binding to counter receptors on relevant target cells are disclosed. The compounds possess a number of advantageous features, rendering them very suitable for a wide range of applications, including use as detection systems, detection of relevant target cells as well as a number of other methods. In particular, novel MHC complexes comprising one or more MHC molecules are disclosed. The affinity and specificity of the MHC-peptide complexes are surprisingly high. The possibility of presenting to the target cells a plurality of MHC-peptide complexes makes the MHC complexes according to the present invention an extremely powerful tool e.g. in the field of therapy and diagnosis. The invention generally relates to the field of therapy, including therapeutic methods and therapeutic compositions. Also comprised by the present invention is the sample-mounted use of MHC complexes and MHC multimers.

8 Claims, 76 Drawing Sheets

Specification includes a Sequence Listing.

(56) References Cited

U.S. PATENT DOCUMENTS

| | | | |
|---|---|---|---|
| 5,955,079 A | 9/1999 | Mond et al. | |
| 5,994,089 A | 11/1999 | Siiman et al. | |
| 5,998,204 A | 12/1999 | Tsien et al. | |
| 6,015,884 A | 1/2000 | Schnek et al. | |
| 6,096,315 A | 1/2000 | Zimmerman et al. | |
| 6,074,645 A | 6/2000 | Diamond et al. | |
| 6,090,587 A | 7/2000 | Rhodes et al. | |
| 6,106,840 A | 8/2000 | Clark et al. | |
| 6,129,916 A | 10/2000 | Chang | |
| 6,140,113 A | 10/2000 | Schnek et al. | |
| 6,156,317 A | 12/2000 | Diamond et al. | |
| 6,156,514 A | 12/2000 | Acevedo et al. | |
| 6,197,302 B1 | 3/2001 | Hirsch et al. | |
| 6,197,928 B1 | 3/2001 | Tsien et al. | |
| 6,211,342 B1 | 4/2001 | Hirsch et al. | |
| 6,232,445 B1 | 5/2001 | Rhode et al. | |
| 6,248,564 B1 | 6/2001 | Walter et al. | |
| 6,251,399 B1 | 6/2001 | Diamond et al. | |
| 6,268,411 B1 | 7/2001 | Schneck et al. | |
| 6,306,605 B1 | 10/2001 | Acevedo et al. | |
| 6,309,645 B1 | 10/2001 | Rhode et al. | |
| 6,335,173 B1 | 1/2002 | Kaplan | |
| 6,387,622 B1 | 5/2002 | Siiman et al. | |
| 6,448,071 B1 | 9/2002 | Schneck et al. | |
| 6,451,314 B1 | 9/2002 | Clark et al. | |
| 6,451,769 B1 | 9/2002 | Huebner et al. | |
| 6,458,354 B1 | 10/2002 | Schneck et al. | |
| 6,458,933 B1 | 10/2002 | Hansen | |
| 6,486,130 B1 | 11/2002 | Livey et al. | |
| 6,517,838 B1 | 2/2003 | Hook et al. | |
| 6,534,633 B1 | 3/2003 | Weidanz et al. | |
| 6,548,067 B1 | 4/2003 | Seeman et al. | |
| 6,605,711 B1 | 8/2003 | Valmori et al. | |
| 6,734,013 B2 | 5/2004 | Schneck et al. | |
| 7,041,442 B1 | 5/2006 | Kern et al. | |
| 7,060,869 B2 | 6/2006 | Tsien et al. | |
| 7,064,190 B1 | 6/2006 | Endl et al. | |
| 7,074,904 B2 | 6/2006 | Wong et al. | |
| 7,094,555 B2 | 8/2006 | Kwok et al. | |
| 7,116,407 B2 | 10/2006 | Hansen et al. | |
| 7,141,656 B2 | 11/2006 | Rhode et al. | |
| 7,202,349 B2 | 4/2007 | Davis | |
| 7,364,869 B2 | 4/2008 | Nixon et al. | |
| 7,502,580 B2 | 3/2009 | Hays | |
| 7,519,318 B2 | 4/2009 | Kurogawa et al. | |
| 7,524,503 B2 | 4/2009 | Khanna et al. | |
| 7,706,782 B1 | 4/2010 | Hosmer et al. | |
| 7,902,121 B2 | 3/2011 | Chen et al. | |
| 8,114,669 B2 | 2/2012 | Choo | |
| 8,268,964 B2 * | 9/2012 | Scholler et al. | 530/350 |
| 8,298,782 B2 | 10/2012 | Busch et al. | |
| 2002/0006903 A1 | 1/2002 | Schneck et al. | |
| 2002/0034513 A1 | 3/2002 | Rhode et al. | |
| 2002/0058787 A1 | 5/2002 | Strominger | |
| 2002/0082411 A1 | 6/2002 | Carter et al. | |
| 2002/0091079 A1 | 7/2002 | Rhode et al. | |
| 2002/0119149 A1 | 8/2002 | Jakobsen et al. | |
| 2002/0127231 A1 | 9/2002 | Schneck | |
| 2002/0164340 A1 | 11/2002 | Brumeanu et al. | |
| 2002/0165364 A1 | 11/2002 | Tsien et al. | |
| 2002/0198144 A1 | 12/2002 | Wong et al. | |
| 2003/0017447 A1 | 1/2003 | Barnardo et al. | |
| 2003/0073102 A1 | 4/2003 | Kwok et al. | |
| 2003/0096432 A1 | 5/2003 | Jakobsen et al. | |
| 2003/0104635 A1 | 6/2003 | Jakobsen et al. | |
| 2003/0118594 A1 | 6/2003 | Nag et al. | |
| 2003/0171290 A1 | 9/2003 | Carr et al. | |
| 2003/0199438 A1 | 10/2003 | Shaw et al. | |
| 2003/0228258 A1 | 12/2003 | Scheinberg et al. | |
| 2004/0068100 A1 | 4/2004 | Mach et al. | |
| 2004/0072262 A1 | 4/2004 | Montero-Julian et al. | |
| 2004/0082012 A1 | 4/2004 | Busch et al. | |
| 2004/0086520 A1 | 5/2004 | Diamond | |
| 2004/0137642 A1 | 7/2004 | Erfle et al. | |
| 2004/0141958 A1 | 7/2004 | Steinaa et al. | |
| 2004/0143094 A1 | 7/2004 | Donda et al. | |
| 2004/0204565 A1 | 10/2004 | Schneck et al. | |
| 2004/0209295 A1 | 10/2004 | Schwabe et al. | |
| 2004/0209314 A1 | 10/2004 | Lang et al. | |
| 2004/0223977 A1 | 11/2004 | Diamond | |
| 2004/0253632 A1 | 12/2004 | Rhode et al. | |
| 2005/0003431 A1 | 1/2005 | Wucherpfennig et al. | |
| 2005/0074822 A1 | 4/2005 | Nixon et al. | |
| 2005/0074848 A1 | 4/2005 | Schwabe | |
| 2005/0079152 A1 | 4/2005 | Bot et al. | |
| 2005/0095655 A1 | 5/2005 | Montero-Julian et al. | |
| 2005/0208529 A1 | 9/2005 | Winther et al. | |
| 2005/0214284 A1 | 9/2005 | Price-Schiavi et al. | |
| 2005/0214852 A1 | 9/2005 | Gaynor et al. | |
| 2005/0239160 A1 | 10/2005 | Shaw et al. | |
| 2006/0018878 A1 | 1/2006 | Cooper et al. | |
| 2006/0018929 A1 | 1/2006 | Zaia et al. | |
| 2006/0073159 A1 | 4/2006 | Vonderheide et al. | |
| 2006/0078563 A1 | 4/2006 | Srivastava | |
| 2006/0084116 A1 | 4/2006 | Muchhal et al. | |
| 2006/0112440 A1 | 5/2006 | Tsien et al. | |
| 2006/0141540 A1 | 6/2006 | Miltenyi et al. | |
| 2006/0155115 A1 | 7/2006 | Jakobsen et al. | |
| 2006/0166214 A1 | 7/2006 | Kato et al. | |
| 2006/0166875 A1 | 7/2006 | Jakobsen et al. | |
| 2006/0171954 A1 | 8/2006 | Endl et al. | |
| 2006/0228758 A1 | 10/2006 | Muchhal et al. | |
| 2006/0228759 A1 | 10/2006 | Muchhal et al. | |
| 2006/0234309 A1 | 10/2006 | Shankar et al. | |
| 2006/0234310 A1 | 10/2006 | Cai et al. | |
| 2006/0240482 A1 | 10/2006 | Kwok et al. | |
| 2007/0026503 A1 | 2/2007 | Lacey | |
| 2007/0134814 A1 | 6/2007 | Kajander et al. | |
| 2007/0154953 A1 | 7/2007 | Brunner et al. | |
| 2007/0178532 A1 | 8/2007 | Jacobson et al. | |
| 2007/0184022 A1 | 8/2007 | Wang et al. | |
| 2007/0280957 A1 | 12/2007 | Falk et al. | |
| 2008/0219947 A1 | 9/2008 | Linette et al. | |
| 2009/0004213 A1 | 1/2009 | Singh et al. | |
| 2009/0061478 A1 | 3/2009 | Poulsen et al. | |
| 2009/0232766 A1 | 9/2009 | Wang et al. | |
| 2009/0324630 A1 | 12/2009 | Jensen | |
| 2010/0159594 A1 | 6/2010 | Hansen et al. | |
| 2012/0020998 A1 | 1/2012 | Plumas et al. | |

FOREIGN PATENT DOCUMENTS

| | | |
|---|---|---|
| EP | 0 106 873 | 5/1984 |
| EP | 0 352 761 | 1/1990 |
| EP | 0 516 953 | 12/1992 |
| EP | 0 633 028 | 1/1995 |
| EP | 0 636 696 | 2/1995 |
| EP | 0 420 913 | 11/1995 |
| EP | 0 423 201 | 6/1996 |
| EP | 0 742 014 | 11/1996 |
| EP | 0 949 508 | 10/1999 |
| EP | 0946592 | 10/1999 |
| EP | 1023319 | 8/2000 |
| EP | 0 776 339 | 10/2000 |
| EP | 1 051 619 | 11/2000 |
| EP | 1181313 | 2/2002 |
| EP | 0 981 747 | 7/2002 |
| EP | 1 227 321 | 7/2002 |
| EP | 0 630 255 | 12/2002 |
| EP | 0 812 331 | 5/2004 |
| EP | 0 935 607 | 7/2004 |
| EP | 1 437 366 | 7/2004 |
| EP | 0 877 760 | 9/2004 |
| EP | 1 526 141 | 8/2005 |
| EP | 0 997 477 | 3/2006 |
| EP | 1 017 799 | 3/2006 |
| EP | 1 349 569 | 4/2007 |
| EP | 0 665 289 | 5/2007 |
| EP | 1 012 320 | 10/2007 |
| RU | 2 260 047 | 4/2005 |
| WO | WO 89/12458 | 12/1989 |
| WO | WO 89/12459 | 12/1989 |
| WO | WO 90/04411 | 5/1990 |
| WO | WO 91/09870 | 7/1991 |

(56) References Cited

FOREIGN PATENT DOCUMENTS

| | | |
|---|---|---|
| WO | WO 91/15766 | 10/1991 |
| WO | WO 92/00055 | 1/1992 |
| WO | WO 92/08983 | 5/1992 |
| WO | WO 92/18150 | 10/1992 |
| WO | WO 92/21972 | 12/1992 |
| WO | WO 93/01498 | 1/1993 |
| WO | WO 93/01498 A1 * | 1/1993 |
| WO | WO 93/04175 | 3/1993 |
| WO | WO 93/08306 | 4/1993 |
| WO | WO 93/10220 | 5/1993 |
| WO | WO 94/11078 | 5/1994 |
| WO | WO 94/12196 | 6/1994 |
| WO | WO 95/11998 | 5/1995 |
| WO | WO 95/12676 | 5/1995 |
| WO | WO 95/14781 | 6/1995 |
| WO | WO 96/04314 | 2/1996 |
| WO | WO 96/26962 | 9/1996 |
| WO | WO 97/05239 | 2/1997 |
| WO | WO 97/28191 | 8/1997 |
| WO | WO 97/35991 | 10/1997 |
| WO | WO 97/42221 | 11/1997 |
| WO | WO 97/44667 | 11/1997 |
| WO | WO 98/03552 | 1/1998 |
| WO | WO 98/05965 | 2/1998 |
| WO | WO 98/06749 | 2/1998 |
| WO | WO 98/05684 | 5/1998 |
| WO | WO 1999/002183 | 1/1999 |
| WO | WO 99/11661 | 3/1999 |
| WO | WO 99/11775 | 3/1999 |
| WO | WO 99/14236 | 3/1999 |
| WO | 199924577 A1 | 5/1999 |
| WO | WO 99/21572 | 5/1999 |
| WO | WO 99/13095 | 7/1999 |
| WO | WO 1999/36568 | 7/1999 |
| WO | WO 99/42597 | 8/1999 |
| WO | WO 99/50637 | 10/1999 |
| WO | WO 99/58557 | 11/1999 |
| WO | WO 99/60119 | 11/1999 |
| WO | WO 2000/006745 | 2/2000 |
| WO | WO 00/15665 | 3/2000 |
| WO | 200021989 A1 | 4/2000 |
| WO | WO 00/23053 | 4/2000 |
| WO | WO 2000/075180 | 12/2000 |
| WO | WO 2000/078966 | 12/2000 |
| WO | WO 2003/000720 | 1/2001 |
| WO | WO 2001/63286 | 8/2001 |
| WO | 2001073443 A3 | 10/2001 |
| WO | WO 01/72782 | 10/2001 |
| WO | WO 01/70245 | 11/2001 |
| WO | WO 01/80833 | 11/2001 |
| WO | WO 01/90198 | 11/2001 |
| WO | WO 01/90747 | 11/2001 |
| WO | WO 2002/016422 | 2/2002 |
| WO | WO 02/054065 | 7/2002 |
| WO | WO 02/072631 | 9/2002 |
| WO | WO 02/089837 | 11/2002 |
| WO | WO 03/016905 | 2/2003 |
| WO | WO 02/055992 | 3/2003 |
| WO | WO 03/073097 | 9/2003 |
| WO | WO 02/083906 | 10/2003 |
| WO | WO 03/101473 | 12/2003 |
| WO | WO 2004/000873 | 12/2003 |
| WO | WO 2004/014957 | 2/2004 |
| WO | WO 2004/018520 | 3/2004 |
| WO | WO 2004/033497 | 4/2004 |
| WO | WO 2004/093905 | 11/2004 |
| WO | WO 05/002621 | 1/2005 |
| WO | WO 2005/007689 | 1/2005 |
| WO | WO 2005/035567 | 4/2005 |
| WO | WO 2005/049073 | 6/2005 |
| WO | WO 2005/116051 | 12/2005 |
| WO | WO 2006/009838 | 1/2006 |
| WO | WO 2006/014292 | 2/2006 |
| WO | WO 2006/056027 | 6/2006 |
| WO | WO 2006/071990 | 7/2006 |
| WO | WO 06/082387 | 8/2006 |
| WO | WO 2006/081826 | 8/2006 |
| WO | WO 2006/090283 | 8/2006 |
| WO | WO 2006/113622 | 10/2006 |
| WO | 2007015168 A2 | 2/2007 |
| WO | WO 2007/065098 | 6/2007 |
| WO | WO 2007/085266 | 8/2007 |
| WO | WO 2007/136778 | 11/2007 |
| WO | WO 2008/019366 | 2/2008 |
| WO | WO 2008/031133 | 3/2008 |
| WO | WO 2008/116468 | 10/2008 |
| WO | WO 2009/003492 | 1/2009 |
| WO | WO 2009/003493 | 1/2009 |
| WO | WO 2009/039854 | 4/2009 |
| WO | 2009077173 A2 | 6/2009 |
| WO | WO 2009/106073 | 9/2009 |
| WO | WO 2009/114207 | 9/2009 |
| WO | 2009126828 A2 | 10/2009 |
| WO | WO 2009/125231 | 10/2009 |
| WO | WO 2009/126816 | 10/2009 |
| WO | WO 2009/155535 | 11/2009 |
| WO | WO 2010/009735 | 1/2010 |
| WO | WO 2010/032022 | 3/2010 |
| WO | WO 2010/037395 | 4/2010 |
| WO | WO 2010/037397 | 4/2010 |
| WO | WO 2010/037402 | 4/2010 |
| WO | 2012044999 A2 | 4/2012 |
| WO | 2012094492 A2 | 7/2012 |

OTHER PUBLICATIONS

Celis et al (Mol. Immunol. 1994 31(18): 1423-1430).*
Busch et al (J. Immunol. 1996, 157: 3534-3541).*
Schueler-Furman et al (Protein Science, 2000, 9: 1838-1846).*
Theisen et al (J. Bacter. 1995, 177: 3036-3044).*
DiBrino et al (J. Immunology 151(11) 5930-5935, 1993).*
HLA Nomenclature (world wide web at hla.alles.org/nomenclature/stats.html, 2010).*
HLA Nomenclature 2015.*
DiBrino et al (J. Immunology 151(11) 5390-5935, 1993) (Year: 1993).*
Celis et al (Molecular Immunol. 3: 1423-1430, 1994 (Year: 1994).*
Ochoa-Garay et al (Mol. Immunol., 1997, 34(3): 273-281 )(Year: 1997).*
U.S. Appl. No. 08/374,468, Endl.
Altman, et al., "Formation of functional peptide complexes of class II major histocompatibility complex proteins from subunits produced in *Escherichia coli*," Proc. Natl. Acad. Sci. USA, pp. 10330-10334, Nov. 1993, vol. 90.
Altman, et al., "Phenotypic Analysis of Antigen-Specific T Lymphocytes," Science 274:94-97, 1996.
Andersen, et al., "Spontaneous cytotoxic T-cell responses against survivin MHC class I-restricted T-cell epttopes in situ as well as ex vivo in cancer patients," Cancer Res., vol. 61, pp. 5964-5968, Aug. 15, 2001.
Appel, et al., "Kinetics of T-cell receptor binding by bivalent HLA-DR-peptide complexes that activate antigen-specific human T-cells," J. Biol. Chem., pp. 312-321, Jan. 7, 2000, vol. 275.
Appel, et al., "Anergy induction by dimeric TCR ligands," J. Immunol., pp. 5279-5285, Apr. 15, 2001, vol. 166.
Ausubel, et al., "Characterization of in vivo expanded OspA-specific human T-cell clones," Clinical Immunology, Academic Press, pp. 313-322, Jun. 1, 2005 (Jun. 6, 2005), vol. 115, No. 3, US.
Bakker, et al., "MHC multimer technology: Current status and future prospects," Current Opinion in Immunology, 17:428-433, 2005.
Barany, et al., "Solid-phase peptide synthesis: A silver anniversary report," Int. J. Peptide Protein Res., 30:705-739, 1987.
Batard, et al., "Dextramers: New generation of fluorescent MHC class I/ peptide multimers for visualization of antigen-specific CD8< + > T cells," Journal of Immunological Methods, Elsevier Science Publishers, pp. 136-148, Mar. 20, 2006 (Mar. 20, 2006), vol. 310, No. 1-2, Amsterdam, NL.
Berger, et al., "Circulation and homing of melanoma-reactive T cells to both cutaneous and visceral metastases after vaccinnation with

(56) References Cited

OTHER PUBLICATIONS monocyte-derived dendritic cells," Int. J. Cancer, pp. 229-237, 2004, vol. 111.
Bergmeier, et al., "Innate and adoptive mucosal immunity in protection against HIV infection," Advances in Dental Research 2006, pp. 21-28, 2006, vol. 19, No. 1, XP002562924.
Bill, et al., "Use of soluble MHC class II/peptide multimers to detect antigen-specific T cells in human disease," Arthritis Res., pp. 261-265, Feb. 28, 2002, vol. 4.
Bjorkman, et al., "The foreign antigen binding site and T cell recognition regions of class I histocompatibility antigen," Nature 329:512-518, 1987.
Bogers, "CCR5 targeted SIV vaccination strategy preventing or inhabiting SIV infection," Vaccine, Butterworth Scientific, pp. 2974-2984, Aug. 13, 2004 (Aug. 13, 2004), vol. 22, No. 23-24. Guildford, GB.
Bross, et al., "Approval summary: Gemtuzumab ozogamicin in relapsed acute myeloid leukemia", Clin. Cancer Res., 2001, 7:1490-1496.
Burlingham, et al., "Soluble MHC, Immunoregulation, and tolerance: A progress report," Human Immunol., pp. 1316-1319, Dec. 2000, vol. 61.
Callan, et al., "Direct Visualizing of Antigen.specific CD8+ T Cells during th ePRimary Immune Response to Epstein-Barr Virus in Vivo," J. Exp. Med., May 1998, pp. 1395-1402, vol. 187, No. 9.
Cameron, et al., "Labeling antigen-specific DC4(+) T cells with class II MHC oligomers," J. Immunol. Methods, pp. 51-69, Oct. 1, 2002, vol. 268.
Carena, et al., "Major Histocompatibility Complex Class I Molecules Modulate Activation Threshold and Early Signaling of T-Cell Antigen Receptor-γδ Stimulated by Nonpeptidic Ligands," J. Exp. Med., Nov. 17, 1997, pp. 1769-1774, 186 (10).
Casares, et al., "Antigen-specific downregulation of T cells by doxorubicin delivered through a recombinant MHC II-peptide chimera," Nature Biotech., pp. 142-147, Feb. 2001, vol. 19.
Cochran, et al., "Receptor clustering and transmembrane signaling T cells," TIBS, pp. 304-310, May 2001, vol. 26.
Coles, et al., "Memory CD8 T lymphocytes express inhibitory MHC-specific Ly49 receptors," Eur. J. Immunol. 30:236-244, 2000.
Constantin, et al., "Major histocompatibility complex (MHC) tetramer technologt: An evaluation," Biol. Res. Nursing, pp. 115-127, Oct. 2002, vol. 4.
Dako: "MHC Dextramers" Internet Article Jul. 6, 2006 URL: pri.dako.com/00207_mhcdex_0406.pdf.
Dal Porto et al, "A soluble divalent class I major histocompatibility complex molecule inhibits alloreactive T cells at nanomolar concentrations," Porc. Natl. Acad. Sci. 90.6671-6675, 1993.
Devito-Haynes, et al., "Soluble donor HLA class I and β2-m-free heavy chain in serum of lung transplant recipients: Steady-state levels and increases in patients with recurrent CMV infection, acute rejection episodes, and poor outcome," Human Immunol., pp. 1370-1382, Dec. 2000, vol. 61.
Drouin, et al., "Searching for borrelial T-cell epitopes associated with antibiotic-refractory Lyme arthritis," Molecular Immunology, pp. 2323-2332, Jan. 11, 2008 (Jan. 11, 2008), vol. 45, No. 8, GB.
Ed. Charron, "HLA: Genetic diversity of HLA. Functional and Medical Implication," EDK Press, pages corresponding to Tables 1A and 1B, 1997.
Erout, et al., "Preparation of Conjugates between Oligonucleotide and N-Vinylpyrrolidone/N-Acryoxysuccinimide Coplymers and Applications in Nucleic Acid Assays to Improve Sensitivity," Bioconjugate Chem. 1996, pp. 568-575, vol. 7.
Fields, et al., "Solid phase peptide synthesis utilizing 9-fluorenylmethoxycarbonyl amino acids," Int. J. Peptide Res., 353:161-214, 1990.
Frayser, et al., "Empty and peptide-loaded class II major histocompatibility complex proteins produced by expression in *Escherichia coli* and folding in vitro," Protein Expression and Purification, pp. 105-114, Feb. 1999, vol. 15.

Garboczi, et al., "HlA-A2.peptide complexes: Refolding and crystallization of molecules expressed in *Escherichia coli* and complexed with single antigenic peptides," Proc. Natl. Acad. Sci., 89:3429-3433, 1992.
Gordon, et al., "Applications of Combinatorial Technologies to Drug Discovery. 2. Combinatorial Organic Synthesis, Library Screening Strategies, and Future Directions," Journal of Medicinal Chemistry, 37 (10):1385-1401, 1994.
Hadrup, et al., "Persistence of survivin specific T cells for seven years in a melanoma patient during complete remission," Cancer Biol. Ther., pp. 480-482, May 2006, vol. 5.
Houghten, et al., "Generation and use of synthetic peptide combinatorial libraries for basic research and drug discovery," Nature, 354:84-86, 1991.
Huges, et al., "Generation and use of alternative multimers of peptide/MHC complexes," Journal of Immunological Methods, 268:83-92, 2002.
Haanen, et al., "In situ detection of virus- and tumor-specific T-cell Immunity," Nature Medicine, Sep. 2000, pp. 1056-1060, vol. 6.
International Search report dated May 6, 2007 in International Application No. PCT/DK2007/000045.
Jung, et al., "Multiple Peptide Synthesis Methods and their Applications," Angewandte Chemie, 31 (4):367-486, 1992.
Kalandadze, et al., "Expression of Recombinant HLA-DR2 molecules," J. Biol. Chem., pp. 20156-20162, Aug. 16, 1996, vol. 271.
Knabel, et al., "Reversible MHC multimer staining for functional isolation of T-cell populations and effective adoptive transfer," Nature Medicine, Nature Publishing Group, pp. 631-637, Jun. 1, 2002 (Jun. 1, 2002), vol. 8, No. 6, New York, NY, USA.
Kozono, et al., "Production of soluble MHC class II proteins with covalently bound single peptides," Nature, pp. 151-154, May 12, 1994, vol. 369.
Kuroda, et al., "Analysis of Gag-specific Cytotoxic T Lymphocytes in Simian Immunodeficiency Virus-intected Rhesus Monkeys by Cell Staining with Tetrameric Major Histocompatibility Complex Class I-Peptide Complex," J.Exp. Med., May 4, 1998, 1373-1381, vol. 187, No. 9.
Kuttler, et al., "An Algorithm for the Prediction of Proteasomal Cleavages," J. Miol. Biol., 298:417-429, 2000.
König, "Interactions between MHC molecules and co-receptors of the TCR," Current Opinion in Immunology, pp. 75-83, 2002, vol. 14.
Larsson, "Immunocytochemical detection systems," in Immunocytohemistry: Theory and Practice, pp. 77-145, CRC Press, 1988.
Lee, et al., "Characterizatio of circulating T cells specific for tumor-associateda ntigens in melanoma patients," Nature Medicine, Jun. 1999, pp. 677-685, vol. 5, No. 6.
Lehner, "Allomicrovac: A combined microbicidal-immunising strategy against SIV and HIV infection," Vaccines for Humans, pp. 64-65, Dec. 5, 2008 (Dec. 5, 2008), XP0025629223, URL: biblioteca.porto.ucp.pt/docbweb/MULTIMEDIA/ASSOCIA/PDF/VAC.PDF.
Ljunggren, et al., "Empty MHC class I molecules come out in the cold," Nature 346:476-480, 1990.
Mallone, et al., "MHC class II tetramers and the pursuit of antigen-specific T cells: Define, deviate, delete," Clin. Immunol., pp. 232-242, 2004, vol. 110.
Marchand, et al., "Tumor regression responses in melanoma patients treated with a peptide encoded by gene MAGE-3," Int. J. Cancer, 63:883-885, 1995.
Matsumura, et al., "Emerging Principles for the Recognition of Peptide Antigen by MHC class I Molecules," Science 257:927-934, 1992.
Matsumura, et al., "In vitro peptide binding to soluble empty class I major histocompatibility complex molecules isolated from transfected *Drosophila melanogaster* cells," J. Biol. Chem., pp. 23589-23595, Nov. 25, 1992, vol. 267.
McCluskey, et al., "T-cell activation by purified, soluble, class I MHC molecules: Requirement for polyvalency," J. Immunol. 141(5): 1451-55, 1988.
McHeyzer-Williams, et al., "Tracking antigen-specific helper T cell responses," Current Opinion in Immunology, pp. 278-284, 1996, vol. 8.

(56) References Cited

OTHER PUBLICATIONS

Melenhorst, et al.,"Detection of Low Avidity CD8+ T Cell Populations with Coreceptor-Enhanced Peptide-Major Histompatibility Complex Class I Tetramers," j. Immunol. Methods, 2008, vol. 338, No. 1-2, pp. 31-39.

Merrifield, "Solid Phase Synthesis," Science 232:341-347, 1986.

Merrifield, et al., "Instrument for Automated Synthesis of peptides," Analytical Chemistry, 38 (13):1905-1914, 1966.

Meyer, et al., "Direct enumeration of Borrelia-reactive CD4 T-cell ex vivo by using MHC class II tetramers," Proceedings of the National Academy of Sciences of USA. (PNAS), National Academy of Science, pp. 11433-11438, Oct. 10, 2000 (Oct. 10, 2000), vol. 97, No. 21, Washington D.C., US.

Mutis, et al., "Tetrameric HLA class I-minor histocompatibility antigen peptide complexes demonstrate minor histocompatibility antigen-specific cytoxic T lymphocytes in patients with graft-visus-host disease," Nature Medicine, Jul. 1999, pp. 839-842, vol. 5, No. 7.

Neudorfer, et al., "Reversible HLA multimers (streptamers) for the isolation of human cytotoxic T lymphocytes functionally active against tumor- and virus-derived antigens," Journal of Immunological Methods, 320:119-131, 2007.

O'Herrin, et al., "Analysis of the Expression of Peptide-Major Histocaompatibility Complexes using high affinity Soluble Divalent T-Cell Receptors," The Journal of Biological Chemistry, Oct. 20, 1997, pp. 1333-1345, vol. 186, No. 8.

Reich, et al., "Stability of empty and peptide-loaded class II major histocompatibility complex molecules at neutral and endosomal pH: Comparison to class I proteins," Proc. Natl. Acad. Sci. USA, pp. 2495-2500, Mar. 1997, vol. 94.

Reijonen, et al., "Use of HLA class II tetramers in tracking antigen-specific T cell and mapping T-call epitopes," pp. 282-288, 2003, vol. 29.

Scheffold, et al., "Recent Development in Flow Cytometry," Journal of Clinical Immunology, Aug. 2000, vol. 20, No. 6.

Scheirle, et al., "Peptide binding to soluble HLA-DR4 molecules produced by insect cells," J. Immunol., pp. 1994-1999, Sep. 15, 1992, vol. 149.

Sengupta, et al., "Heat shock protein-mediated cross-presentation of exogenous HIV antigen on HLA class I and class II," Journal of Immunology, American Association of Immunologists, pp. 1987-1993, Aug. 1, 2004 (Aug. 1, 2004), vol. 173, No. 3.

Shambrook, Fritsch and Maniatis, "Molecular Cloning," Cold Spring Harbor Press, 1989, Index and Table of Contents pp. xi to xxxviii and I-1 to I-47.

Shields, et al., "The Effect of Human β2-Microglobulin on Major Histocompatibility Complex I Peptide Loading and the Engineering of a High Affinity Variant," The Journal of Biological Chemistry, Oct. 23, 1998, pp. 28010-28018, vol. 273, No. 43.

Siiman, et al., Bioconjugate Chem. 1999, vol. 10, pp. 1090-1106.

Skinner, et al., "In situ tetramer staining," J. Immunol. Meth., pp. 29-34, 2002, vol. 268.

Stern, et al., "The human class II MHC protein HLA-DR1 assembles as empty alpha beta heterodimers in the absence of antigenic peptide," Cell, pp. 465-477, Feb. 7, 1992, vol. 68.

Stratmann, et al., "Susceptible MHC Alleles, not background genes, select an autoimmune T cell reactivity," The Journal of Clinical Investigation, pp. 902-914, Sep. 2003, vol. 112, No. 6.

Stockel, et al., "Refolding of human class II major histocompatibility complex molecules isolated from *Escherichia coli*", J. Biol. Chem., pp. 29571-29578, Nov. 25, 1994, vol. 269.

Sun, et al., "MHC class I multimers," Arthritis Res., pp. 265-269, Jul. 2001, vol. 3.

Sørensen, et al., "Efficient tumor cell lysis mediated by a bcl-X(L) specific T cell clone isolated from a breast cancer patient," Cancer Immunol., Immunotherapy, Springer, pp. 527-533, Jul. 19, 2006, vol. 56, No. 4, Berlin, DE.

Ugolini, et al., "Regulation of T cell function by NK cell receptors for classical MHC class I molecules," Current Opinion in Immunology 12:295-300, 2000.

Valmori, et al., "Enhanced generation of specific tumor-reactive CTL in vitro by selected Melan-A/MART-1 immunodominant peptide analogues," J. Immunol., pp. 1750-1758, Feb. 15, 1998, vol. 160.

Viola, et al., "T-cell activation and the dynamic world of rafts.," APMIS 107:615-623, 1999.

Vollers, et al.,"Class II Major Histocompatibility Complex Tetramer Staining: Progress, Problems, and Prospects," Immunology, 2008, vol. 123, pp. 305-313.

Vyth-Dreese, et al., "In situ visualization of antigen specific T cells in cryopreserved human tissues," J. Immunol. Meth., pp. 78-85, 2006, vol. 310.

White, et al., "Soluble class I MHC with β2-microglobulin covalently linked peptides: Specific binding to a T cell hybridoma," J. Immunol., pp. 2671-2676, Mar. 1, 1999, vol. 162.

Xu, et al., "MHC/peptide tetramer-based studies of T cell function," J. Immunol Meth., pp. 21-28, 2002, vol. 268.

Zhang, et al., "Essential role of LAT in T cell development," Immunity 10:323-332, 1999.

Bleesing, et al., "Cell Function-Based Flow Cytometry" Seminars in Hematology, Apr. 2001, pp. 169-178, vol. 38, No. 2.

Drouin, et al., "Molecular characterization of the OspA161-175 T cell epitope associated with treatment-resistant Lyme arthritis: differences among the three pathogenic species of *Borrelia burgdorferi* sensu lato", Journal of Autoimmunity, 2004, vol. 23, pp. 281-292.

Fornas, et al., Flow Cytometry Counting of CD34+ cells in whole blood, Nature Medicine, 6 (2000) 7:833-836.

Heijnen, et al., "Enumeration of Antigen-Specific CD8+ T Lymphocytes by Single-Platform, HLA Tetramer-Based Flow Cytometry: A European Multicenter Evaluation", Clinical Cytometry, 2004, pp. 1-13, vol. 62B.

Marsh, et al., "12th International Histocompatibility Workshop Cell Lines Panel: List of Cell Lines", Genetic diversity of HLA Functional and Medical Implication, (Charron ed.), pp. 26-28, 1997.

Wolfl, et al., "Quantitation of MHC Tetramer-Positive Cells From Whole Blood: Evaluation of Single-Platform, Six-parameter Flow Cytometric Method", Cytometry Part A, 2004, pp. 120-130, vol. 57A.

Cecconi, et al., "Use of MHC Class II Tetramers to Investigate CD4 + T Cell Responses: Problems and Solutions," Cytometry, 2008, Part A 73, No. 11, pp. 1010-1018.

Chattopadhyay, et al., "Techniques to improve the direct Ex Vivo detection of low frequency antigen-specific CD8+T cells with peptide-major histocompatibility complex class I tetramers," Cytometry, 2008, Part A, vol. 73, pp. 1001-1009.

Lissina, et al.,"Protein Kinase Inhibitors Substantially Improve the Physical Detection of T-Cells with Peptide-MHC Tetramers," J. Immunol. Methods, 2009, vol. 340, pp. 11-24.

Melenhorst, et al.,"Detection of Low Avidity CD8+ T Cell Populations with Coreceptor-Enhanced Peptide-Major Histocompatibility Complex Class I Tetramers," J. Immunol. Methods, 2008, vol. 338, No. 1-2, pp. 31-39.

Weichsel, et al.,"Profound Inhibition of Antigen-Specific T-Cell Effector Functions by Dasatinib," Clin. Cancer Res.2008, vol. 14, pp. 2484-2491.

Alp, et al., "Fine specificity of cellular immune responses in humans to human cytomegalovirus immediate-early 1 protein", Journal of Virology, vol. 65, No. 9, 1991 pp. 4812-4820.

Ferré, et al., "Purification of correctly oxidized MHC class I heavy-chain molecules under denaturing conditions: A novel strategy exploiting disulfide assisted protein folding", Protein Science, 2003, 12, pp. 551-559.

Dibrino et al., "Endogenous peptides bound to HLA-A3 possess a specific combination of anchor residues that permit identification of potential antigenic peptides", PNAS USA, 1993, vol. 90, pp. 1508-1512.

Parker et al, "Peptide binding to HLA-A2 and HLA-B27 isolated from *Escherichia coli*", JBC, 1992, vol. 267, pp. 5451-5459.

IEBD Analysis Ressource, Jul. 2012, 3 pages, world wide web at tools.immuneepitiope.org/tools/population/tutorial.jsp.

Akiyama et al. "Analysis of HLA-A24-restricted CMVpp65 peptide-specific CTL with HLA-A*2402-CMVpp65 tetramer," Immunology Letters, vol. 95, pp. 199-205, (2004).

(56) References Cited

OTHER PUBLICATIONS

Chen et al. "Modulation of CD1d-restricted NKT cell responses by CD4," Journal of Leukocyte Biology, vol. 82, pp. 1455-1465 (2007).

Denkberg et al. "Recombinant human single-chain MHC-peptide complexes made from E. coli by in vitro refolding: functional single-chain MHC-peptide complexes and tetramers with tumor associated antigens," Eur. J. Immunol., vol. 30, pp. 3522-3532 (2000).

Drake et al. "Cutting Edge: Lipid Raft Integrity Affects the Efficiency of MHC Class I Tetramer Binding and Cell Surface TCR Arrangement on CD8+ T Cells1," The Journal of Immunology, vol. 166, No. 12, pp. 7009-7013 (2001).

He et al. "Procedure for preparing peptide-major histocompatibility complex tetramers for direct quantification of antigen-specific cytotoxic T lymphocytes," World J Gastroenterol, vol. 11, No. 27, pp. 4180-4187 (2005).

Kao et al. "Loss of CD8 and TCR binding to Class I MHC ligands following T cell activation," International Immunology, vol. 17, No. 12, pp. 1607-1617 (2005).

Kronenberg et al. "The unconventional lifestyle of NKT cells," Nature Reviews Immunology vol. 2 No. 8 pp. 557-568 (2002).

Nepom "MHC multimers: expanding the clinical toolkit," Clinical Immunology, vol. 106, pp. 1-4 (2003).

Rognan et al., "Rational design of nonnatural peptides as high-affinity ligands for the HLA-B*2705 human leukocyte antigen", Proc. Natl. Acad. Sci., vol. 92, 1995, pp. 753-757 (1995).

Ruan et al. "Preparation of HLA-A*0201 NLVPMVATV peptide tetramers and application to detect cytomegalovirus specific CTL," Chin J Microbiol Immunol., vol. 26., No. 9, pp. 855-858 (2006)—English Abstract Only.

Ruan et al. "Improved preparation of class I HLA tetramers and their use in detecting CMV-specific CTL," Journal of Immunological Methods, vol. 312, pp. 148-156 (2006).

Weinberg "The Biology of Cancer," Garland Science, pp. 737-747 (2007).

Wulff, "Guide to Flow Cytometry," Dako Educational Guide, www.dako.com, (2006), pp. i to 117.

Andersen et al., "Parallel detection of antigen-specific T-cell responses by combinatorial encoding of MHC multimers," Nat Protoc. vol. 7, No. 5, pp. 891-902 (2012).

Bauer et al., Maximizing Immune Responses: The Effects of Covalent Peptide Linkage to Beta-2-Microglobulin, Oncology Research, vol. 17, pp. 205-216 (2008).

Celis et al., "Induction of anti-tumor cytotoxic T lymphocytes in normal humans using primary cultures and synthetic peptide epitopes," Proc. Natl. Acad. Sci. USA, vol. 91, pp. 2105-2109 (1994).

Cortez-Gonzales et al., Immunogenic HLA-B7-restricted peptides of hTRT. Intl Immunology, vol. 18 No. 12 pp. 1707-1718 (2006).

Desrosiers, "Prospects for an AIDS vaccine," Nature Medicine, vol. 10, No. 3, (2004).

Greten et al., "Peptide-beta-2-microglubulin-MHC fusion molecules bind antigen-specific T cells and can be used for multivalent MHC-Ig complexes," J. Immunological Methods, 27(1-2):125-135 (2002).

Hackett et al., "Frontiers in peptide-MHC class II multimer technology," Nature Immunology, vol. 3, No. 10 (2002).

Karin et al., "Reversal of Experimental Autoimmune Encephalomyelitis by a Soluble Peptide Variant of a Myelin Basic Protein Epitope: T Cell Receptor Antagonism and Reduction of Interferon γ and Tumor Necrosis Factor α Production," J. Exp. Med., vol. 180, pp. 2227-2237 (1994).

Larsen, MV, "Prediction of T-cell epitopes for therapeutic and prophylactic vaccines," Ph.D. thesis, Center for Biological Sequence Analysis BioCentrum DTU—Denmark. (2007).

Lauritsen et al., Two distinct pathways exist for down-regulation of the TCR, J, Immunology, 161:260-7 (1998).

Maher, Liposomes and Micelles, Dynamic Chiropractic. www.dynamicchirpractic.com (2016).

Matthews et al., "Prospects for Development of a Vaccine Against HTLV-III-Related Disorders," AIDS Research and Human Retroviruses, vol. 3 Supplement I, (1987).

Nikolich-Zugich et al., "The many important facets of t-cell repertoire diversity, Nature Reviews Immunology," vol. 4, 123-132 (2004).

Ochoa-Garay et al., "The ability of peptides to induce cytotoxic T cells in vitro does not strongly correlate with their affinity for the H-2Ld molecule: Implications for vaccine design and immunotherapy," Molecular Immunology vol. 34, No. 3 273-281, (1997).

Oka et al., "Induction of WT1 (Wilms' tumor gene)-specific cytotoxic T lymphocytes by WT1 peptide vaccine and the resultant cancer regression," PNAS, vol. 101 No. 38, 13885-13890 (2004).

Rammensee et al., "MHC ligands and peptide motifs: first listing. Immunogenetics," 41:178-228 (1995).

Hadrup et al., "Parallel detection of antigen-specific T-cell responses by multidimensional encoding of MHC multimers", Nature Methods (Nature Publishing Group), Basingstoke GB, vol. 6, No. 7, doi:10.1038/NMETH.1345, ISSN 1548-7091, pp. 520-528, (2009).

Schueler-Furman et al., "Structure-based prediction of binding peptides to MHC class I molecules: Application to a broad range of MHC alleles," Protein Science, vol. 9, pp. 1838-1846 (2000).

Schroers et al., "Identification of HLA DR7-restricted epitopes from human telomerase reverse transcriptase recognized by CD4+ T-helper cells," Cancer Research 62, 2600-2605, (2002).

Speiser et al., In Vivo Activation of Melanoma-Specific CD8(+) T Cells by Endogenous Tumor Antigen and Peptide Vaccines. A Comparison to Virus-Specific T Cells, Eur. J. Immunol. 32: 731-741 (2002).

Stoeva et al., "Multiplexed Detection of Protein Cancer Markers with Biobarcoded Nanoparticle Probes", J. American Chemical Society, vol. 128, No. 26, doi:10.1021/JA0613106, ISSN 0002-7863, pp. 8378-8379, (2006).

Sano et al., "Immuno-PCR: Very sensitive antigen detection by means of specific antibody-DNA conjugates," Science American Association for the Advancement of Science, US, vol. 258, No. 5079, 120-122 (1992).

Xu et al., "Preparation and Characterization of HLA-A *0201 Tretamer Loaded with IE-1 316-324 Antigenic Peptide of Human Cytomegalovirus," Cullular & Molecular Immunology, vol. 3, No. 5, pp. 367-371 (2006).

Yang et al. "Immunization with recombinant macaque major histocompatibility complex class I and II and human immunodeficiency virus gp140 inhibits simian-human immunodeficiency virus infection in macaques," Journal of General Virology, vol. 93, pp. 1506-1518 (2012).

* cited by examiner

Fig 1. Schematic representation of MHC multimer

Figure 2: Program for peptide sequence motifs prediction

```
Imports System.IO

Public Class Form1

Dim TRACE_LOG = ""
    Dim CR = "-"
    Dim BACKSLASH = "\"
    Dim COLON = ":"
    Dim SPACE = " "

Private Sub Button_valgmappe_Click(ByVal sender As System.Object, ByVal e As
System.EventArgs) Handles Button_valgmappe.Click
        Dim fdlg As FolderBrowserDialog = New FolderBrowserDialog()

If fdlg.ShowDialog() = Windows.Forms.DialogResult.OK Then
            Txt_mappe.Text = fdlg.SelectedPath
        End If
    End Sub Private Sub Button_gem_Click(ByVal sender As System.Object, ByVal e As
System.EventArgs) Handles Button_gem.Click
        If Txt_sekvens.Text = Nothing Then
            MessageBox.Show("Indtast sekvens")
            Exit Sub
        End If
        If Txt_fil.Text = Nothing Then
            MessageBox.Show("Indtast filnavn")
            Exit Sub
        End If
        If Txt_mappe.Text = Nothing Then
            MessageBox.Show("Vælg mappe")
            Exit Sub
        End If TRACE_LOG = Txt_mappe.Text + "/" + Txt_fil.Text + ".txt"
        If File.Exists(TRACE_LOG) Then
            MessageBox.Show("Filen findes allerede og kan ikke overskrives")
            Exit Sub
        End If
```

Figure 2 cont.

```
    Dim n = Txt_sekvens.Text.Length
    Trace_skriv("Sequence length: " & n)

Trace_skriv("CR")
    Trace_skriv("CR")

Dim min = CInt(Txt_min.Text)
    Dim max = CInt(Txt_max.Text)
    Dim j As Integer
    Dim i As Integer
    Dim tmptxt As String
    Dim peptid As String For j = min To max
       Trace_skriv(j & " mers:")
       Trace_skriv("CR")
       tmptxt = ""
       For i = 0 To n - j
          peptid = Txt_sekvens.Text.Substring(i, j)
          If CheckBox_validering.Checked Then
             If valideret(peptid) Then
                tmptxt = tmptxt + peptid & CR
             End If
          Else
             tmptxt = tmptxt + peptid & CR
          End If
       Next
       Trace_skriv(tmptxt)
       Trace_skriv("CR")
       Trace_skriv("CR")
    Next End Sub Private Function valideret(ByVal peptid As String)
   If CheckBox_validering_stopkodon.Checked Then
      If InStr(peptid, "*") Then
         Return False
      Else
```

Figure 2 cont.

```
            Return True
        End If
    Else
        Return True
    End If
End Function Private Sub Form1_Load(ByVal sender As System.Object, ByVal e As
System.EventArgs) Handles MyBase.Load
    Txt_min.Text = 8

Txt_max.Text = 11
End Sub

Friend Sub Trace_skriv(ByVal texttoadd As String)
    Dim logtext() As String
    Dim fileline() As String
    Dim fs As StreamWriter
    Dim strace As New StackTrace(True)
    Try
        If Not File.Exists(TRACE_LOG) Then
            fs = File.CreateText(TRACE_LOG)
            'fs.Write("Trace Log " & Format(Now) & CR & CR)
            fs.Flush()
            fs.Close()
        End If
        logtext = strace.GetFrame(1).ToString.Split(Space)
        fileline = logtext(6).Split(BACKSLASH)
        Dim i As Integer = fileline.GetUpperBound(0)
        fs = File.AppendText(TRACE_LOG)
        If texttoadd = "CR" Then
            fs.WriteLine()
        Else
            Dim tmp = Split(texttoadd, CR)
            If UBound(tmp) = 0 Then
                fs.Write(tmp(0))
            Else
                For i = LBound(tmp) To UBound(tmp) - 1
                    fs.Write(tmp(i))
```

Figure 2 cont.

```
            If Me.CheckBox_semikolon.Checked Then
               fs.Write("; ")
            End If
            If Me.CheckBox_linie.Checked And i < UBound(tmp) - 1 Then
               fs.WriteLine()
            End If
          Next
        End If
      End If
      fs.Flush()
      fs.Close()
    Catch ex As Exception
      MsgBox(ex.ToString)
    End Try
  End Sub
End Class
```

Figure 3

Full List of HLA Class I alleles assigned as of January 2007 from
http://www.anthonynolan.org.uk/HIG/lists/class1list.html

```
HLA-AHLA-BHLA-CHLA-EHLA-FHLA-G
A*01010101B*070201Cw*010201E*01010101F*01010101G*01010101
A*01010102NB*070202Cw*010202E*01010102F*01010102G*01010102
A*010102B*070203Cw*010203E*01010103F*01010103G*01010103
A*010103B*070204Cw*010204E*01030101F*01010104G*01010104
A*010104B*0703Cw*0103E*01030102F*01010105G*01010105
A*0102B*0704Cw*0104E*010302F*01010106G*01010201
A*0103B*070501Cw*0105E*010303F*01010107G*01010202
A*0104NB*070502Cw*0106E*010304F*01010108G*010103
A*0106B*070503Cw*0107E*0104F*01010201G*010104
A*0107B*0706Cw*0108F*01010202G*010105
A*0108B*0707Cw*0109F*01010203G*010106
A*0109B*0708Cw*0110F*01010204G*010107
A*0110B*0709Cw*0111F*01010205G*010108
A*0111NB*0710Cw*0112F*01010301G*010109
A*0112B*0711Cw*0113F*01010302G*010110
A*0113B*0712Cw*020201F*01010303G*0102
A*0114B*0713Cw*020202F*01010304G*0103
A*0115NB*0714Cw*020203F*0102G*010401
A*0116NB*0715Cw*020205F*01030101G*010402
A*0117B*0716Cw*0203F*01030102G*010403
A*0118NB*0717Cw*0204F*0104G*0105N
A*0119B*0718Cw*0205G*0106
A*0120B*0719Cw*0206G*0107
A*02010101B*0720Cw*0207
A*02010102LB*0721Cw*0208
A*020102B*0722Cw*0209
A*020103B*0723Cw*0210
A*020104B*0724Cw*0211
A*020105B*0725Cw*0212
A*020106B*0726Cw*0213
A*020107B*0727Cw*0214
A*020108B*0728Cw*0215
A*020109B*0729Cw*0216
A*020110B*0730Cw*0217
A*020111B*0731Cw*030201
```

Figure 3 cont.

```
A*020112B*0732Cw*030202
A*0202B*0733Cw*030301
A*020301B*0734Cw*030302
A*020302B*0735Cw*030303
A*0204B*0736Cw*030304
A*0205B*0737Cw*030305
A*020601B*0738Cw*030401
A*020602B*0739Cw*030402
A*020603B*0740Cw*030403
A*0207B*0741Cw*030404
A*0208B*0742Cw*030405
A*0209B*0743Cw*0305
A*0210B*0744Cw*0306
A*0211B*0745Cw*0307
A*0212B*0746Cw*0308
A*0213B*0747Cw*0309
A*0214B*0748Cw*0310
A*0215NB*0749NCw*031101
A*0216B*0750Cw*031102
A*021701B*0751Cw*0312
A*021702B*080101Cw*0313
A*0218B*080102Cw*0314
A*0219B*080103Cw*0315
A*022001B*0802Cw*0316
A*022002B*0803Cw*0317
A*0221B*0804Cw*0318
A*0222B*0805Cw*0319
A*0224B*0806Cw*0320N
A*0225B*0807Cw*0321
A*0226B*0808NCw*0322Q
A*0227B*0809Cw*0323
A*0228B*0810Cw*0324
A*0229B*0811Cw*0325
A*0230B*0812Cw*0326
A*0231B*0813Cw*0327
A*0232NB*0814Cw*0328
A*0233B*0815Cw*0329
A*0234B*0816Cw*0330
A*023501B*0817Cw*0331
```

Figure 3 cont.

```
A*023502B*0818Cw*0332
A*0236B*0819NCw*0333
A*0237B*0820Cw*0334
A*0238B*0821Cw*0335
A*0239B*0822Cw*04010101
A*0240B*0823Cw*04010102
A*0241B*0824Cw*040102
A*0242B*0825Cw*040103
A*0243NB*0826Cw*040104
A*0244B*0827Cw*0403
A*0245B*0828Cw*040401
A*0246B*0829Cw*040402
A*0247B*0830NCw*0405
A*0248B*0831Cw*0406
A*0249B*1301Cw*0407
A*0250B*130201Cw*0408
A*0251B*130202Cw*0409N
A*0252B*130203Cw*0410
A*0253NB*1303Cw*0411
A*0254B*1304Cw*0412
A*0255B*1306Cw*0413
A*0256B*1307NCw*0414
A*0257B*1308Cw*0415
A*0258B*1309Cw*0416
A*0259B*1310Cw*0417
A*0260B*1311Cw*0418
A*0261B*1312Cw*0419
A*0262B*1313Cw*0420
A*0263B*1314Cw*0421
A*0264B*1315Cw*0423
A*0265B*1316Cw*0424
A*0266B*1317Cw*050101
A*0267B*1401Cw*050102
A*0268B*140201Cw*050103
A*0269B*140202Cw*0502
A*0270B*1403Cw*0503
A*0271B*1404Cw*0504
A*0272B*1405Cw*0505
A*0273B*140601Cw*0506
```

Figure 3 cont.

A*027401B*140602Cw*0507N
    A*027402B*1407NCw*0508
    A*0275B*15010101Cw*0509
    A*0276B*15010102NCw*0510
    A*0277B*150102Cw*0511
    A*0278B*150103Cw*0512
    A*0279B*150104Cw*0513
    A*0280B*1502Cw*0514
    A*0281B*1503Cw*0515
    A*0282NB*1504Cw*06020101
    A*0283NB*1505Cw*06020102
    A*0284B*1506Cw*060202
    A*0285B*1507Cw*0603
    A*0286B*1508Cw*0604
    A*0287B*1509Cw*0605
    A*0288NB*1510Cw*0606
    A*0289B*151101Cw*0607
    A*0290B*151102Cw*0608
    A*0291B*151103Cw*0609
    A*0292B*1512Cw*0610
    A*0293B*1513Cw*0611
    A*0294NB*1514Cw*0612
    A*0295B*1515Cw*0613
    A*0296B*1516Cw*0614
    A*0297B*15170101Cw*070101
    A*0299B*15170102Cw*070102
    A*03010101B*151702Cw*070103
    A*03010102NB*1518Cw*070104
    A*03010103B*1519Cw*070105
    A*030102B*1520Cw*070106
    A*030103B*1521Cw*070107
    A*030104B*1523Cw*07020101
    A*030105B*1524Cw*07020102
    A*0302B*1525Cw*07020103
    A*0303NB*1526NCw*0703
    A*0304B*1527Cw*070401
    A*0305B*1528Cw*070402
    A*0306B*1529Cw*0705
    A*0307B*1530Cw*0706

```
A*1115B*1572Cw*080101
A*1116B*1573Cw*080102
A*1117B*1574Cw*0802
A*1118B*1575Cw*0803
A*1119B*1576Cw*0804
A*1120B*1577Cw*0805
A*1121NB*1578Cw*0806
A*1122B*1579NCw*0807
A*1123B*1580Cw*0808
A*1124B*1581Cw*0809
A*1125B*1582Cw*0810
A*1126B*1583Cw*0811
A*1127B*1584Cw*0812
A*1128B*1585Cw*0813
A*1129B*1586Cw*0814
A*2301B*1587Cw*120201
A*2302B*1588Cw*120202
A*2303B*1589Cw*120203
A*2304B*1590Cw*12030101
A*2305B*1591Cw*12030102
A*2306B*1592Cw*120302
A*2307NB*1593Cw*120303
A*2308NB*1594NCw*120304
A*2309B*1595Cw*120401
A*2310B*1596Cw*120402
A*2311NB*1597Cw*1205
A*2312B*1598Cw*1206
A*2313B*1599Cw*1207
A*2314B*9501Cw*1208
A*24020101B*9502Cw*1209
A*24020102LB*9503Cw*1210
A*240202B*9504Cw*1211
A*240203B*9505Cw*1212
A*240204B*9506Cw*1213
A*240205B*9507Cw*1214
A*240206B*9508Cw*1215
A*240207B*9509Cw*1216
A*240208B*9510Cw*1217
A*240209B*9511NCw*1218
```

Figure 3 cont.

A*240210B*9512Cw*1219
A*240211B*9513Cw*140201
A*240212B*9514Cw*140202
A*240213B*9515Cw*140203
A*240301B*9516Cw*140204
A*240302B*9517Cw*1403
A*2404B*9518Cw*1404
A*2405B*9519Cw*1405
A*2406B*9520Cw*1406
A*2407B*9521Cw*1407N
A*2408B*9522Cw*1408
A*2409NB*180101Cw*150201
A*2410B*180102Cw*150202
A*2411NB*180103Cw*150203
A*2413B*1802Cw*1503
A*2414B*1803Cw*1504
A*2415B*1804Cw*150501
A*2417B*1805Cw*150502
A*2418B*1806Cw*150503
A*2419B*1807Cw*150504
A*2420B*1808Cw*1506
A*2421B*1809Cw*1507
A*2422B*1810Cw*1508
A*2423B*1811Cw*1509
A*2424B*1812Cw*1510
A*2425B*1813Cw*1511
A*2426B*1814Cw*1512
A*2427B*1815Cw*1513
A*2428B*1817NCw*1514
A*2429B*1818Cw*1515
A*2430B*1819Cw*1516
A*2431B*1820Cw*1517
A*2432B*1821Cw*160101
A*2433B*1822Cw*160102
A*2434B*1823NCw*1602
A*2435B*1824Cw*160401
A*2436NB*2701Cw*1606
A*2437B*2702Cw*1607
A*2438B*2703Cw*1608

B*5706
B*5707
B*5708
B*5709
B*5710
B*5711
B*5801
B*5802
B*5804
B*5805
B*5806
B*5807
B*5808
B*5809
B*5810N
B*5811
B*5812
B*5813
B*5814
B*5901
B*5902
B*670101
B*670102
B*6702
B*7301
B*7801
B*780201
B*780202
B*7803
B*7804
B*7805
B*8101
B*8102
B*8201
B*8202
B*8301
HLA-HHLA-JHLA-KHLA-LHLA-P
H*01010101J*01010101K*01010101L*01010101P*01010101
H*01010102J*01010102K*01010102L*01010102P*01010102

Figure 4: Top 30 HLA class 1 allele frequency in human ethnic groups

Data from HLA Matchmaker, http://tpis.upmc.edu/tpis/HLAMatchmaker/

| % chance of allele expressed in an individual | | | | | | | |
|---|---|---|---|---|---|---|---|
| Top 30 expressed alleles | | | | | | | |
| Allele | Caucasian | Allele | African-American | Allele | Hispanic | Allele | Oriental |
| A*0201 | 45.6% | C*0401 | 29.0% | A*0201 | 37.1% | A*1101 | 38.4% |
| C*0701 | 27.7% | C*0701 | 25.4% | C*0401 | 25.4% | A*2402 | 33.7% |
| A*0101 | 27.4% | C*0602 | 23.0% | A*2402 | 24.9% | C*0702 | 33.3% |
| A*0301 | 23.8% | A*0201 | 22.3% | C*0702 | 24.2% | C*0102 | 27.7% |
| C*0702 | 21.5% | A*2301 | 20.7% | C*0701 | 20.8% | A*3303 | 23.3% |
| C*0401 | 21.2% | C*0202 | 19.0% | C*0304 | 14.4% | C*0801 | 21.6% |
| B*4402 | 20.2% | A*0301 | 18.7% | A*0301 | 14.3% | C*0304 | 19.9% |
| B*0702 | 18.1% | C*0702 | 18.1% | B*0702 | 13.2% | A*0201 | 18.1% |
| B*0801 | 18.1% | B*5301 | 18.1% | B*3501 | 12.8% | B*4001 | 15.2% |
| C*0501 | 17.2% | B*0702 | 15.8% | C*0602 | 12.3% | C*0401 | 14.0% |
| C*0304 | 16.8% | C*1601 | 15.7% | C*0501 | 11.9% | B*5801 | 13.3% |
| C*0602 | 15.7% | B*1503 | 13.9% | A*0101 | 11.4% | B*4601 | 12.7% |
| A*1101 | 15.3% | B*5801 | 13.5% | A*1101 | 11.0% | B*5101 | 12.4% |
| B*4001 | 13.6% | A*6802 | 12.7% | B*5101 | 10.8% | C*0302 | 12.0% |
| A*2402 | 12.1% | C*1701 | 11.7% | C*1601 | 10.6% | B*3802 | 11.4% |
| B*3501 | 10.7% | B*4501 | 10.8% | B*4403 | 9.9% | A*0207 | 11.0% |
| C*0303 | 10.6% | B*4201 | 10.5% | C*0102 | 9.7% | B*1501 | 9.4% |
| B*5101 | 10.4% | A*3001 | 10.4% | A*2902 | 9.7% | A*0206 | 9.3% |
| C*1203 | 9.9% | B*3501 | 10.1% | C*0802 | 9.3% | C*0303 | 9.2% |
| B*1501 | 9.6% | A*0101 | 10.0% | B*1801 | 9.1% | B*1502 | 9.1% |
| A*2902 | 8.9% | C*0304 | 9.3% | A*3101 | 8.9% | A*0203 | 8.8% |
| A*2601 | 8.2% | A*3002 | 9.2% | B*5201 | 8.6% | B*4403 | 8.6% |
| A*3201 | 8.2% | B*0801 | 8.5% | B*1402 | 8.6% | C*1402 | 8.4% |
| C*0802 | 7.7% | A*3402 | 8.4% | C*0202 | 7.6% | B*3501 | 7.2% |
| A*2501 | 7.5% | A*7401 | 8.4% | C*1203 | 7.6% | C*0602 | 7.0% |
| B*5701 | 7.1% | A*3303 | 8.0% | A*2601 | 7.6% | B*5401 | 6.9% |
| B*1402 | 6.7% | C*1801 | 7.3% | A*6801 | 7.1% | B*1301 | 6.6% |
| C*0202 | 6.6% | A*2902 | 7.2% | B*0801 | 7.0% | B*4002 | 6.3% |
| B*1801 | 6.4% | B*4403 | 6.9% | A*3002 | 6.8% | B*5502 | 6.3% |
| B*4403 | 6.4% | B*4901 | 6.9% | B*4402 | 6.5% | A*2601 | 6.0% |

Figure 5: Reactive groups and the bonds formed upon their reaction.

A

Nucleophilic substitution reaction

Figure 5 cont.

Aromatic nucleophilic substitution

SUBSTITUTED AROMATIC COMPOUNDS

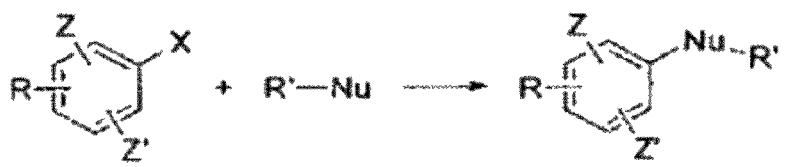

Nu = Oxygen-, Nitrogen-, Sulfur- and Carbon Nucleophiles
X = F, Cl, Br, I, $OSO_2CH_3$, $OSO_2CF_3$, $OSO_2TOL$, . , etc.
Z', Z = COOR, CHO, COR, $CONR"_2$, $COO^-$, CN,
$NO_2$, SOR, $SO_2R$, $SO_2NR"_2$.. ect.

Transition metal catalysed reactions

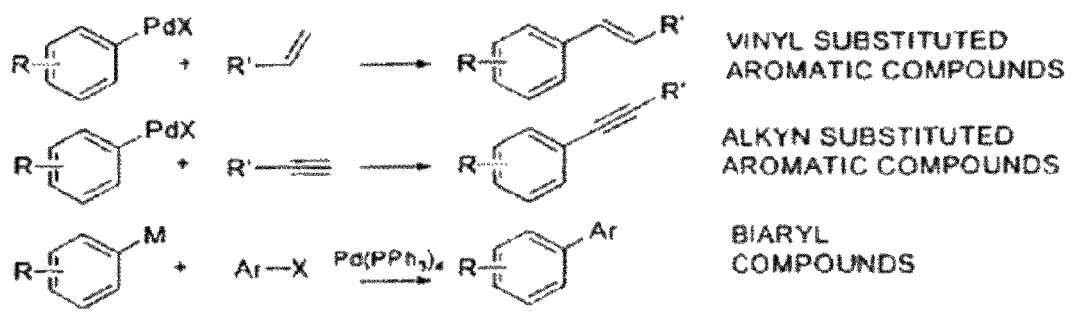

VINYL SUBSTITUTED AROMATIC COMPOUNDS

ALKYN SUBSTITUTED AROMATIC COMPOUNDS

BIARYL COMPOUNDS

Addition to carbon-carbon multiplebonds

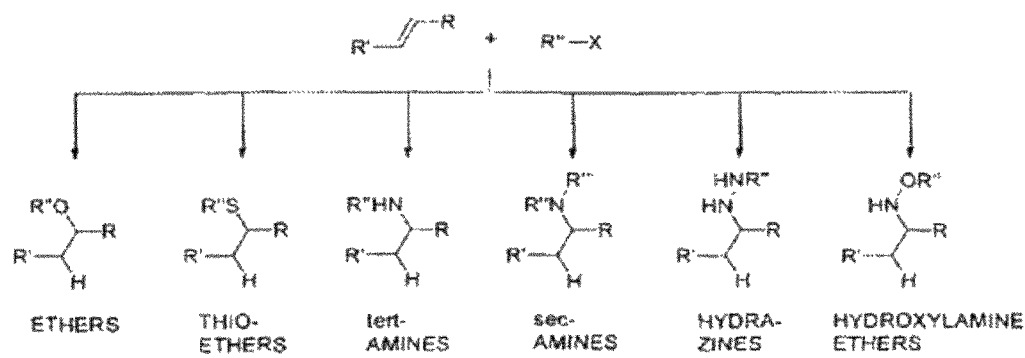

ETHERS  THIO-ETHERS  tert-AMINES  sec-AMINES  HYDRA-ZINES  HYDROXYLAMINE ETHERS

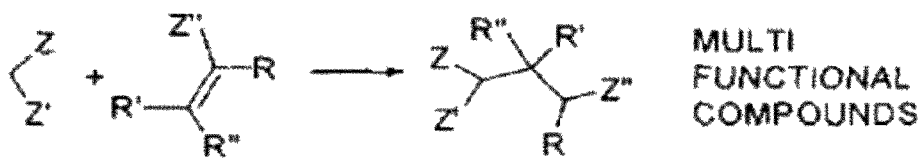

MULTI FUNCTIONAL COMPOUNDS $Z$ = H, Alkyl, $Z'$, Ar $Z''$ = COOR, CHO, COR, CONR''$_2$, CN, NO$_2$, SOR, SO$_2$R, SO$_2$NR''$_2$,. ect.

$Z' = Z''$ $\quad R = R', = R'', = Z$

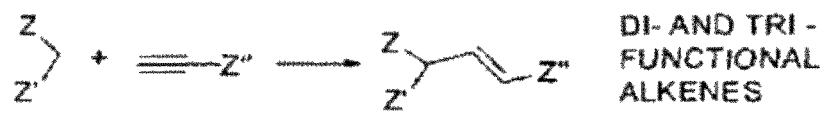

DI- AND TRI- FUNCTIONAL ALKENES $Z$ = H, Alkyl, Ar, $Z'' = Z'$, Alkyl, Ar, $Z'$ = COOR, CHO, COR, CONR''$_2$, CN, NO$_2$, SOR, SO$_2$R, SO$_2$NR''$_2$. ect.

Figure 5 cont.
C
Addition to carbon-hetero multiple bonds
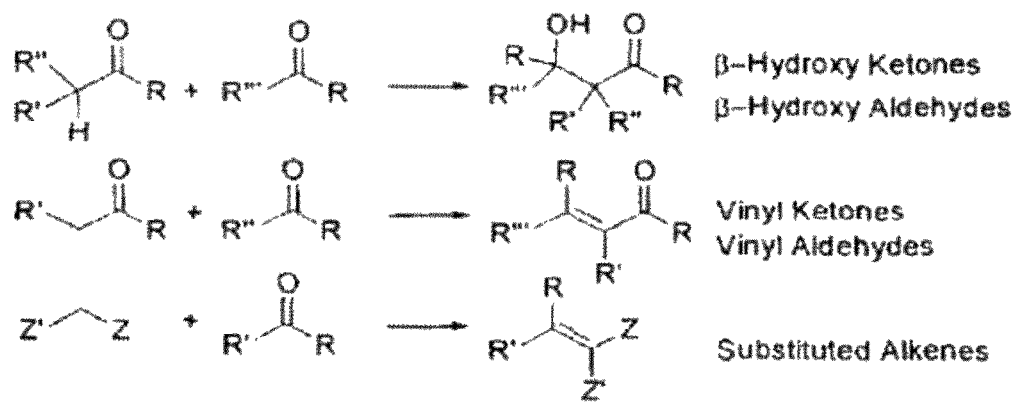
β-Hydroxy Ketones
β-Hydroxy Aldehydes
Vinyl Ketones
Vinyl Aldehydes
Substituted Alkenes
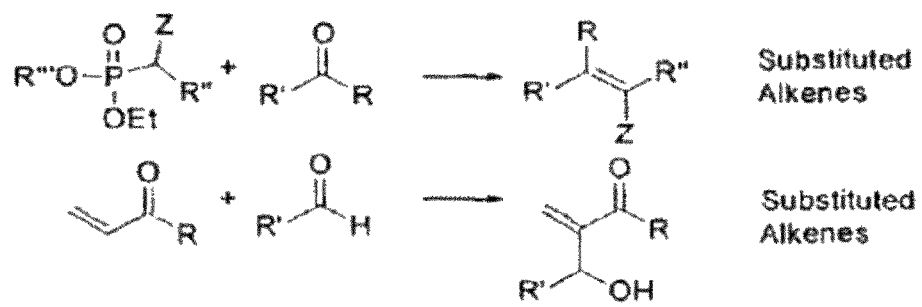
Substituted Alkenes
Substituted Alkenes
Z, Z' = COOR, CHO, COR, CONR''$_2$, CN, NO$_2$, SOR, SO$_2$R, SO$_2$NR''$_2$, ect.    R'' = H, Alkyl, Aryl Z = COOR, CHO, COR, SOR, SO$_2$R, CN, NO$_2$, ect.

R = R', H, Alkyl, Ar,

R" = R'", H, Alkyl, COR,

Figure 6: Cleavable linkers, conditions for cleaving them and the resulting products of the cleavage.
A. Linker for the formation of Ketones, Aldehydes, Amid and Acids
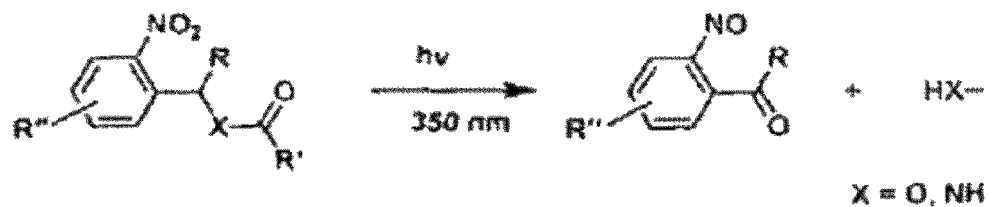
B. Linker for the formation of Ketones, Amides and Acid
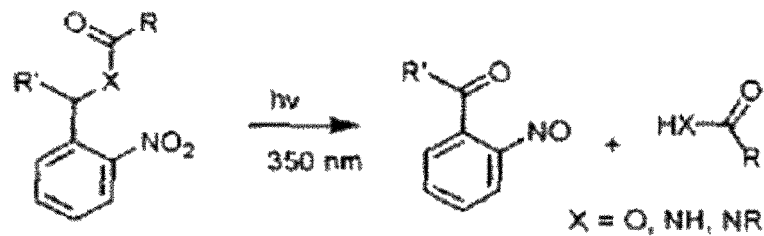
C. Linker for the formation of Aldehydes and Ketones
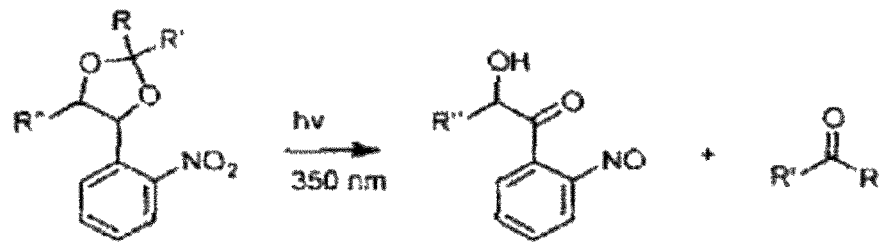

Figure 6 cont.
D. Linker for the formation of Alcohols and Acids
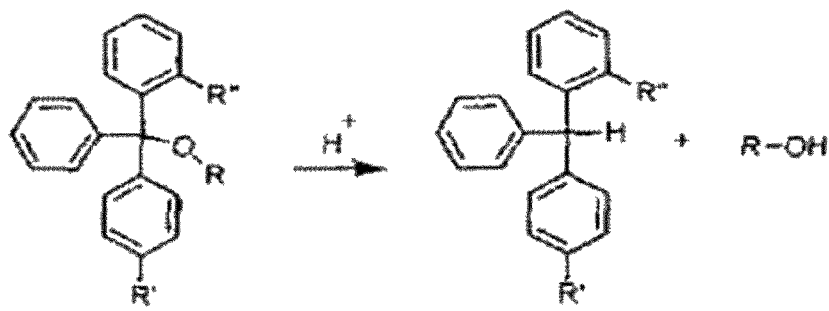
E. Linker for the formation of Amines and Alcohols
F. Linker for the formation of Esters, Thioesters, Amides and Alcohols
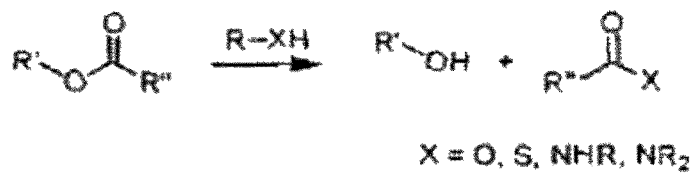
X = O, S, NHR, NR$_2$
G. Linker for the formation of Sulfonamides and Alcohols
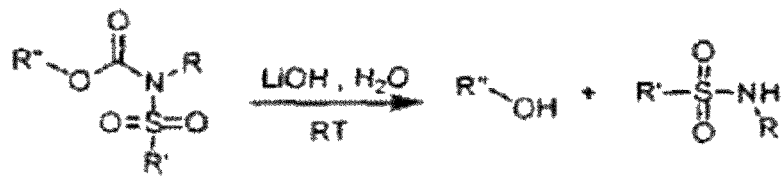

Figure 6 cont.
H. Linker for the formation of Ketones, Amines and Alcohols
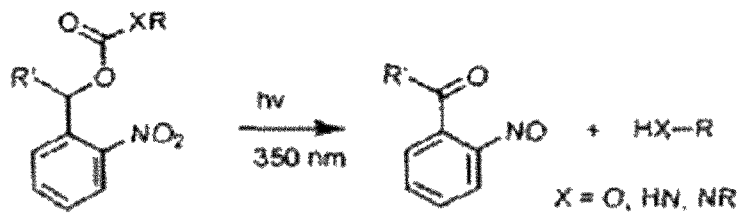
I. Linker for the formation of Ketones, Amines, Alcohols and Mercaptanes
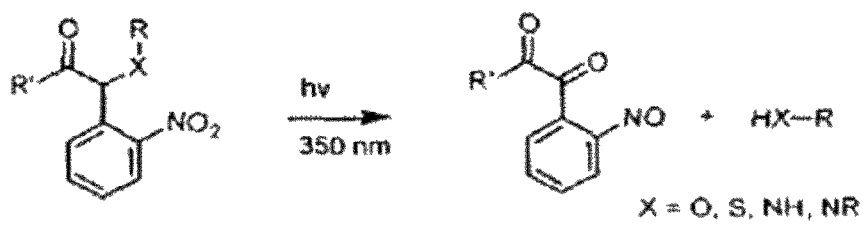
J. Linker for the formation of Biaryl and Bihetaryl
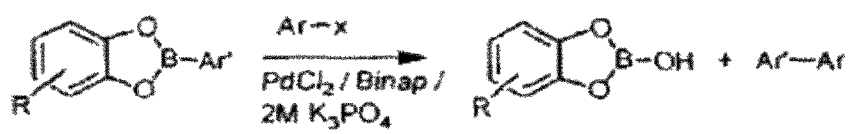
K. Linker for the formation of Benzyles, Amines, Anilins Alcohols and Phenoles
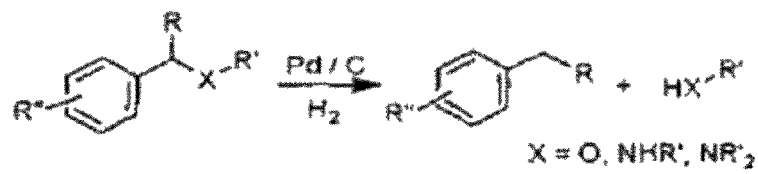

Figure 6 cont.
L. Linker for the formation of Mercaptanes
TCEP = tris(2-carboxyethyl)phosphine
M. Linker for the formation of Glycosides
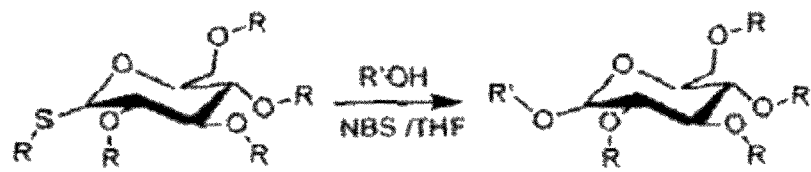
N. Linker for the formation of Aldehydes and Glyoxylamides
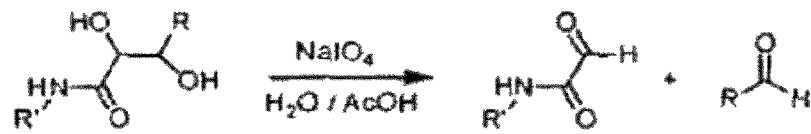
O. Linker for the formation of Aldehydes, Ketones and Aminoalcohols
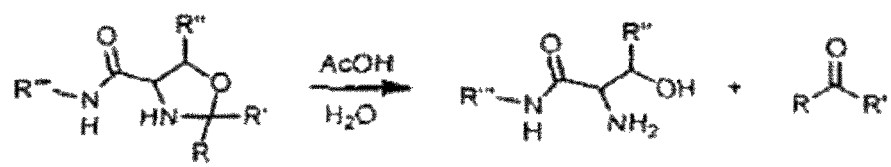

Figure 7: Prediction of MHC class 1 mouse virus LCMV gp 1 protein nonamer peptide binders for H-2Kd using the Syfpeithi database

```
Pos 1 2 3 4 5 6 7 8 9 score
179 S F S D A Q S A L 22
289 G Y C L T K W M I 22
65  M Y G L D G P D I 21
139 T F D H T L M S I 21
30  I V L I I I T S I 20
41  V Y N F A T C G I 20
105 H Y I S M G K S G 19
43  N F A T C G I L A 18
108 S M G K S G L E L 18
143 T L M S I V S S L 18
175 Q Y N L S F S D A 18
226 C S Q T S Y Q Y L 18
13  M F E A L P H I I 17
33  I I I T S I K A V 17
73  I Y K G V Y Q F K 17
84  E F D M S H L N L 17
230 S Y Q Y L I I Q N 17
48  G I L A L V S F L 16
50  L A L V S F L F L 16
75  K G V Y Q F K S V 16
99  S V N N S H H Y I 16
147 I V S S L H L S I 16
208 K Y M R S G W G W 16
227 S Q T S Y Q Y L I 16
9   Q I V T M F E A L 15
25  I N I V I I V L I 15
92  L T M P N A C S V 15
160 N Y K P V S C D F 15
246 T Y A G P F R I S 15
284 V E S P G G Y C L 15
290 Y C L T K W M I L 15
294 K W M I L A A E L 15
54  S F L F L A G K S 14
258 F A Q E K T K F L 14
12  T M F E A L P H I 13
19  H I I D E V I N I 13
```

Figure 8. Size exclusion chromatography of folded HLA-A*0201-β2m-QLFEELQEL-complex.
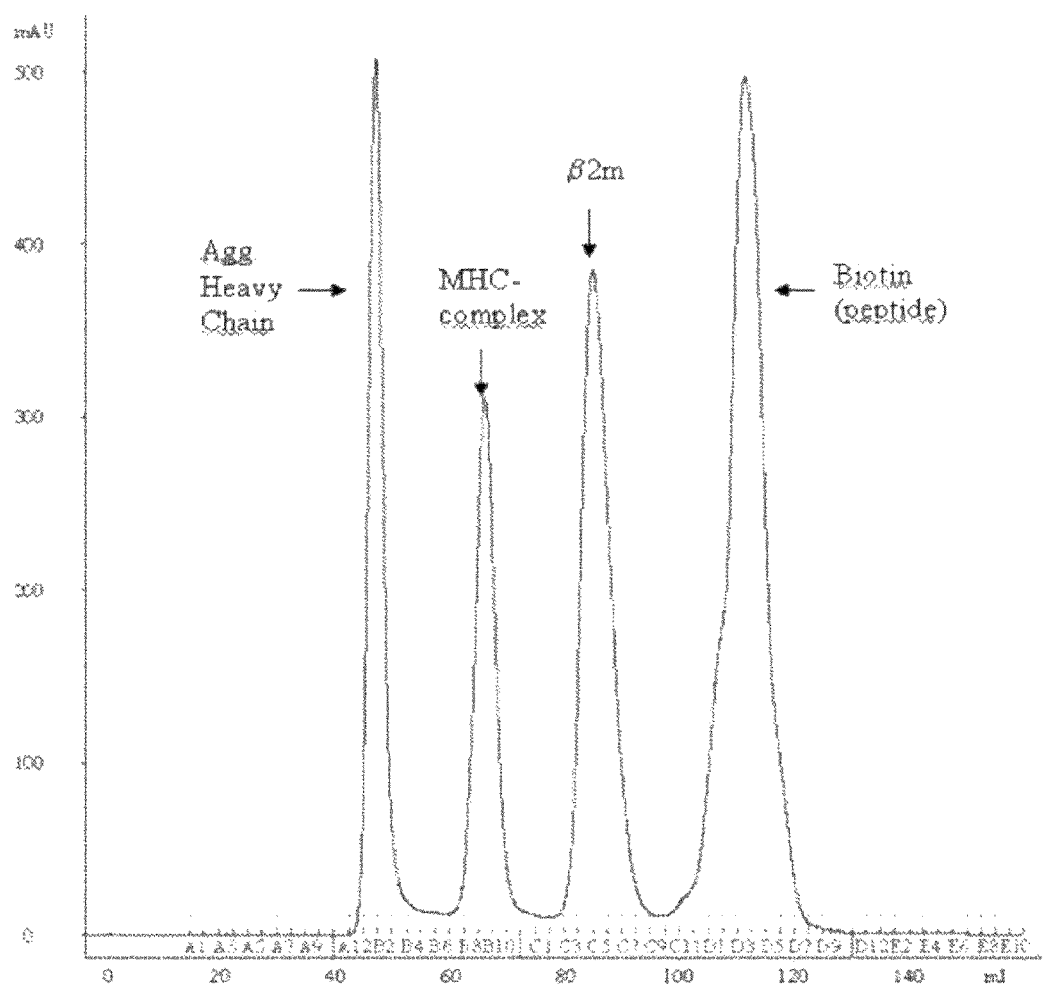

Figure 9: MHC-SHIFT Assay
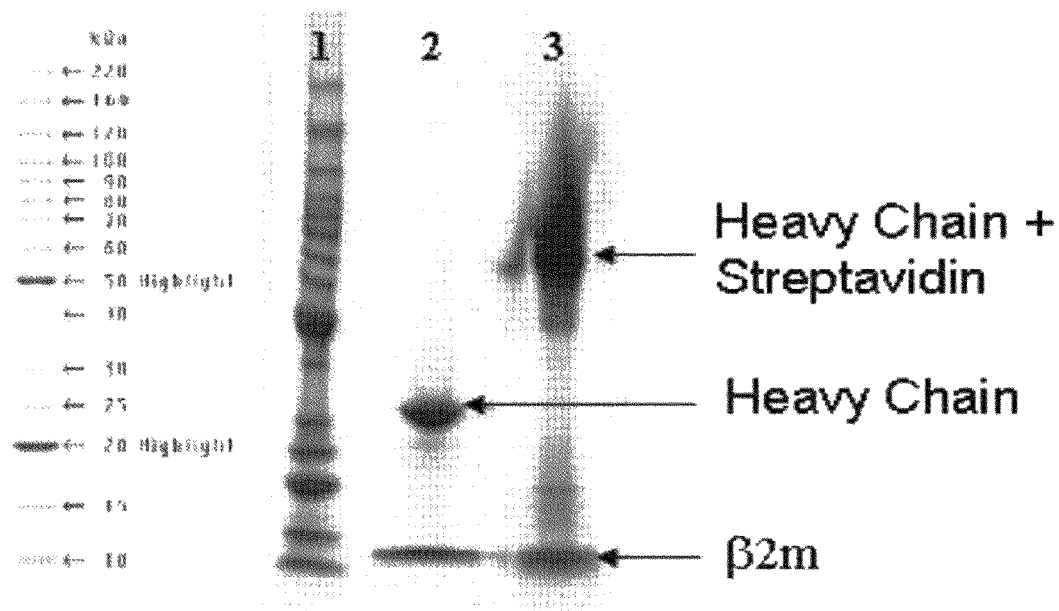

Figure 10: Composition of a Fluorescein-linker molecule
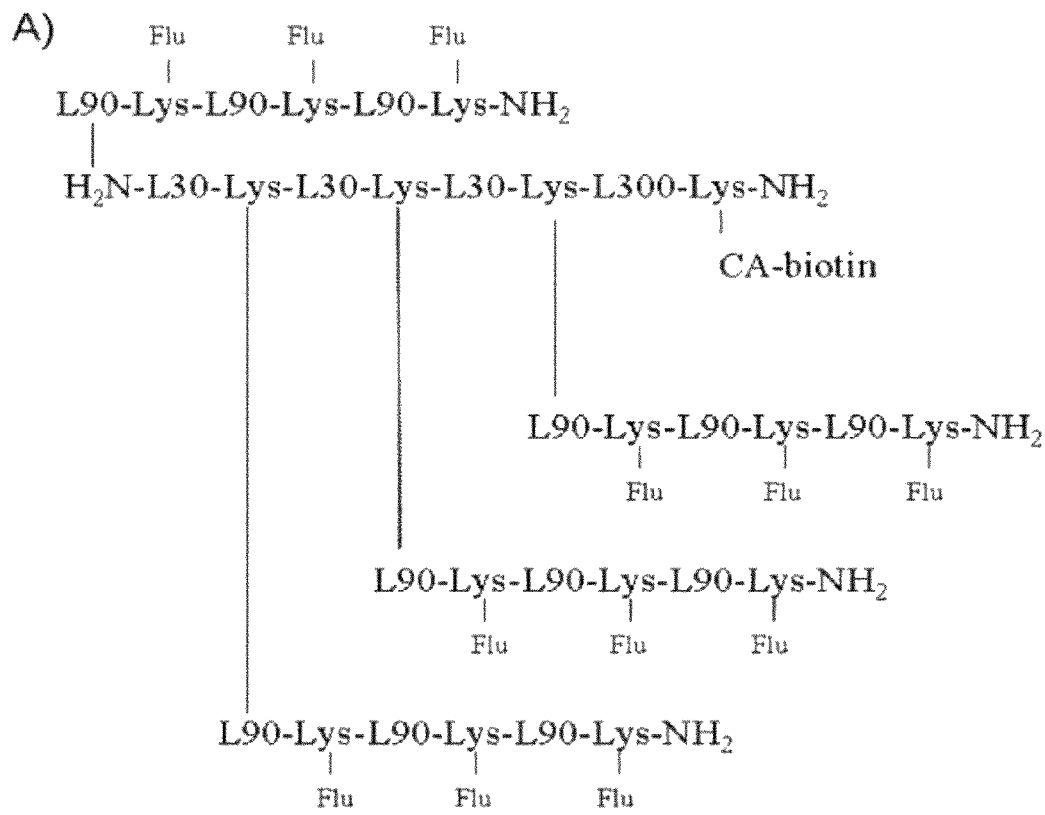
B)   L15 linker composition:
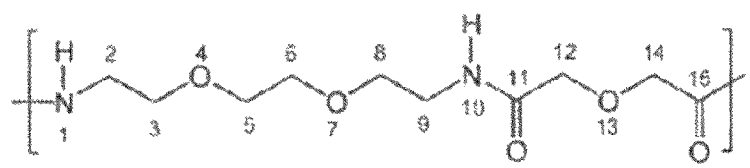

Figure 11: HLA alleles of the NetMHC databases

| Database | Alleles |
|---|---|
| http://www.cbs.dtu.dk/services/NetMHC/ | HLA-A0101, HLA-A0201, HLA-A0202, HLA-A0203, HLA-A0204, HLA-A0206, HLA-A0211, HLA-A0212, HLA-A0216, HLA-A0219, HLA-A0301, HLA-A1101, HLA-A2301, HLA-A2402, HLA-A2403, HLA-A2601, HLA-A2602, HLA-A2902, HLA-A3002, HLA-A3101, HLA-A3301, HLA-A6801, HLA-A6802, HLA-A6901 |
| http://www.cbs.dtu.dk/services/NetMHCII/ | HLA-DRB1*0101, HLA-DRB1*0301, HLA-DRB1*0401, HLA-DRB1*0404, HLA-DRB1*0405, HLA-DRB1*0701, HLA-DRB1*0802, HLA-DRB1*0901, HLA-DRB1*1101, HLA-DRB1*1302, HLA-DRB1*1501, HLA-DRB3*0101, HLA-DRB4*0101, HLA-DRB1*0501 |

Figure 12: Prediction of MHC class 1 mouse virus LCMV gp 1 protein nonamer peptide binders for H-2Kd using the Syfpeithi database

| Pos | 1 | 2 | 3 | 4 | 5 | 6 | 7 | 8 | 9 | score |
|---|---|---|---|---|---|---|---|---|---|---|
| 179 | S | F | S | D | A | Q | S | A | L | 22 |
| 289 | G | Y | C | L | T | K | W | M | I | 22 |
| 65 | M | Y | G | L | D | G | P | D | I | 21 |
| 139 | T | F | D | H | T | L | M | S | I | 21 |
| 30 | I | V | L | I | I | I | T | S | I | 20 |
| 41 | V | Y | N | F | A | T | C | G | I | 20 |
| 105 | H | Y | I | S | M | G | K | S | G | 19 |
| 43 | N | F | A | T | C | G | I | L | A | 18 |
| 108 | S | M | G | K | S | G | L | E | L | 18 |
| 143 | T | L | M | S | I | V | S | S | L | 18 |
| 175 | Q | Y | N | L | S | F | S | D | A | 18 |
| 226 | C | S | Q | T | S | Y | Q | Y | L | 18 |
| 13 | M | F | E | A | L | P | H | I | I | 17 |
| 33 | I | I | I | T | S | I | K | A | V | 17 |
| 73 | I | Y | K | G | V | Y | Q | F | K | 17 |
| 84 | E | F | D | M | S | H | L | N | L | 17 |
| 230 | S | Y | Q | Y | L | I | I | Q | N | 17 |
| 48 | G | I | L | A | L | V | S | F | L | 16 |
| 50 | L | A | L | V | S | F | L | F | L | 16 |
| 75 | K | G | V | Y | Q | F | K | S | V | 16 |
| 99 | S | V | N | N | S | H | H | Y | I | 16 |
| 147 | I | V | S | S | L | H | L | S | I | 16 |
| 208 | K | Y | M | R | S | G | W | G | W | 16 |
| 227 | S | Q | T | S | Y | Q | Y | L | I | 16 |
| 9 | Q | I | V | T | M | F | E | A | L | 15 |
| 25 | I | N | I | V | I | I | V | L | I | 15 |
| 92 | L | T | M | P | N | A | C | S | V | 15 |
| 160 | N | Y | K | P | V | S | C | D | F | 15 |
| 246 | T | Y | A | G | P | F | R | I | S | 15 |
| 284 | V | E | S | P | G | G | Y | C | L | 15 |
| 290 | Y | C | L | T | K | W | M | I | L | 15 |
| 294 | K | W | M | I | L | A | A | E | L | 15 |
| 54 | S | F | L | F | L | A | G | K | S | 14 |
| 258 | F | A | Q | E | K | T | K | F | L | 14 |
| 12 | T | M | F | E | A | L | P | H | I | 13 |

| | | |
|---|---|---|
| 19 | HIIDEVINI | 13 |
| 27 | IVIIVL III | 13 |
| 82 | SVEFDMSHL | 13 |
| 116 | LTFINDSIL | 13 |
| 145 | MSIVSSLHL | 13 |
| 156 | RGNSNYKPV | 13 |
| 170 | NGITIQYNL | 13 |
| 178 | LSFSDAQSA | 13 |
| 240 | TWENHCTYA | 13 |
| 257 | LFAQEK TKF | 13 |
| 262 | KTKFLTRRL | 13 |
| 264 | KFL TRRLAG | 13 |
| 276 | WTLSDSSGV | 13 |
| 20 | II DEVINIV | 12 |
| 21 | I DEVINIVI | 12 |
| 22 | DEVINIVII | 12 |
| 24 | VINIVIIVL | 12 |
| 26 | NIVIIVL II | 12 |
| 37 | SIKAVYNF A | 12 |
| 56 | LFLAGKSCG | 12 |
| 106 | YISMGKSGL | 12 |
| 115 | ELIFINDS I | 12 |
| 126 | HNHCNLTSA | 12 |
| 136 | NKKTFDHTL | 12 |
| 140 | FDHTLMS IV | 12 |
| 166 | CDFNNGITI | 12 |
| 232 | QYLIIQNRT | 12 |

| HLA-A | HLA-B | HLA-C | HLA-E | HLA-F | HLA-G |
|---|---|---|---|---|---|
| A*01010101 | B*070201 | Cw*010201 | E*01010101 | F*01010101 | G*01010101 |
| A*01010102N | B*070202 | Cw*010202 | E*01010102 | F*01010102 | G*01010102 |
| A*010102 | B*070203 | Cw*010203 | E*01010103 | F*01010103 | G*01010103 |
| A*010103 | B*070204 | Cw*010204 | E*01030101 | F*01010104 | G*01010104 |
| A*010104 | B*0703 | Cw*0103 | E*01030102 | F*01010105 | G*01010105 |
| A*0102 | B*0704 | Cw*0104 | E*010302 | F*01010106 | G*01010201 |
| A*0103 | B*070501 | Cw*0105 | E*010303 | F*01010107 | G*01010202 |
| A*0104N | B*070502 | Cw*0106 | E*010304 | F*01010108 | G*010103 |
| A*0106 | B*070503 | Cw*0107 | E*0104 | F*01010201 | G*010104 |
| A*0107 | B*0706 | Cw*0108 | | F*01010202 | G*010105 |
| A*0108 | B*0707 | Cw*0109 | | F*01010203 | G*010106 |
| A*0109 | B*0708 | Cw*0110 | | F*01010204 | G*010107 |
| A*0110 | B*0709 | Cw*0111 | | F*01010205 | G*010108 |
| A*0111N | B*0710 | Cw*0112 | | F*01010301 | G*010109 |
| A*0112 | B*0711 | Cw*0113 | | F*01010302 | G*010110 |
| A*0113 | B*0712 | Cw*020201 | | F*01010303 | G*0102 |
| A*0114 | B*0713 | Cw*020202 | | F*01010304 | G*0103 |
| A*0115N | B*0714 | Cw*020203 | | F*0102 | G*010401 |
| A*0116N | B*0715 | Cw*020205 | | F*01030101 | G*010402 |
| A*0117 | B*0716 | Cw*0203 | | F*01030102 | G*010403 |
| A*0118N | B*0717 | Cw*0204 | | F*0104 | G*0105N |
| A*0119 | B*0718 | Cw*0205 | | | G*0106 |
| A*0120 | B*0719 | Cw*0206 | | | G*0107 |
| A*02010101 | B*0720 | Cw*0207 | | | |
| A*02010102L | B*0721 | Cw*0208 | | | |
| A*020102 | B*0722 | Cw*0209 | | | |
| A*020103 | B*0723 | Cw*0210 | | | |
| A*020104 | B*0724 | Cw*0211 | | | |
| A*020105 | B*0725 | Cw*0212 | | | |
| A*020106 | B*0726 | Cw*0213 | | | |
| A*020107 | B*0727 | Cw*0214 | | | |
| A*020108 | B*0728 | Cw*0215 | | | |
| A*020109 | B*0729 | Cw*0216 | | | |
| A*020110 | B*0730 | Cw*0217 | | | |
| A*020111 | B*0731 | Cw*030201 | | | |
| A*020112 | B*0732 | Cw*030202 | | | |
| A*0202 | B*0733 | Cw*030301 | | | |
| A*020301 | B*0734 | Cw*030302 | | | |
| A*020302 | B*0735 | Cw*030303 | | | |
| A*0204 | B*0736 | Cw*030304 | | | |
| A*0205 | B*0737 | Cw*030305 | | | |
| A*020601 | B*0738 | Cw*030401 | | | |
| A*020602 | B*0739 | Cw*030402 | | | |
| A*020603 | B*0740 | Cw*030403 | | | |
| A*0207 | B*0741 | Cw*030404 | | | |
| A*0208 | B*0742 | Cw*030405 | | | |
| A*0209 | B*0743 | Cw*0305 | | | |
| A*0210 | B*0744 | Cw*0306 | | | |
| A*0211 | B*0745 | Cw*0307 | | | |
| A*0212 | B*0746 | Cw*0308 | | | |
| A*0213 | B*0747 | Cw*0309 | | | |
| A*0214 | B*0748 | Cw*0310 | | | |
| A*0215N | B*0749N | Cw*031101 | | | |
| A*0216 | B*0750 | Cw*031102 | | | |
| A*021701 | B*0751 | Cw*0312 | | | |

Figure 13 cont.

| | | |
|---|---|---|
| A*0217O2 | B*080101 | Cw*0313 |
| A*0218 | B*080102 | Cw*0314 |
| A*0219 | B*080103 | Cw*0315 |
| A*022001 | B*0802 | Cw*0316 |
| A*022002 | B*0803 | Cw*0317 |
| A*0221 | B*0804 | Cw*0318 |
| A*0222 | B*0805 | Cw*0319 |
| A*0224 | B*0806 | Cw*0320N |
| A*0225 | B*0807 | Cw*0321 |
| A*0226 | B*0808N | Cw*0322Q |
| A*0227 | B*0809 | Cw*0323 |
| A*0228 | B*0810 | Cw*0324 |
| A*0229 | B*0811 | Cw*0325 |
| A*0230 | B*0812 | Cw*0326 |
| A*0231 | B*0813 | Cw*0327 |
| A*0232N | B*0814 | Cw*0328 |
| A*0233 | B*0815 | Cw*0329 |
| A*0234 | B*0816 | Cw*0330 |
| A*023501 | B*0817 | Cw*0331 |
| A*023502 | B*0818 | Cw*0332 |
| A*0236 | B*0819N | Cw*0333 |
| A*0237 | B*0820 | Cw*0334 |
| A*0238 | B*0821 | Cw*0335 |
| A*0239 | B*0822 | Cw*04010101 |
| A*0240 | B*0823 | Cw*04010102 |
| A*0241 | B*0824 | Cw*040102 |
| A*0242 | B*0825 | Cw*040103 |
| A*0243N | B*0826 | Cw*040104 |
| A*0244 | B*0827 | Cw*0403 |
| A*0245 | B*0828 | Cw*040401 |
| A*0246 | B*0829 | Cw*040402 |
| A*0247 | B*0830N | Cw*0405 |
| A*0248 | B*0831 | Cw*0406 |
| A*0249 | B*1301 | Cw*0407 |
| A*0250 | B*130201 | Cw*0408 |
| A*0251 | B*130202 | Cw*0409N |
| A*0252 | B*130203 | Cw*0410 |
| A*0253N | B*1303 | Cw*0411 |
| A*0254 | B*1304 | Cw*0412 |
| A*0255 | B*1306 | Cw*0413 |
| A*0256 | B*1307N | Cw*0414 |
| A*0257 | B*1308 | Cw*0415 |
| A*0258 | B*1309 | Cw*0416 |
| A*0259 | B*1310 | Cw*0417 |
| A*0260 | B*1311 | Cw*0418 |
| A*0261 | B*1312 | Cw*0419 |
| A*0262 | B*1313 | Cw*0420 |
| A*0263 | B*1314 | Cw*0421 |
| A*0264 | B*1315 | Cw*0423 |
| A*0265 | B*1316 | Cw*0424 |
| A*0266 | B*1317 | Cw*050101 |
| A*0267 | B*1401 | Cw*050102 |
| A*0268 | B*140201 | Cw*050103 |
| A*0269 | B*140202 | Cw*0502 |
| A*0270 | B*1403 | Cw*0503 |
| A*0271 | B*1404 | Cw*0504 |

Figure 13 cont.

| | | |
|---|---|---|
| A*0272 | B*1405 | Cw*0505 |
| A*0273 | B*140601 | Cw*0506 |
| A*027401 | B*140602 | Cw*0507N |
| A*027402 | B*1407N | Cw*0508 |
| A*0275 | B*15010101 | Cw*0509 |
| A*0276 | B*15010102N | Cw*0510 |
| A*0277 | B*150102 | Cw*0511 |
| A*0278 | B*150103 | Cw*0512 |
| A*0279 | B*150104 | Cw*0513 |
| A*0280 | B*1502 | Cw*0514 |
| A*0281 | B*1503 | Cw*0515 |
| A*0282N | B*1504 | Cw*06020101 |
| A*0283N | B*1505 | Cw*06020102 |
| A*0284 | B*1506 | Cw*060202 |
| A*0285 | B*1507 | Cw*0603 |
| A*0286 | B*1508 | Cw*0604 |
| A*0287 | B*1509 | Cw*0605 |
| A*0288N | B*1510 | Cw*0606 |
| A*0289 | B*151101 | Cw*0607 |
| A*0290 | B*151102 | Cw*0608 |
| A*0291 | B*151103 | Cw*0609 |
| A*0292 | B*1512 | Cw*0610 |
| A*0293 | B*1513 | Cw*0611 |
| A*0294N | B*1514 | Cw*0612 |
| A*0295 | B*1515 | Cw*0613 |
| A*0296 | B*1516 | Cw*0614 |
| A*0297 | B*15170101 | Cw*070101 |
| A*0299 | B*15170102 | Cw*070102 |
| A*03010101 | B*151702 | Cw*070103 |
| A*03010102N | B*1518 | Cw*070104 |
| A*03010103 | B*1519 | Cw*070105 |
| A*030102 | B*1520 | Cw*070106 |
| A*030103 | B*1521 | Cw*070107 |
| A*030104 | B*1523 | Cw*07020101 |
| A*030105 | B*1524 | Cw*07020102 |
| A*0302 | B*1525 | Cw*07020103 |
| A*0303N | B*1526N | Cw*0703 |
| A*0304 | B*1527 | Cw*070401 |
| A*0305 | B*1528 | Cw*070402 |
| A*0306 | B*1529 | Cw*0705 |
| A*0307 | B*1530 | Cw*0706 |
| A*0308 | B*1531 | Cw*0707 |
| A*0309 | B*1532 | Cw*0708 |
| A*0310 | B*1533 | Cw*0709 |
| A*0311N | B*1534 | Cw*0710 |
| A*0312 | B*1535 | Cw*0711 |
| A*0313 | B*1536 | Cw*0712 |
| A*0314 | B*1537 | Cw*0713 |
| A*0315 | B*1538 | Cw*0714 |
| A*0316 | B*1539 | Cw*0715 |
| A*0317 | B*1540 | Cw*0716 |
| A*0318 | B*1542 | Cw*0717 |
| A*0319 | B*1543 | Cw*0718 |
| A*0320 | B*1544 | Cw*0719 |
| A*0321N | B*1545 | Cw*0720 |
| A*0322 | B*1546 | Cw*0721 |

Figure 13 cont.

| | | |
|---|---|---|
| A*0323 | B*1547 | Cw*0722 |
| A*0324 | B*1548 | Cw*0723 |
| A*0325 | B*1549 | Cw*0724 |
| A*0326 | B*1550 | Cw*0725 |
| A*110101 | B*1551 | Cw*0726 |
| A*110102 | B*1552 | Cw*0727 |
| A*110103 | B*1553 | Cw*0728 |
| A*110104 | B*1554 | Cw*0729 |
| A*110105 | B*1555 | Cw*0730 |
| A*110106 | B*1556 | Cw*0731 |
| A*110201 | B*1557 | Cw*0732N |
| A*110202 | B*1558 | Cw*0733N |
| A*1103 | B*1560 | Cw*0734 |
| A*1104 | B*1561 | Cw*0735 |
| A*1105 | B*1562 | Cw*0736 |
| A*1106 | B*1563 | Cw*0737 |
| A*1107 | B*1564 | Cw*0738 |
| A*1108 | B*1565 | Cw*0739 |
| A*1109 | B*1566 | Cw*0740 |
| A*1110 | B*1567 | Cw*0741 |
| A*1111 | B*1568 | Cw*0742 |
| A*1112 | B*1569 | Cw*0743 |
| A*1113 | B*1570 | Cw*0744 |
| A*1114 | B*1571 | Cw*0745 |
| A*1115 | B*1572 | Cw*080101 |
| A*1116 | B*1573 | Cw*080102 |
| A*1117 | B*1574 | Cw*0802 |
| A*1118 | B*1575 | Cw*0803 |
| A*1119 | B*1576 | Cw*0804 |
| A*1120 | B*1577 | Cw*0805 |
| A*1121N | B*1578 | Cw*0806 |
| A*1122 | B*1579N | Cw*0807 |
| A*1123 | B*1580 | Cw*0808 |
| A*1124 | B*1581 | Cw*0809 |
| A*1125 | B*1582 | Cw*0810 |
| A*1126 | B*1583 | Cw*0811 |
| A*1127 | B*1584 | Cw*0812 |
| A*1128 | B*1585 | Cw*0813 |
| A*1129 | B*1586 | Cw*0814 |
| A*2301 | B*1587 | Cw*120201 |
| A*2302 | B*1588 | Cw*120202 |
| A*2303 | B*1589 | Cw*120203 |
| A*2304 | B*1590 | Cw*12030101 |
| A*2305 | B*1591 | Cw*12030102 |
| A*2306 | B*1592 | Cw*120302 |
| A*2307N | B*1593 | Cw*120303 |
| A*2308N | B*1594N | Cw*120304 |
| A*2309 | B*1595 | Cw*120401 |
| A*2310 | B*1596 | Cw*120402 |
| A*2311N | B*1597 | Cw*1205 |
| A*2312 | B*1598 | Cw*1206 |
| A*2313 | B*1599 | Cw*1207 |
| A*2314 | B*9501 | Cw*1208 |
| A*24020101 | B*9502 | Cw*1209 |
| A*24020102L | B*9503 | Cw*1210 |
| A*240202 | B*9504 | Cw*1211 |

Figure 13 cont.

| | | |
|---|---|---|
| A*240203 | B*9505 | Cw*1212 |
| A*240204 | B*9506 | Cw*1213 |
| A*240205 | B*9507 | Cw*1214 |
| A*240206 | B*9508 | Cw*1215 |
| A*240207 | B*9509 | Cw*1216 |
| A*240208 | B*9510 | Cw*1217 |
| A*240209 | B*9511N | Cw*1218 |
| A*240210 | B*9512 | Cw*1219 |
| A*240211 | B*9513 | Cw*140201 |
| A*240212 | B*9514 | Cw*140202 |
| A*240213 | B*9515 | Cw*140203 |
| A*240301 | B*9516 | Cw*140204 |
| A*240302 | B*9517 | Cw*1403 |
| A*2404 | B*9518 | Cw*1404 |
| A*2405 | B*9519 | Cw*1405 |
| A*2406 | B*9520 | Cw*1406 |
| A*2407 | B*9521 | Cw*1407N |
| A*2408 | B*9522 | Cw*1408 |
| A*2409N | B*180101 | Cw*150201 |
| A*2410 | B*180102 | Cw*150202 |
| A*2411N | B*180103 | Cw*150203 |
| A*2413 | B*1802 | Cw*1503 |
| A*2414 | B*1803 | Cw*1504 |
| A*2415 | B*1804 | Cw*150501 |
| A*2417 | B*1805 | Cw*150502 |
| A*2418 | B*1806 | Cw*150503 |
| A*2419 | B*1807 | Cw*150504 |
| A*2420 | B*1808 | Cw*1506 |
| A*2421 | B*1809 | Cw*1507 |
| A*2422 | B*1810 | Cw*1508 |
| A*2423 | B*1811 | Cw*1509 |
| A*2424 | B*1812 | Cw*1510 |
| A*2425 | B*1813 | Cw*1511 |
| A*2426 | B*1814 | Cw*1512 |
| A*2427 | B*1815 | Cw*1513 |
| A*2428 | B*1817N | Cw*1514 |
| A*2429 | B*1818 | Cw*1515 |
| A*2430 | B*1819 | Cw*1516 |
| A*2431 | B*1820 | Cw*1517 |
| A*2432 | B*1821 | Cw*160101 |
| A*2433 | B*1822 | Cw*160102 |
| A*2434 | B*1823N | Cw*1602 |
| A*2435 | B*1824 | Cw*160401 |
| A*2436N | B*2701 | Cw*1606 |
| A*2437 | B*2702 | Cw*1607 |
| A*2438 | B*2703 | Cw*1608 |
| A*2439 | B*270401 | Cw*1609 |
| A*2440N | B*270402 | Cw*1701 |
| A*2441 | B*270502 | Cw*1702 |
| A*2442 | B*270503 | Cw*1703 |
| A*2443 | B*270504 | Cw*1704 |
| A*2444 | B*270505 | Cw*1801 |
| A*2445N | B*270506 | Cw*1802 |
| A*2446 | B*270507 | |
| A*2447 | B*270508 | |
| A*2448N | B*270509 | |

Figure 13 cont.

| | |
|---|---|
| A*2449 | B*2706 |
| A*2450 | B*2707 |
| A*2451 | B*2708 |
| A*2452 | B*2709 |
| A*2453 | B*2710 |
| A*2454 | B*2711 |
| A*2455 | B*2712 |
| A*2456 | B*2713 |
| A*2457 | B*2714 |
| A*2458 | B*2715 |
| A*2459 | B*2716 |
| A*2460N | B*2717 |
| A*2461 | B*2718 |
| A*2462 | B*2719 |
| A*2463 | B*2720 |
| A*2464 | B*2721 |
| A*2465 | B*2723 |
| A*2466 | B*2724 |
| A*2467 | B*2725 |
| A*2468 | B*2726 |
| A*250101 | B*2727 |
| A*250102 | B*2728 |
| A*2502 | B*2729 |
| A*2503 | B*2730 |
| A*2504 | B*2731 |
| A*2505 | B*2732 |
| A*2506 | B*2733 |
| A*260101 | B*2734 |
| A*260102 | B*2735 |
| A*260103 | B*2736 |
| A*260104 | B*350101 |
| A*2602 | B*350102 |
| A*2603 | B*350103 |
| A*2604 | B*350104 |
| A*2605 | B*350105 |
| A*2606 | B*350106 |
| A*260701 | B*350201 |
| A*260702 | B*350202 |
| A*2608 | B*3503 |
| A*2609 | B*350401 |
| A*2610 | B*350402 |
| A*2611N | B*3505 |
| A*2612 | B*3506 |
| A*2613 | B*3507 |
| A*2614 | B*350801 |
| A*2615 | B*350802 |
| A*2616 | B*350901 |
| A*2617 | B*350902 |
| A*2618 | B*3510 |
| A*2619 | B*3511 |
| A*2620 | B*3512 |
| A*2621 | B*3513 |
| A*2622 | B*351401 |
| A*2623 | B*351402 |
| A*2624 | B*3515 |
| A*2625N | B*3516 |

Figure 13 cont.

| | |
|---|---|
| A*2626 | B*3517 |
| A*2627 | B*3518 |
| A*2628 | B*3519 |
| A*2629 | B*3520 |
| A*2630 | B*3521 |
| A*2631 | B*3522 |
| A*2632 | B*3523 |
| A*2633 | B*3524 |
| A*2634 | B*3525 |
| A*29010101 | B*3526 |
| A*29010102N | B*3527 |
| A*290201 | B*3528 |
| A*290202 | B*3529 |
| A*290203 | B*3530 |
| A*2903 | B*3531 |
| A*2904 | B*3532 |
| A*2905 | B*3533 |
| A*2906 | B*3534 |
| A*2907 | B*3535 |
| A*2908N | B*3536 |
| A*2909 | B*3537 |
| A*2910 | B*3538 |
| A*2911 | B*3539 |
| A*2912 | B*3540N |
| A*2913 | B*3541 |
| A*2914 | B*3542 |
| A*2915 | B*3543 |
| A*2916 | B*3544 |
| A*300101 | B*3545 |
| A*300102 | B*3546 |
| A*300201 | B*3547 |
| A*300202 | B*3548 |
| A*300203 | B*3549 |
| A*3003 | B*3550 |
| A*3004 | B*3551 |
| A*3006 | B*3552 |
| A*3007 | B*3553N |
| A*3008 | B*3554 |
| A*3009 | B*3555 |
| A*3010 | B*3556 |
| A*3011 | B*3557 |
| A*3012 | B*3558 |
| A*3013 | B*3559 |
| A*3014L | B*3560 |
| A*3015 | B*3561 |
| A*3016 | B*3562 |
| A*3017 | B*3563 |
| A*3018 | B*3564 |
| A*3019 | B*3565Q |
| A*310102 | B*3566 |
| A*3102 | B*3567 |
| A*3103 | B*3568 |
| A*3104 | B*3569 |
| A*3105 | B*3570 |
| A*3106 | B*3571 |
| A*3107 | B*3572 |

Figure 13 cont.

| | |
|---|---|
| A*3108 | B*370101 |
| A*3109 | B*370102 |
| A*3110 | B*370103 |
| A*3111 | B*370104 |
| A*3112 | B*3702 |
| A*3113 | B*3703N |
| A*3114N | B*3704 |
| A*3115 | B*3705 |
| A*3201 | B*3706 |
| A*3202 | B*3707 |
| A*3203 | B*3708 |
| A*3204 | B*3709 |
| A*3205 | B*3710 |
| A*3206 | B*3711 |
| A*3207 | B*3712 |
| A*3208 | B*380101 |
| A*3209 | B*380102 |
| A*3210 | B*380201 |
| A*3211Q | B*380202 |
| A*3212 | B*3803 |
| A*3213 | B*3804 |
| A*3214 | B*3805 |
| A*3301 | B*3806 |
| A*330301 | B*3807 |
| A*330302 | B*3808 |
| A*3304 | B*3809 |
| A*3305 | B*3810 |
| A*3306 | B*3811 |
| A*3307 | B*3812 |
| A*3308 | B*3813 |
| A*3309 | B*3814 |
| A*3401 | B*3815 |
| A*3402 | B*39010101 |
| A*3403 | B*39010102L |
| A*3404 | B*390103 |
| A*3405 | B*390104 |
| A*3406 | B*390201 |
| A*3407 | B*390202 |
| A*3408 | B*3903 |
| A*3601 | B*3904 |
| A*3602 | B*3905 |
| A*3603 | B*390601 |
| A*3604 | B*390602 |
| A*4301 | B*3907 |
| A*6601 | B*3908 |
| A*6602 | B*3909 |
| A*6603 | B*3910 |
| A*6604 | B*3911 |
| A*6605 | B*3912 |
| A*6606 | B*391301 |
| A*680101 | B*391302 |
| A*680102 | B*3914 |
| A*680103 | B*3915 |
| A*680104 | B*3916 |
| A*680105 | B*3917 |
| A*68020101 | B*3918 |

HLA-H       HLA-J       HLA-K       HLA-L       HLA-P
H*01010101  J*01010101  K*01010101  L*01010101  P*01010101
H*01010102  J*01010102  K*01010102  L*01010102  P*01010102
H*01010103  J*01010103  K*01010103  L*01010103  P*02010101
H*0102      J*01010104  K*01010104  L*010102    P*02010102
H*02010101  J*01010105  K*0102                  L*0102
H*02010102  J*01010106  K*0103
H*0202      J*01010107
H*0203      J*01010108
H*0204      J*0201
H*0205
H*0206
H*0301
```

Figure 14: Top 30 HLA class 1 allele frequency in human ethnic groups

| % chance of allele expressed in an individual | | | | | | | |
|---|---|---|---|---|---|---|---|
| Top 30 expressed alleles | | | | | | | |
| Allele | Caucasian | Allele | African-American | Allele | Hispanic | Allele | Oriental |
| A*0201 | 45.6% | C*0401 | 29.0% | A*0201 | 37.1% | A*1101 | 38.4% |
| C*0701 | 27.7% | C*0701 | 25.4% | C*0401 | 25.4% | A*2402 | 33.7% |
| A*0101 | 27.4% | C*0602 | 23.0% | A*2402 | 24.9% | C*0702 | 33.3% |
| A*0301 | 23.8% | A*0201 | 22.3% | C*0702 | 24.2% | C*0102 | 27.7% |
| C*0702 | 21.5% | A*2301 | 20.7% | C*0701 | 20.8% | A*3303 | 23.3% |
| C*0401 | 21.2% | C*0202 | 19.0% | C*0304 | 14.4% | C*0801 | 21.6% |
| B*4402 | 20.2% | A*0301 | 18.7% | A*0301 | 14.3% | C*0304 | 19.9% |
| B*0702 | 18.1% | C*0702 | 18.1% | B*0702 | 13.2% | A*0201 | 18.1% |
| B*0801 | 18.1% | B*5301 | 18.1% | B*3501 | 12.8% | B*4001 | 15.2% |
| C*0501 | 17.2% | B*0702 | 15.8% | C*0602 | 12.3% | C*0401 | 14.0% |
| C*0304 | 16.8% | C*1601 | 15.7% | C*0501 | 11.9% | B*5801 | 13.3% |
| C*0602 | 15.7% | B*1503 | 13.9% | A*0101 | 11.4% | B*4601 | 12.7% |
| A*1101 | 15.3% | B*5801 | 13.5% | A*1101 | 11.0% | B*5101 | 12.4% |
| B*4001 | 13.6% | A*6802 | 12.7% | B*5101 | 10.8% | C*0302 | 12.0% |
| A*2402 | 12.1% | C*1701 | 11.7% | C*1601 | 10.6% | B*3802 | 11.4% |
| B*3501 | 10.7% | B*4501 | 10.8% | B*4403 | 9.9% | A*0207 | 11.0% |
| C*0303 | 10.6% | B*4201 | 10.5% | C*0102 | 9.7% | B*1501 | 9.4% |
| B*5101 | 10.4% | A*3001 | 10.4% | A*2902 | 9.7% | A*0206 | 9.3% |
| C*1203 | 9.9% | B*3501 | 10.1% | C*0802 | 9.3% | C*0303 | 9.2% |
| B*1501 | 9.6% | A*0101 | 10.0% | B*1801 | 9.1% | B*1502 | 9.1% |
| A*2902 | 8.9% | C*0304 | 9.3% | A*3101 | 8.9% | A*0203 | 8.8% |
| A*2601 | 8.2% | A*3002 | 9.2% | B*5201 | 8.6% | B*4403 | 8.6% |
| A*3201 | 8.2% | B*0801 | 8.5% | B*1402 | 8.6% | C*1402 | 8.4% |
| C*0802 | 7.7% | A*3402 | 8.4% | C*0202 | 7.6% | B*3501 | 7.2% |
| A*2501 | 7.5% | A*7401 | 8.4% | C*1203 | 7.6% | C*0602 | 7.0% |
| B*5701 | 7.1% | A*3303 | 8.0% | A*2601 | 7.6% | B*5401 | 6.9% |
| B*1402 | 6.7% | C*1801 | 7.3% | A*6801 | 7.1% | B*1301 | 6.6% |
| C*0202 | 6.6% | A*2902 | 7.2% | B*0801 | 7.0% | B*4002 | 6.3% |
| B*1801 | 6.4% | B*4403 | 6.9% | A*3002 | 6.8% | B*5502 | 6.3% |
| B*4403 | 6.4% | B*4901 | 6.9% | B*4402 | 6.5% | A*2601 | 6.0% |

Figure 19: Detection of Borrelia specific T cells using MHC dextramers
A)
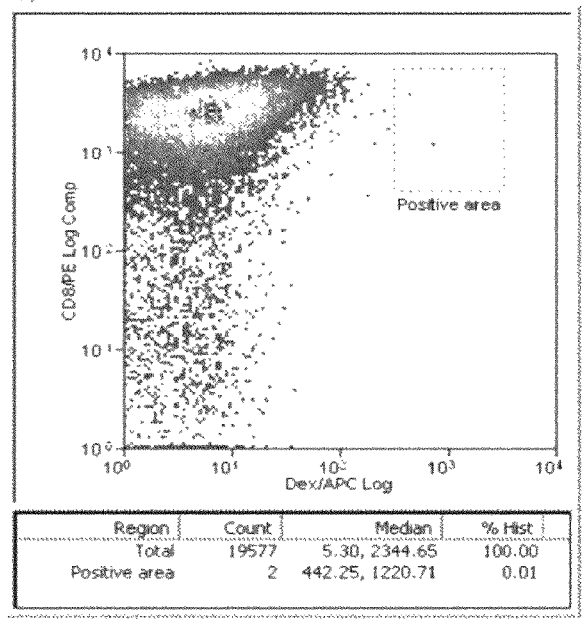
B)
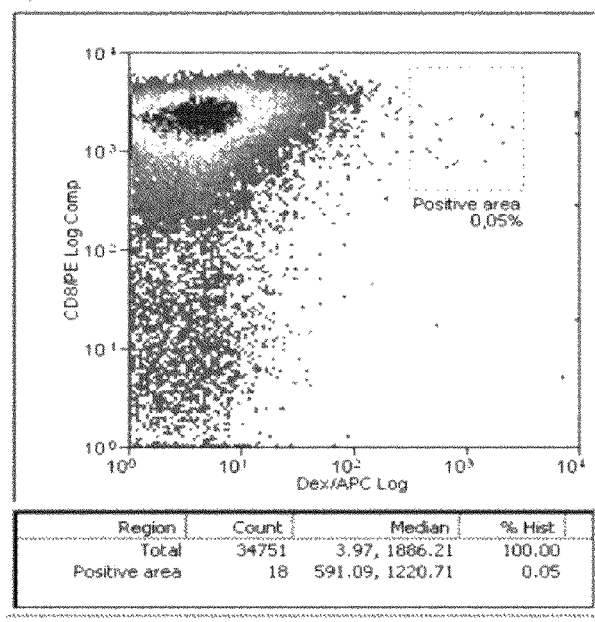

Figure 20: Detection of CMV specific T cells using MHC dextramers
A)
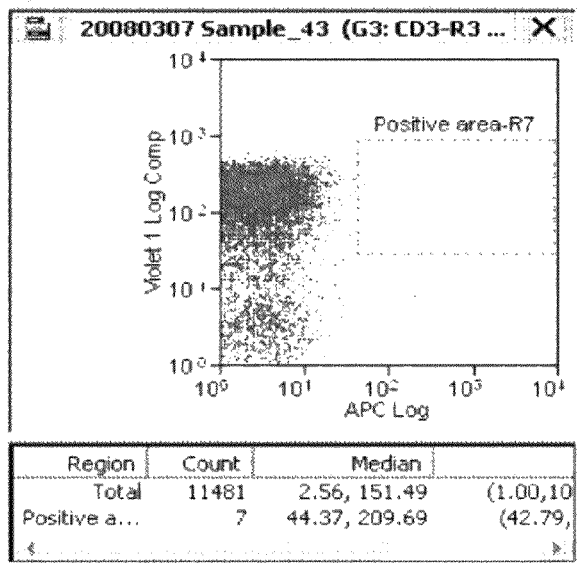
B)
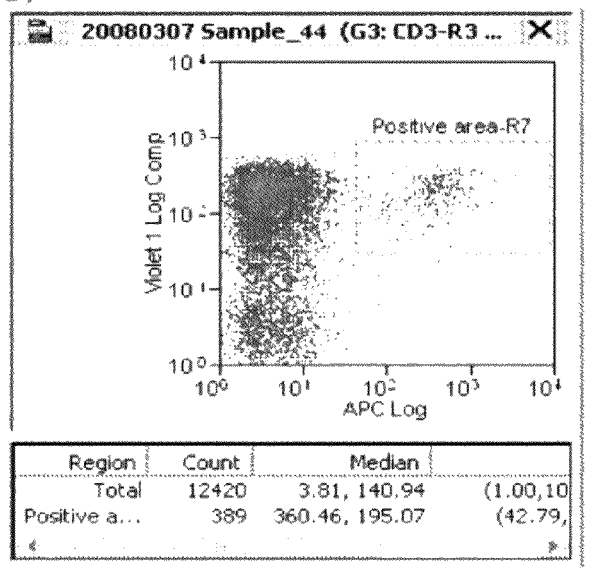

MHC PEPTIDE COMPLEXES AND USES THEREOF IN INFECTIOUS DISEASES

This application claims priority under 35 U.S.C. § 120 as a continuation of U.S. application Ser. No. 12/619,039 filed Nov. 16, 2009, which is a continuation of PCT Application No. PCT/DK2008/000118 filed Mar. 26, 2008, which claims priority to the following Danish Patent applications Nos.—PA 2007 00461, filed Mar. 26, 2007, PA 2007 00973, filed Jul. 3, 2007, PA 2007 00975, filed Jul. 3, 2007, PA 2007 00972, filed Jul. 3, 2007, and PA 2007 00974, filed Jul. 3, 2007 and also claims priority to the following U.S. Provisional Patent Application Nos.—U.S. 60/907,217 filed Mar. 26, 2007, U.S. 60/929,583, filed Jul. 3, 2007, U.S. 60/929,581, filed Jul. 3, 2007, U.S. 60/929,582, filed Jul. 3, 2007, and U.S. 60/929,586, Jul. 3, 2007, the contents of each of which are hereby incorporated by reference.

All patent and non-patent references cited in U.S. 60/907,217 as well as in this application are hereby incorporated by reference in their entirety. U.S. 60/907,217 is hereby also incorporated herein by reference in its entirety.

FIELD OF INVENTION

The present invention relates to MHC-peptide complexes and uses thereof in the treatment of a disease in an individual.

BACKGROUND OF THE INVENTION

Biochemical interactions between peptide epitope specific membrane molecules encoded by the Major Histocompatibility Complex (MHC, in humans HLA) and T-cell receptors (TCR) are required to elicit specific immune responses. This requires activation of T-cells by presentation to the T-cells of peptides against which a T-cell response should be raised. The peptides are presented to the T-cells by the MHC complexes.

The Immune Response

The immune response is divided into two parts termed the innate immune response and the adaptive immune response. Both responses work together to eliminate pathogens (antigens). Innate immunity is present at all times and is the first line of defense against invading pathogens. The immediate response by means of pre-existing elements, i.e. various proteins and phagocytic cells that recognize conserved features on the pathogens, is important in clearing and control of spreading of pathogens. If a pathogen is persistent in the body and thus only partially cleared by the actions of the innate immune system, the adaptive immune system initiate a response against the pathogen. The adaptive immune system is capable of eliciting a response against virtually any type of pathogen and is unlike the innate immune system capable of establishing immunological memory.

The adaptive response is highly specific to the particular pathogen that activated it but it is not so quickly launched as the innate when first encountering a pathogen. However, due to the generation of memory cells, a fast and more efficient response is generated upon repeated exposure to the same pathogen. The adaptive response is carried out by two distinct sets of lymphocytes, the B cells producing antibodies leading to the humoral or antibody mediated immune response, and the T cells leading to the cell mediated immune response.

T cells express a clonotypic T cell receptor (TCR) on the surface. This receptor enable the T cell to recognize peptide antigens bound to major histocompatibility complex (MHC) molecules, called human leukocyte antigens (HLA) in man. Depending on the type of pathogen, being intracellular or extracellular, the antigenic peptides are bound to MHC class I or MHC class II, respectively. The two classes of MHC complexes are recognized by different subsets of T cells; Cytotoxic CD8+ T cells recognizing MHC class I and CD4+ helper cells recognizing MHC class II. In general, TCR recognition of MHC-peptide complexes result in T cell activation, clonal expansion and differentiation of the T cells into effector, memory and regulatory T cells.

B cells express a membrane bound form of immunoglobulin (Ig) called the B cell receptor (BCR). The BCR recognizes an epitope that is part of an intact three dimensional antigenic molecule. Upon BCR recognition of an antigen the BCR:antigen complex is internalized and fragments from the internalized antigen is presented in the context of MHC class II on the surface of the B cell to CD4+ helper T-cells (Th). The specific Th cell will then activate the B cell leading to differentiation into an antibody producing plasma cell.

A very important feature of the adaptive immune system is its ability to distinguish between self and non-self antigens, and preferably respond against non-self. If the immune system fails to discriminate between the two, specific immune responses against self-antigens are generated. These autoimmune reactions can lead to damage of self-tissue.

The adaptive immune response is initiated when antigens are taken up by professional antigen presenting cells such as dendritic cells, Macrophages, Langerhans cells and B-cells. These cells present peptide fragments, resulting from the degradation of proteins, in the context of MHC class II proteins (Major Histocompatibility Complex) to helper T cells. The T helper cells then mediate help to B-cells and antigen specific cytotoxic T cells, both of which have received primary activation signals via their BCR respective TCR. The help from the Th-cell is mediated by means of soluble mediators e.g. cytokines.

In general the interactions between the various cells of the cellular immune response is governed by receptor-ligand interactions directly between the cells and by production of various soluble reporter substances e.g. cytokines by activated cells.

MHC-Peptide Complexes.

MHC complexes function as antigenic peptide receptors, collecting peptides inside the cell and transporting them to the cell surface, where the MHC-peptide complex can be recognized by T-lymphocytes. Two classes of classical MHC complexes exist, MHC class I and II. The most important difference between these two molecules lies in the protein source from which they obtain their associated peptides. MHC class I molecules present peptides derived from endogenous antigens degraded in the cytosol and are thus able to display fragments of viral proteins and unique proteins derived from cancerous cells. Almost all nucleated cells express MHC class I on their surface even though the expression level varies among different cell types. MHC class II molecules bind peptides derived from exogenous antigens. Exogenous proteins enter the cells by endocytosis or phagocytosis, and these proteins are degraded by proteases in acidified intracellular vesicles before presentation by MHC class II molecules. MHC class II molecules are only expressed on professional antigen presenting cells like B cells and macrophages.

The three-dimensional structure of MHC class I and II molecules are very similar but important differences exist. MHC class I molecules consist of two polypeptide chains, a heavy chain, α, spanning the membrane and a light chain, β2-microglobulin (β2m). The heavy chain is encoded in the gene complex termed the major histocompatibility complex (MHC), and its extracellular portion comprises three domains, α1, α2 and α3. The β2m chain is not encoded in the MHC gene and consists of a single domain, which together with the α3 domain of the heavy chain make up a folded structure that closely resembles that of the immunoglobulin. The α1 and α2 domains pair to form the peptide binding cleft, consisting of two segmented α helices lying on a sheet of eight β-strands. In humans as well as in mice three different types of MHC class I molecule exist. HLA-A, B, C are found in humans while MHC class I molecules in mice are designated H-2K, H-2D and H-2L.

The MHC class II molecule is composed of two membrane spanning polypeptide chains, α and β, of similar size (about 30000 Da). Genes located in the major histocompatibility complex encode both chains. Each chain consists of two domains, where α1 and β1 forms a 9-pocket peptide-binding cleft, where pocket 1, 4, 6 and 9 are considered as major peptide binding pockets. The α2 and β2, like the α2 and β2m in the MHC class I molecules, have amino acid sequence and structural similarities to immunoglobulin constant domains. In contrast to MHC class I complexes, where the ends of the antigenic peptide is buried, peptide-ends in MHC class II complexes are not. HLA-DR, DQ and DP are the human class II molecules, H-2A, M and E are those of the mice.

A remarkable feature of MHC genes is their polymorphism accomplished by multiple alleles at each gene. The polygenic and polymorphic nature of MHC genes is reflected in the peptide-binding cleft so that different MHC complexes bind different sets of peptides. The variable amino acids in the peptide binding cleft form pockets where the amino acid side chains of the bound peptide can be buried. This permits a specific variant of MHC to bind some peptides better than others.

MHC Multimers

Due to the short half-life of the peptide-MHC-T cell receptor ternary complex (typically between 10 and 25 seconds) it is difficult to label specific T cells with labelled MHC-peptide complexes, and like-wise, it is difficult to employ such monomers of MHC-peptide for therapeutic and vaccine purposes because of their weak binding. In order to circumvent this problem, MHC multimers have been developed. These are complexes that include multiple copies of MHC-peptide complexes, providing these complexes with an increased affinity and half-life of interaction, compared to that of the monomer MHC-peptide complex. The multiple copies of MHC-peptide complexes are attached, covalently or non-covalently, to a multimerization domain. Known examples of such MHC multimers include the following:

MHC-dimers: Each MHC dimer contains two copies of MHC-peptide. IgG is used as multimerization domain, and one of the domains of the MHC protein is covalently linked to IgG.

MHC-tetramers: Each MHC-tetramer contains four copies of MHC-peptide, each of which is biotinylated. The MHC complexes are held together in a complex by the streptavidin tetramer protein, providing a non-covalent linkage between a streptavidin monomer and the MHC protein. Tetramers are described in U.S. Pat. No. 5,635,363.

MHC pentamers: Five copies of MHC-peptide complexes are multimerised by a self-assembling coiled-coil domain, to form a MHC pentamer. MHC pentamers are described in the US patent 2004209295

MHC dextramers: A large number of MHC-peptide complexes, typically more than ten, are attached to a dextran polymer. MHC-dextramers are described in the patent application WO 02/072631 A2.

MHC streptamers: 8-12 MHC-peptide complexes attached to Streptactin. MHC streptamers are described in Knabel M et al. Reversible MHC multimer staining for functional isolation of T-cell populations and effective adoptive transfer. Nature medicine 6. 631-637 (2002).

Use of MHC Multimers in Flow Cytometry and Related Techniques

The concentration of antigen specific T-cells in samples from e.g. peripheral blood can be very low. Flow cytometry and related methods offer the ability to analyze a large number of cells and simultaneously identify the few of interest. MHC multimers have turned out to be very valuable reagents for detection and characterization of antigen specific T-cells in flow cytometer experiments. The relative amount of antigen specific T cells in a sample can be determined and also the affinity of the binding of MHC multimer to the T-cell receptor can be determined.

The basic function of a flow cytometer is its ability to analyse and identify fluorochrome labelled entities in a liquid sample, by means of its excitation, using a light source such as a laser beam and the light emission from the bound fluorochrome.

MHC multimers is used as detections molecule for identification of antigen specific T-cells in flow cytometry, by labelling the MHC multimer with a specific fluorochrome, which is detectable, by the flow cytometer used.

In order to facilitate the identification of a small amount of cells, the cells can be sub-categorized using antibodies or other fluorochrome labelled detections molecules directed against surface markers other than the TCR on the specific T-cells population. Antibodies or other fluorochrome labelled detections molecules can also be used to identify cells known not to be antigen specific T-cells. Both kinds of detections molecules are in the following referred to as gating reagents. Gating reagents, helps identify the "true" antigen specific T cells bound by MHC multimers by identifying specific subpopulations in a sample, e.g. T cells and by excluding cells that for some reason bind MHC multimers without being antigen specific T-cells. Other cytometry methods, e.g. fluorescence microscopy and IHC can like flow cytometry be employed in identification of antigen specific T cells in a cell sample using MHC multimers.

Application of MHC Multimers in Immune Monitoring, Diagnostics, Prognostics, Therapy and Vaccines T cells are pivotal for mounting an adaptive immune response. It is therefore of importance to be able to measure the number of specific T cells when performing a monitoring of a given immune response, for example in connection with vaccine development, autologous cancer therapy, transplantation, infectious diseases, toxicity studies etc.

Accordingly, the present invention further provides powerful tools in the fields of vaccines, therapy and diagnosis. One objective of the present invention is to provide methods for anti-tumour and anti-virus immunotherapy by generating antigen-specific T-cells capable of inactivating or eliminating undesirable target cells. Another objective is to isolate antigen-specific T-cells and culture these in the presence of co-stimulatory molecules. Ex vivo priming and expansion of T-cell populations allows the T-cells to be used in immunotherapy of various types of cancer and infectious diseases. A third objective of the present invention is to identify and label specific subsets of cells with relevance for the development or treatment of diseases.

SUMMARY OF THE INVENTION

Measurement of antigen specific T cells during an immune response are important parameters in vaccine development, autologous cancer therapy, transplantation, infectious diseases, inflammation, autoimmunity, toxicity studies etc. MHC multimers are crucial reagents in monitoring of antigen specific T cells. The present invention describes novel methods to generate MHC multimers and methods to improve existing and new MHC multimers. The invention also describes improved methods for the use of MHC multimers in analysis of T cells in samples including diagnostic and prognostic methods. Furthermore the use of MHC multimers in therapy are described, e.g. anti-tumour and anti-virus therapy, including isolation of antigen specific T cells capable of inactivation or elimination of undesirable target cells or isolation of specific T cells capable of regulation of other immune cells.

The present invention in one aspect refers to a MHC monomer comprising a-b-P, or a MHC multimer comprising $(a-b-P)_n$, wherein n>1,
wherein a and b together form a functional MHC protein capable of binding the peptide P,
wherein (a-b-P) is the MHC-peptide complex formed when the peptide P binds to the functional MHC protein, and
wherein each MHC peptide complex of a MHC multimer is associated with one or more multimerization domains.

MHC monomers and MHC multimers comprising one or more MHC peptide complexes of class 1 or class 2 MHC are covered by the present invention. Accordingly, the peptide P can have a length of e.g. 8, 9, 10, 11, 12, 13, 14, 15, 16, 16-20, or 20-30 amino acid residues.

Examples of the peptide P is provided herein below. In one embodiment, the peptide P can be selected from the group consisting of sequences disclosed in the electronically enclosed "Sequence Listing" and annotated consecutively (using integers) starting with SEQ ID NO:1 and ending with SEQ ID NO:52252.

In another aspect the present invention is directed to a composition comprising a plurality of MHC monomers and/or MHC multimers according to the present invention, wherein the MHC multimers are identical or different, and a carrier.

In yet another aspect there is provided a kit comprising a MHC monomer or a MHC multimer according to the present invention, or a composition according to the present invention, and at least one additional component, such as a positive control and/or instructions for use.

In a still further aspect there is provided a method for immune monitoring one or more diseases comprising monitoring of antigen specific T cells, said method comprising the steps of
i) providing the MHC monomer or MHC multimer or individual components thereof according to the present invention, or the individual components thereof,
ii) providing a population of antigen specific T cells or individual antigen specific T cells, and
iii) measuring the number, activity or state and/or presence of antigen specific of T cells specific for the peptide P of the said MHC monomer or MHC multimer, thereby immune monitoring said one or more diseases.

In yet another aspect there is provided a method for diagnosing one or more diseases comprising immune monitoring of antigen specific T cells, said method comprising the following steps: of
i) providing the MHC monomer or MHC multimer or individual components thereof according to the present invention, or individual components thereof,
ii) providing a population of antigen specific T cells or individual antigen specific T cells, and
iii) measuring the number, activity or state and/or presence of T cells specific for said MHC monomer or the peptide P of the MHC multimer, thereby diagnosing said one or more diseases.

There is also provided a method for isolation of one or more antigen specific T cells, said method comprising the steps of
i) providing the MHC monomer or MHC multimer or individual components thereof according to the present invention, or individual components thereof, and
ii) providing a population of antigen specific T cells or individual antigen specific T cells, and
iii) thereby isolating said T cells specific for the peptide P of the said MHC monomer or MHC multimer.

The present invention makes it possible to pursue different immune monitoring methods using the MHC monomers and MHC multimers according to the present invention. The immune monitoring methods include e.g. flow cytometry, ELISPOT, LDA, Quantaferon and Quantaferon-like methods. Using the above-cited methods, the MHC monomers and/or the MHC multimers can be provided as a MHC peptide complex, or the peptide and the MHC monomer and/or multimer can be provided separately.

Accordingly, recognition of TCR's can be achieved by direct or indirect detection, e.g. by using one or more of the following methods:

ELISPOT technique using indirect detection, e.g. by adding the antigenic peptide optionally associated with a MHC monomer or MHC multimer, followed by measurement of INF-gamma secretion from a population of cells or from individual cells.

Another technique involves a Quantaferon-like detection assays, e.g. by using indirect detection, e.g. by adding the antigenic peptide optionally associated with a MHC monomer or MHC multimer, followed by measurement of INF-gamma secretion from a population of cells or from individual cells.

Flow cytometry offers another alternative for performing detection assays, e.g. by using direct detection (e.g. of MHC tetramers), e.g. by adding the antigenic peptide optionally associated with a MHC monomer or MHC multimer, followed by detection of a fluorescein label, thereby measuring the number of TCRs on specific T-cells.

Flow cytometry can also be used for indirect detection, e.g. by adding the antigenic peptide optionally associated with a MHC monomer or MHC multimer, followed by addition of a "cell-permeabilizing factor", and subsequent measurement of an intracellular component (e.g. INF-gamma mRNA), from individual cells or populations of cells.

By using the above-mentioned and other techniques, one can diagnose and/or monitor e.g. infectious diseases caused e.g. by mycobacetrium, Gram positive bacteria, Gram negative bacteria, Spirochetes, intracellular bacterium, extracellular bacterium, *Borrelia*, TB, CMV, HPV, Hepatitis, BK, fungal organisms and microorganisms. The diagnosis and/or monitoring of a particular disease can greatly aid in directing an optimal treatment of said disease in an individual. Cancer diagnostic methods and/or cancer monitoring methods also fall within the scope of the present invention.

In still further aspects of the present invention there is provided a method for performing a vaccination of an individual in need thereof, said method comprising the steps of
- providing a MHC monomer or a MHC multimer according to the present invention, or the individual components thereof, and
- administering said MHC monomer or MHC multimer to said individual and obtaining a protective immune response, thereby performing a vaccination of the said individual.

In yet another embodiment there is provided a method for performing therapeutic treatment of an individual comprising the steps of
- Providing the MHC multimer according to the present invention, or individual components thereof, and
- Isolating or obtaining T-cells from a source, such as an individual or an ex-vivo library or cell bank, wherein said isolated or obtained T-cells are specific for said provided MHC multimer,
- Optionally manipulating said T-cells, and
- Introducing said isolated or obtained T-cells into an individual to be subjected to a therapeutic treatment, wherein the individual can be the same individual or a different individual from the source individual.

There is also provided in accordance with the present invention a method for immune monitoring one or more cancer diseases comprising the step of monitoring one or more cancer antigen specific T-cells, said method comprising the steps of
- providing a MHC monomer or MHC multimer, or individual components thereof, as described herein,
- providing a population of cancer antigen specific T cells, or individual cancer antigen specific T cells, and
- measuring the number and/or presence of cancer antigen specific T cells specific for the peptide P of the MHC monomer or MHC multimer, thereby immune monitoring said one or more cancer diseases.

In a still further aspect there is provided a method for diagnosing one or more cancer diseases in an individual, said method comprising the step of performing an immune monitoration of one or more cancer antigen specific T cell(s), said method comprising the further steps of
- providing the MHC multimer or individual components thereof according to the present invention,
- providing a population of cancer antigen specific T cells, or individual cancer antigen specific T cells, and
- measuring the number and/or presence of T cells specific for the peptide P of the MHC monomer or MHC multimer, thereby diagnosing said one or more cancer diseases.

In yet another aspect of the present invention there is provided a method for performing a cancer vaccination of an individual in need thereof, said method comprising the steps of
- providing a MHC monomer or MHC multimer according to any of the present invention, and
- administering said MHC monomer or said MHC multimer to said individual, thereby performing a cancer vaccination of the said individual.

In a still further aspect of the present invention there is provided a method for performing a cancer therapeutic treatment of an individual comprising the steps of
- Providing the MHC multimer according to the present invention, and
- Isolation of T cells specific for said MHC multimer, and
- Optionally manipulation of said T cell and
- Introduction of said T cells into the same or a different individual to obtain a cancer therapeutic treatment.

There is also provided a method comprising one or more steps for minimizing undesired binding of the MHC multimer according to the present invention. This method is disclosed herein below in more detail.

In further aspects the present invention provides:

A method for performing a control experiment comprising the step of counting of particles comprising the MHC multimer according to the present invention.

A method for performing a control experiment comprising the step of sorting of particles comprising the MHC multimer according to the present invention.

A method for performing a control experiment comprising the step of performing flow cytometry analysis of particles comprising the MHC multimer according to the present invention.

A method for performing a control experiment comprising the step of performing a immunohistochemistry analysis comprising the MHC multimer according to the present invention.

A method for performing a control experiment comprising the step of performing a immunocytochemistry analysis comprising the MHC multimer according to the present invention.

A method for performing a control experiment comprising the step of performing an ELISA analysis comprising the MHC multimer according to the present invention.

In a still further aspect of the present invention there is provided a method for generating MHC multimers according to the present invention, said method comprising the steps of
i) providing one or more peptides P; and/or
ii) providing one or more functional MHC proteins,
iii) optionally providing one or more multimerization domains, and
iv) contacting the one or more peptides P and the one or more functional MHC proteins and the one or more multimerization domains simultaneously or sequentially in any order, thereby obtaining MHC multimers according to the present invention.

The method can also be performed by initially providing one or more antigenic peptide(s) P and one or more functional MHC proteins to generate a MHC-peptide complex (a-b-P); subsequently providing one or more multimerisation domain(s); and reacting the one or more MHC-peptide complexes and the one or more multimerization domain(s) to generate a MHC multimer according to the present invention.

Definitions

As used everywhere herein, the term "a", "an" or "the" is meant to be one or more, i.e. at least one.

Adjuvant: adjuvants are drugs that have few or no pharmacological effects by themselves, but can increase the efficacy or potency of other drugs when given at the same time. In another embodiment, an adjuvant is an agent which, while not having any specific antigenic effect in itself, can stimulate the immune system, increasing the response to a vaccine.

Agonist: agonist as used herein is a substance that binds to a specific receptor and triggers a response in the cell. It mimics the action of an endogenous ligand that binds to the same receptor.

Antagonist: antagonist as used herein is a substance that binds to a specific receptor and blocks the response in the cell. It blocks the action of an endogenous ligand that binds to the same receptor.

Antibodies: As used herein, the term "antibody" means an isolated or recombinant binding agent that comprises the necessary variable region sequences to specifically bind an antigenic epitope. Therefore, an antibody is any form of antibody or fragment thereof that exhibits the desired biological activity, e.g., binding the specific target antigen. Antibodies can derive from multiple species. For example, antibodies include rodent (such as mouse and rat), rabbit, sheep, camel, and human antibodies. Antibodies can also include chimeric antibodies, which join variable regions from one species to constant regions from another species. Likewise, antibodies can be humanized, that is constructed by recombinant DNA technology to produce immunoglobulins which have human framework regions from one species combined with complementarity determining regions (CDR's) from a another species' immunoglobulin. The antibody can be monoclonal or polyclonal.

Antibodies can be divided into isotypes (IgA, IgG, IgM, IgD, IgE, IgG1, IgG2, IgG3, IgG4, IgA1, IgA2, IgM1, IgM2)

Antibodies: In another embodiment the term "antibody" refers to an intact antibody, or a fragment of an antibody that competes with the intact antibody for antigen binding. In certain embodiments, antibody fragments are produced by recombinant DNA techniques. In certain embodiments, antibody fragments are produced by enzymatic or chemical cleavage of intact antibodies. Exemplary antibody fragments include, but are not limited to, Fab, Fab', F(ab')2, Fv, and scFv. Exemplary antibody fragments also include, but are not limited to, domain antibodies, nanobodies, minibodies ((scFv-C.sub.H3).sub.2), maxibodies ((scFv-C.sub.H2-C.sub.H3).sub.2), diabodies (noncovalent dimer of scFv).

Antigen presenting cell: An antigen-presenting cell (APC) as used herein is a cell that displays foreign antigen complexed with MHC on its surface.

Antigenic peptide: Any peptide molecule that is bound or able to bind into the binding groove of either MHC class 1 or MHC class 2.

Aptamer: the term aptamer as used herein is defined as oligonucleic acid or peptide molecules that bind a specific target molecule. Aptamers are usually created by selecting them from a large random sequence pool, but natural aptamers also exist. Aptamers can be divided into DNA amtamers, RNA aptamers and peptide aptamers.

Avidin: Avidin as used herein is a glycoprotein found in the egg white and tissues of birds, reptiles and amphibians. It contains four identical subunits having a combined mass of 67,000-68,000 daltons. Each subunit consists of 128 amino acids and binds one molecule of biotin.

Biologically active molecule: A biologically active molecule is a molecule having itself a biological activity/effect or is able to induce a biological activity/effect when administered to a biological system. Biologically active molecules include adjuvants, immune targets (e.g. antigens), enzymes, regulators of receptor activity, receptor ligands, immune potentiators, drugs, toxins, cytotoxic molecules, co-receptors, proteins and peptides in general, sugar moieties, lipid groups, nucleic acids including siRNA, nanoparticles, small molecules.

Bioluminescent: Bioluminescence, as used herein, is the production and emission of light by a living organism as the result of a chemical reaction during which chemical energy is converted to light energy.

Biotin: Biotin, as used herein, is also known as vitamin H or $B_7$. Niotin has the chemical formula $C_{10}H_{16}N_2O_3S$.

Bispecific antibodies: The term bispecific antibodies as used herein is defined as monoclonal, preferably but not limited to human or humanized, antibodies that have binding specificities for at least two different antigens. The antibody can also be trispecific or multispecific.

Carrier: A carrier as used herein can be any type of molecule that is directly or indirectly associated with the MHC peptide complex. In this invention, a carrier will typically refer to a functionalized polymer (e.g. dextran) that is capable of reacting with MHC-peptide complexes, thus covalently attaching the MHC-peptide complex to the carrier, or that is capable of reacting with scaffold molecules (e.g. streptavidin), thus covalently attaching streptavidin to the carrier; the streptavidin then may bind MHC-peptide complexes. Carrier and scaffold are used interchangeably herein where scaffold typically refers to smaller molecules of a multimerization domain and carrier typically refers to larger molecule and/or cell like structures.

Chelating chemical compound: Chelating chemical compound, as used herein, is the process of reversible binding of a ligand to a metal ion, forming a metal complex.

Chemiluminescent: Chemiluminescence, as used herein, is the emission of light (luminescence) without emission of heat as the result of a chemical reaction.

Chromophore: A chromophore, as used herein, is the part of a visibly coloured molecule responsible for light absorption over a range of wavelengths thus giving rise to the colour. By extension the term can be applied to uv or it absorbing parts of molecules.

Coiled-coil polypeptide: the term coiled-coil polypeptide as used herein is a structural motif in proteins, in which 2-7 alpha-helices are coiled together like the strands of a rope Covalent binding: The term covalent binding is used herein to describe a form of chemical bonding that is characterized by the sharing of pairs of electrons between atoms. Attraction-to-repulsion stability that forms between atoms when they share electrons is known as covalent bonding.

Crosslinking is the process of chemically joining two or more molecules by a covalent bond. Crosslinking reagents contain reactive ends to specific functional groups (primary amines, sulfhydryls, etc.) on proteins or other molecules.

Diagnosis: The act or process of identifying or determining the nature and cause of a disease or injury through evaluation Diabodies: The term "diabodies" refers to small antibody fragments with two antigen-binding sites, which fragments comprise a heavy-chain variable domain (VH) connected to a light-chain variable domain (VL) in the same polypeptide chain (VH-VL). By using a linker that is too short to allow pairing between the two domains on the same chain, the domains are forced to pair with the complementary domains of another chain and create two antigen-binding sites.

Dendritic cell: The term dendritic cell as used herein is a type of immune cells. Their main function is to process antigen material and present it on the surface to other cells of the immune system, thus functioning as antigen-presenting cells.

Detection: In this invention detection means any method capable of measuring one molecule bound to another molecule. The molecules are typically proteins but can be any type of molecule Dextran: the term dextran as used herein is a complex, branched polysaccharide made of many glucose molecules joined into chains of varying lengths. The straight chain consists of α1→6 glycosidic linkages between glucose molecules, while branches begin from α1→3 linkages (and in some cases, α1→2 and α1→4 linkages as well).

Direct detection of T cells: Direct detection of T cells is used herein interchangeably with direct detection of TCR and direct detection of T cell receptor. As used herein direct detection of T cells is detection directly of the binding interaction between a specific T cell receptor and a MHC multimer.

DNA: The term DNA (Deoxyribonucleic acid) duplex as used herein is a polymer of simple units called nucleotides, with a backbone made of sugars and phosphate atoms joined by ester bonds. Attached to each sugar is one of four types of molecules called bases.

DNA duplex: In living organisms, DNA does not usually exist as a single molecule, but instead as a tightly-associated pair of molecules. These two long strands entwine like vines, in the shape of a double helix.

Electrophilic: electrophile, as used herein, is a reagent attracted to electrons that participates in a chemical reaction by accepting an electron pair in order to bond to a nucleophile.

Enzyme label: enzyme labelling, as used herein, involves a detection method comprising a reaction catalysed by an enzyme.

Epitope-focused antibody: Antibodies also include epitope-focused antibodies, which have at least one minimal essential binding specificity determinant from a heavy chain or light chain CDR3 from a reference antibody, methods for making such epitope-focused antibodies are described in U.S. patent application Ser. No. 11/040,159, which is incorporated herein by reference in its entirety.

Flow cytometry: The analysis of single cells using a flow cytometer.

Flow cytometer: Instrument that measures cell size, granularity and fluorescence due to bound fluorescent marker molecules as single cells pass in a stream past photodectors. A flow cytometer carry out the measurements and/or sorting of individual cells.

Fluorescent: the term fluorescent as used herein is to have the ability to emit light of a certain wavelength when activated by light of another wavelength.

Fluorochromes: fluorochrome, as used herein, is any fluorescent compound used as a dye to mark e.g. protein with a fluorescent label.

Fluorophore: A fluorophore, as used herein, is a component of a molecule which causes a molecule to be fluorescent.

Folding: In this invention folding means in vitro or in vivo folding of proteins in a tertiary structure.

Fusion antibody: As used herein, the term "fusion antibody" refers to a molecule in which an antibody is fused to a non-antibody polypeptide at the N- or C-terminus of the antibody polypeptide.

Glycosylated: Glycosylation, as used herein, is the process or result of addition of saccharides to proteins and lipids.

Hapten: A residue on a molecule for which there is a specific molecule that can bind, e.g. an antibody.

Heteroconjugate antibodies are composed of two covalently joined antibodies. Such antibodies have, for example, been proposed to target immune system cells to unwanted cells.

IgG: IgG as used herein is a monomeric immunoglobulin, built of two heavy chains and two light chains. Each molecule has two antigen binding sites.

Isolated antibody: The term "isolated" antibody as used herein is an antibody which has been identified and separated and/or recovered from a component of its natural environment.

Immunoconjugates: The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate) Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *momordica charantia* inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis(p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene).

Immune monitoring: Immune monitoring of the present invention refers to testing of immune status in the diagnosis and therapy of diseases like but not limited to cancer, immunoproliferative and immunodeficiency disorders, autoimmune abnormalities, and infectious disease. It also refers to testing of immune status before, during and after vaccination and transplantation procedures.

Immune monitoring process: a series of one or more immune monitoring analysis

Indirect detection of T cells: Indirect detection of T cells is used interchangeably herein with Indirect detection of TCR and indirect detection of T cell receptor. As used herein indirect detection of T cells is detection of the binding interaction between a specific T cell receptor and a MHC multimer by measurement of the effect of the binding interaction.

Ionophore: ionophore, as used herein, is a lipid-soluble molecule usually synthesized by microorganisms capable of transporting ions.

Label: Label herein is used interchangeable with labeling molecule. Label as described herein is an identifiable substance that is detectable in an assay and that can be attached to a molecule creating a labeled molecule. The behavior of the labeled molecule can then be studied.

Labelling: Labelling herein means attachment of a label to a molecule.

Lanthanide: lanthanide, as used herein, series comprises the 15 elements with atomic numbers 57 through 71, from lanthanum to lutetium.

Linker molecule: Linker molecule and linker is used interchangeable herein. A linker molecule is a molecule that covalently or non-covalently connects two or more molecules, thereby creating a larger complex consisting of all molecules including the linker molecule.

Liposomes: The term liposomes as used herein is defined as a spherical vesicle with a membrane composed of a phospholipid and cholesterol bilayer. Liposomes, usually but not by definition, contain a core of aqueous solution; lipid spheres that contain no aqueous material are called micelles.

Immunoliposomes: The antibodies disclosed herein can also be formulated as immunoliposomes. Liposomes comprising the antibody are prepared by methods known in the art, such as described in Epstein et al., Proc. Natl. Acad. Sci. USA 82: 3688 (1985); Hwang et al., Proc. Natl. Acad. Sci. USA 77: 4030 (1980); and U.S. Pat. Nos. 4,485,045 and 4,544,545. Particularly useful liposomes can be generated by the reverse-phase evaporation method with a lipid composition comprising phosphatidylcholine, cholesterol, and PEG-derivatized phosphatidylethanolamine (PEG-PE).

Marker: Marker is used interchangeably with marker molecule herein. A marker is molecule that specifically associates covalently or non-covalently with a molecule belonging to or associated with an entity.

MHC: Denotes the major histocompatibility complex.

A "MHC Class I molecule" as used everywhere herein is defined as a molecule which comprises 1-3 subunits, including a heavy chain, a heavy chain combined with a light chain (beta$_2$m), a heavy chain combined with a light chain (beta$_2$m) through a flexible linker, a heavy chain combined with a peptide, a heavy chain combined with a peptide through a flexible linker, a heavy chain/beta$_2$m dimer combined with a peptide, and a heavy chain/beta$_2$m dimer with a peptide through a flexible linker to the heavy or light chain. The MHC molecule chain can be changed by substitution of single or by cohorts of native amino acids or by inserts, or deletions to enhance or impair the functions attributed to said molecule. By example, it has been shown that substitution of XX with YY in position nn of human beta$_2$m enhance the biochemical stability of MHC Class I molecule complexes and thus can lead to more efficient antigen presentation of subdominant peptide epitopes.

MHC complex: MHC complex is herein used interchangeably with MHC-peptide complex, unless it is specified that the MHC complex is empty, i.e. is not complexed with peptide.

MHC Class I like molecules (including non-classical MHC Class I molecules) include CD1d, HLA E, HLA G, HLA F, HLA H, MIC A, MIC B, ULBP-1, ULBP-2, and ULBP-3.

A "MHC Class II molecule" as used everywhere herein is defined as a molecule which comprises 2-3 subunits including an alpha-chain and a beta-chain (alpha/beta-dimer), an alpha/beta dimer with a peptide, and an alpha/beta dimer combined with a peptide through a flexible linker to the alpha or beta chain, an alpha/beta dimer combined through an interaction by affinity tags e.g. jun-fos, an alpha/beta dimer combined through an interaction by affinity tags e.g. jun-fos and further combined with a peptide through a flexible linker to the alpha or beta chain. The MHC molecule chains can be changed by substitution of single or by cohorts of native amino acids or by inserts, or deletions to enhance or impair the functions attributed to said molecule. Under circumstances where the alpha-chain and beta-chain have been fused, to form one subunit, the "MHC Class II molecule" can comprise only 1 subunit.

MHC Class II like molecules (including non-classical MHC Class II molecules) include HLA DM, HLA DO, I-A beta2, and I-E beta2.

A "peptide free MHC Class I molecule" as used everywhere herein is meant to be a MHC Class I molecule as defined above with no peptide.

A "peptide free MHC Class II molecule" as used everywhere herein is meant to be a MHC Class II molecule as defined above with no peptide.

Such peptide free MHC Class I and II molecules are also called "empty" MHC Class I and II molecules.

The MHC molecule may suitably be a vertebrate MHC molecule such as a human, a mouse, a rat, a porcine, a bovine or an avian MHC molecule. Such MHC complexes from different species have different names. E.g. in humans, MHC complexes are denoted HLA. The person skilled in the art will readily know the name of the MHC complexes from various species.

In general, the term "MHC molecule" is intended to include alleles. By way of example, in humans e.g. HLA A, HLA B, HLA C, HLA D, HLA E, HLA F, HLA G, HLA H, HLA DR, HLA DQ and HLA DP alleles are of interest, and in the mouse system, H-2 alleles are of interest. Likewise, in the rat system RT1-alleles, in the porcine system SLA-alleles, in the bovine system BoLA, in the avian system e.g. chicken-B alleles, are of interest.

"MHC complexes" and "MHC constructs" are used interchangeably herein.

"MHC protein" and "MHC molecule" are used interchangeably herein. Accordingly, a functional MHC peptide complex comprises a MHC protein or MHC molecule associated with a peptide to be presented for cells or binding partners having an affinity for said peptide.

By the terms "MHC complexes" and "MHC multimers" as used herein are meant such complexes and multimers thereof, which are capable of performing at least one of the functions attributed to said complex or multimer. The terms include both classical and non-classical MHC complexes. The meaning of "classical" and "non-classical" in connection with MHC complexes is well known to the person skilled in the art. Non-classical MHC complexes are subgroups of MHC-like complexes. The term "MHC complex" includes MHC Class I molecules, MHC Class II molecules, as well as MHC-like molecules (both Class I and Class II), including the subgroup non-classical MHC Class I and Class II molecules.

The MHC molecule can suitably be a vertebrate MHC molecule such as a human, a mouse, a rat, a porcine, a bovine or an avian MHC molecule. Such MHC complexes from different species have different names. E.g. in humans, MHC complexes are denoted HLA. The person skilled in the art will readily know the name of the MHC complexes from various species.

MHC multimer: The terms MHC multimer, MHCmer and MHC'mer herein are used interchangeably, to denote a complex comprising more than one MHC-peptide complexes, held together by covalent or non-covalent bonds.

Monoclonal antibodies: Monoclonal antibodies, as used herein, are antibodies that are identical because they were produced by one type of immune cell and are all clones of a single parent cell.

Monovalent antibodies: The antibodies in the present invention can be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking. In vitro methods are also suitable for preparing monovalent antibodies. Digestion of antibodies to produce fragments thereof, particularly, Fab fragments, can be accomplished using routine techniques known in the art.

Multimerization domain: A multimerization domain is a molecule, a complex of molecules, or a solid support, to which one or more MHC or MHC-peptide complexes can be attached. A multimerization domain consist of one or more carriers and/or one or more scaffolds and may also contain one or more linkers connecting carrier to scaffold, carrier to carrier, scaffold to scaffold. The multimerization domain may also contain one or more linkers that can be used for attachment of MHC complexes and/or other molecules to the multimerization domain. Multimerization domains thus include IgG, streptavidin, streptactin, micelles, cells, polymers, beads and other types of solid support, and small organic molecules carrying reactive groups or carrying chemical motifs that can bind MHC complexes and other molecules.

Nanobodies: Nanobodies as used herein is a type of antibodies derived from camels, and are much smaller than traditional antibodies.

Neutralizing antibodies: neutralizing antibodies as used herein is an antibody which, on mixture with the homologous infectious agent, reduces the infectious titer.

NMR: NMR (Nuclear magnetic resonance), as used herein, is a physical phenomenon based upon the quantum mechanical magnetic properties of an atom's nucleus. NMR refers to a family of scientific methods that exploit nuclear magnetic resonance to study molecules.

Non-covalent: The term noncovalent bond as used herein is a type of chemical bond, that does not involve the sharing of pairs of electrons, but rather involves more dispersed variations of electromagnetic interactions.

Nucleic acid duplex: A nucleic acid is a complex, high-molecular-weight biochemical macromolecule composed of nucleotide chains that convey genetic information. The most common nucleic acids are deoxyribonucleic acid (DNA) and ribonucleic acid (RNA).

Nucleophilic: a nucleophile, as used herein, is a reagent that forms a chemical bond to its reaction partner (the electrophile) by donating both bonding electrons.

"One or more" as used everywhere herein is intended to include one and a plurality.

A "peptide free MHC Class I molecule" as used everywhere herein is meant to be a MHC Class I molecule as defined above with no peptide.

A "peptide free MHC Class II molecule" as used everywhere herein is meant to be a MHC Class II molecule as defined above with no peptide.

Such peptide free MHC Class I and II molecules are also called "empty" MHC Class I and II molecules.

Pegylated: pegylated, as used herein, is conjugation of Polyethylene glycol (PEG) to proteins.

Peptide or protein: Any molecule composed of at least two amino acids. Peptide normally refers to smaller molecules of up to around 30 amino acids and protein to larger molecules containing more amino acids.

Phosphorylated; phosphorylated, as used herein, is the addition of a phosphate ($PO_4$) group to a protein molecule or a small molecule.

"A plurality" as used everywhere herein should be interpreted as two or more.

PNA: PNA (Peptide nucleic acid) as used herein is a chemical similar to DNA or RNA. PNA is not known to occur naturally in existing life on Earth but is artificially synthesized and used in some biological research and medical treatments. DNA and RNA have a deoxyribose and ribose sugar backbone, respectively, whereas PNA's backbone is composed of repeating N-(2-aminoethyl)-glycine units linked by peptide bonds. The various purine and pyrimidine bases are linked to the backbone by methylene carbonyl bonds. PNAs are depicted like peptides, with the N-terminus at the first (left) position and the C-terminus at the right.

"A plurality" as used everywhere herein should be interpreted as two or more. This applies i.a. to the MHC peptide complex and the binding entity. When a plurality of MHC peptide complexes is attached to the multimerization domain, such as a scaffold or a carrier molecule, the number of MHC peptide complexes need only be limited by the capacity of the multimerization domain.

Polyclonal antibodies: a polyclonal antibody as used herein is an antibody that is derived from different B-cell lines. They are a mixture of immunoglobulin molecules secreted against a specific antigen, each recognising a different epitope.

Polymer: the term polymer as used herein is defined as a compound composed of repeating structural units, or monomers, connected by covalent chemical bonds.

Polypeptide: Peptides are the family of short molecules formed from the linking, in a defined order, of various α-amino acids. The link between one amino acid residue and the next is an amide bond and is sometimes referred to as a peptide bond. Longer peptides are referred to as proteins or polypeptide.

Polysaccharide: The term polysaccharide as used herein is defined as polymers made up of many monosaccharides joined together by glycosidic linkages.

Radicals: radicals, as used herein, are atomic or molecular species with unpaired electrons on an otherwise open shell configuration. These unpaired electrons are usually highly reactive, so radicals are likely to take part in chemical reactions.

Radioactivity: Radioactive decay is the process in which an unstable atomic nucleus loses energy by emitting radiation in the form of particles or electromagnetic waves.

RNA: RNA (Ribonucleic acid) as used herein is a nucleic acid polymer consisting of nucleotide monomers that plays several important roles in the processes that translate genetic information from deoxyribonucleic acid (DNA) into protein products Scaffold: A scaffold is typically an organic molecule carrying reactive groups, capable of reacting with reactive groups on a MHC-peptide complex. Particularly small organic molecules of cyclic structure (e.g. functionalized cycloalkanes or functionalized aromatic ring structures) are termed scaffolds. Scaffold and carrier are used interchangeably herein where scaffold typically refers to smaller molecules of a multimerization domain and carrier typically refers to larger molecule and/or cell like structures.

Staining: In this invention staining means specific or unspecific labelling of cells by binding labeled molecules to defined proteins or other structures on the surface of cells or inside cells. The cells are either in suspension or part of a tissue. The labeled molecules can be MHC multimers, antibodies or similar molecules capable of binding specific structures on the surface of cells.

Streptavidin: Streptavidin as used herein is a tetrameric protein purified from the bacterium *Streptomyces avidinii*. Streptavidin is widely use in molecular biology through its extraordinarily strong affinity for biotin.

Sugar: Sugars as used herein include monosaccharides, disaccharides, trisaccharides and the oligosaccharides—comprising 1, 2, 3, and 4 or more monosaccharide units respectively.

Therapy: Treatment of illness or disability

Vaccine: A vaccine is an antigenic preparation used to establish immunity to a disease or illness and thereby protects or cure the body from a specific disease or illness. Vaccines are either prophylactic and prevent disease or therapeutic and treat disease. Vaccines may contain more than one type of antigen and is then called a combined vaccine.

Vaccination: The introduction of vaccine into the body of human or animals for the purpose of inducing immunity.

B.L. is an abbreviation for Bind level.

Aff. is an abbreviation for affinity.

BRIEF DESCRIPTION OF THE DRAWINGS

FIG. 2. Program for peptide sequence motifs prediction.

FIG. 3. Full List of HLA Class I alleles assigned as of January 2007 from www.anthonynolan.org.uk/HIG/lists/class1list.html.

FIG. 6. Illustration of selected cleavable linkers.

FIG. 7. Prediction of MHC class 1 mouse virus LCMV gp 1 protein nonamer peptide binders for H-2Kd using the Syfpeithi database. Peptides are ranked according to their binding score. Only peptides with binding scores above the value of 11 are listed. The peptides listed in FIG. 7 correspond to SEQ ID NO:61368 to SEQ ID NO:61663.

FIG. 8. Size exclusion chromatography of folded HLA-A*0201-β2m QLFEELQEL peptide-complex (SEQ ID NO:61664). Purification of HLA-A*0201-β2m QLFEELQEL peptide-complex (SEQ ID NO:61664) by size exclusion chromatography on a HiLoad 16/60 Superdex 75 column. Eluted protein was followed by measurement of the absorbance at 280 nm. The elution profile consisted of 4 peaks, corresponding to aggregated Heavy Chain, correctly folded MHC-complex, β2m and excess biotin and peptide.

FIG. 9. MHC-SHIFT Assay. The SHIFT Assay shows that heavy chain is efficiently biotinylated, since the band corresponding to biotinylated heavy chain (lane 2) is shifted up-wards upon incubation with streptavidin.

Lane 1: Benchmark protein-ladder.

Lane 2: Folded HLA-A*0201-β2m-QLFEELQEL peptide-complex (SEQ ID NO:61664).

Lane 3: Folded HLA-A*0201-β2m-QLFEELQEL peptide-complex (SEQ ID NO:61664) incubated with molar excess Streptavidin.

FIG. 10. Composition of Fluorescein-linker molecule. (A) Schematic representation of an example of a Fluorescein-linker molecule. (B) Composition of a L15 linker.

FIG. 11. List of the 24 MHC class 1 alleles used for peptide prediction by the database www.cbs.dtu.dk/services/NetMHC/ and the 14 MHC class 2 alleles used for peptide prediction by the database www.cbs.dtu.dk/services/NetMHCII/.

FIG. 12. Prediction of MHC class 1 mouse virus LCMV gp 1 protein nonamer peptide binders for H-2Kd using the Syfpeithi database. Peptides are ranked according to their binding score. Only peptides with binding scores above the value of 11 are listed. The peptides listed in FIG. 12 correspond to SEQ ID NO:61665 to SEQ ID NO:61726.

FIG. 13. Full List of HLA Class I alleles assigned as of January 2007 from www.anthonynolan.org.uk/HIG/lists/class1list.html.

FIG. 14. List of top 30 HLA class 1 alleles in different human ethnic groups.

Figure 15:
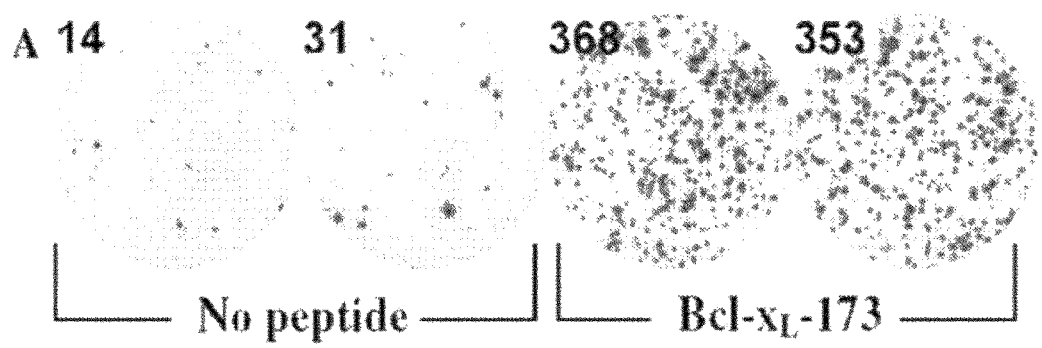

FIG. 15. Ex vivo ELISPOT analysis of BclX(L)-specific, CD8 positive T cells in PBL from a breast cancer patient either with or without the BclX(L) YLNDHLEPWI peptide (SEQ ID NO:61727). Analysis were performed in doublets and number of IFN-gamma producing T-cells are presented. (Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56 (4) 527-33).

Figure 16:
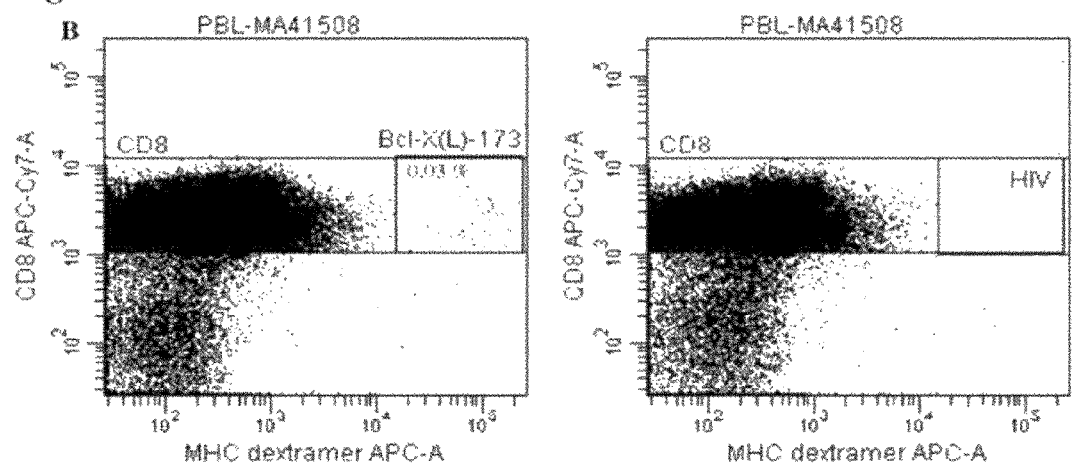

FIG. 16. PBL from a breast cancer patient was analyzed by flow cytometry to identify Bcl-X(L)173-182 (peptide YLNDHLEPWI) (SEQ ID NO:61727) specific CD8 T cells using the dextramer complex HLA-A2/Bcl-X(L)173-182-APC, 7-AAD-PerCP, CD3-FITC, and CD8-APC-Cy7. The dextramer complex HLA-A2/HIV-1 pol476-484-APC was used as negative control. (Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56 (4) 527-33).

Figure 17:
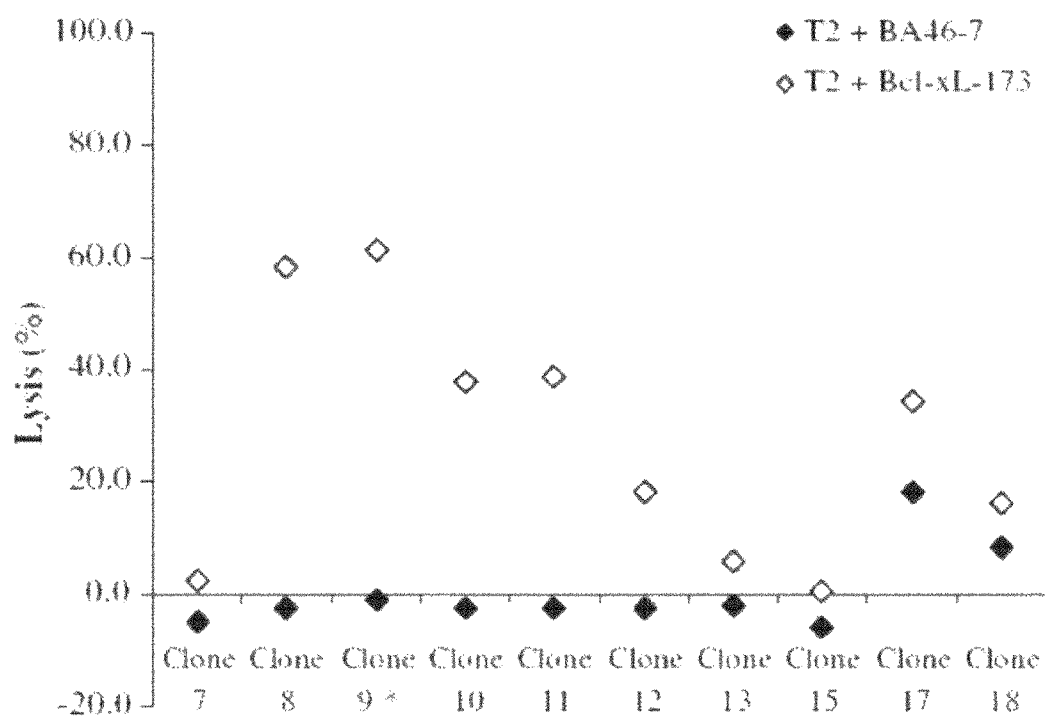

FIG. 17. Ten expanded T cell clones isolated by Flow sorting and then expanded were tested for their specificity by analysis in a standard 51-Cr release assay. For this purpose, T2 cells loaded with either Bcl-X(L)173-182, YLNDHLEPWI peptide (SEQ ID NO:61727) or an irrelevant peptide (BA4697-105, GLQHWVPEL) (SEQ ID NO:61728) were used as target cells. Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56 (4) 527-33).

Figure 18:
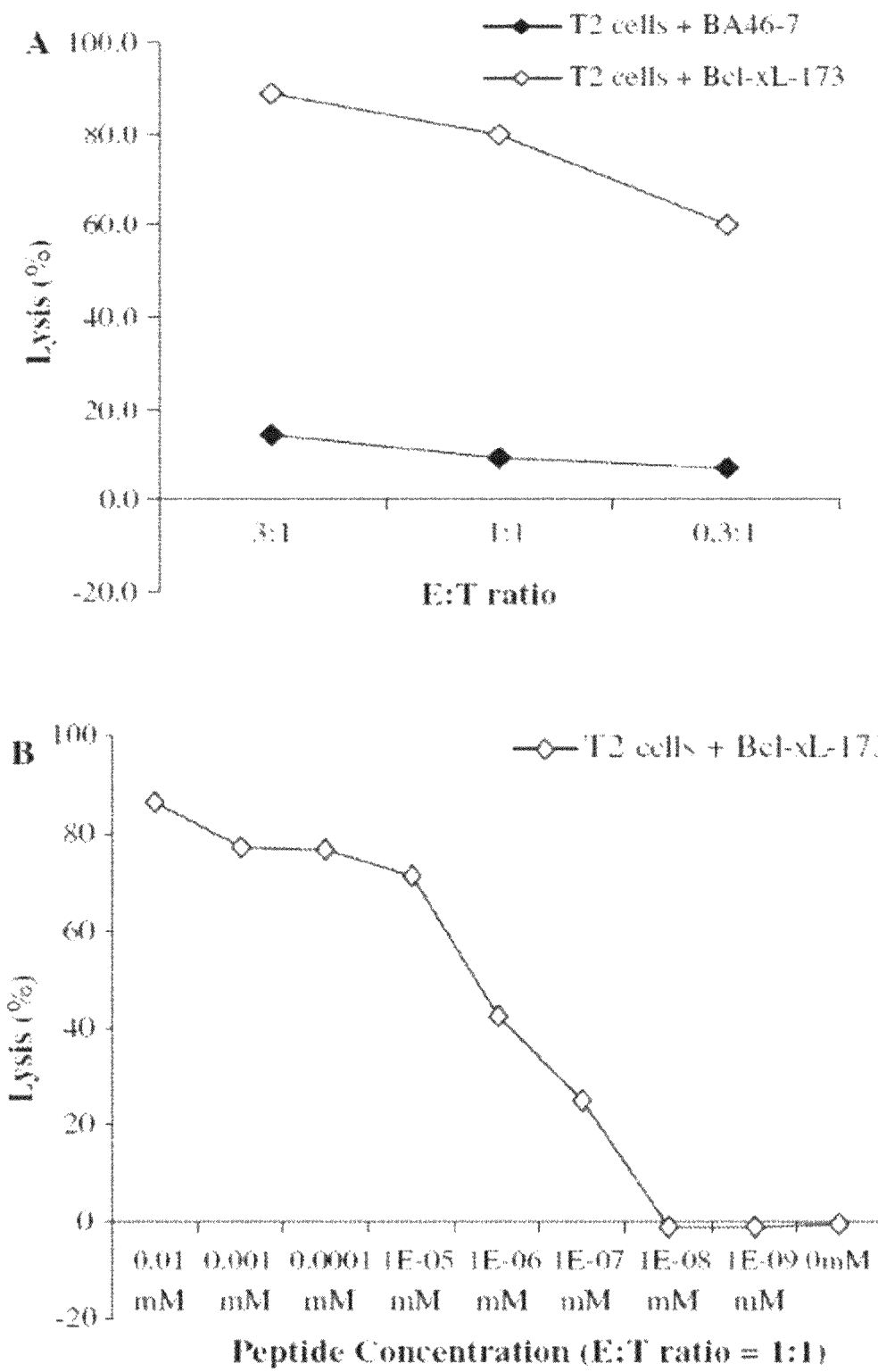

FIG. 18. A Bcl-X(L)173-182 specific clone was tested for its cytotoxic potential in 51Cr-release assays. Two assays were performed a Cell lysis of T2 cells pulsed with Bcl-X(L)173-182 peptide or an irrelevant peptide (BA4697-105, GLQHWVPEL) (SEQ ID NO:61728) in three E:T ratios. b Cell lysis of T2 cells pulsed with different concentrations of Bcl-X(L)173-182 peptide at the E:T ratio 1:1. (Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56 (4) 527-33).

FIG. 19. Detection of *Borrelia* specific T cells using MHC dextramers. Dot plots showing live gated CD3+/CD4− lymphocytes from *Borrelia* patient stained with (A) Negative Control MHC Dextramer (HLA-A*0201(GLAGDVSAV) (SEQ ID NO:61729) or (B) pool of MHC Dextramers containing peptides from *Borrelia* antigen Osp A and Fla B. pool of MHC Dextramers containing peptides from *Borrelia* antigen. 0.05% of the live gated CD3+/CD4− lymphocytes are positive for one or more of the MHC Dextramers in the pool.

FIG. 20. Detection of CMV specific T cells using MHC dextramers Dot plots showing live gated CD3+/CD4− lymphocytes from CMV infected patient stained with (A) Negative Control MHC Dextramers (HLA-A*0201(GLAGDVSAV)) (SEQ ID NO:61729) or (B) MHC Dextramers containing peptides from CMV pp65 antigen (HLA-A*0201 (NLVPMVATV)) (SEQ ID NO:61730).

DETAILED DESCRIPTION OF THE INVENTION

In one aspect, the present invention is directed to novel MHC complexes optionally comprising a multimerization domain preferably comprising a carrier molecule and/or a scaffold.

There is also provided a MHC multimer comprising 2 or more MHC-peptide complexes and a multimerization domain to which the 2 or more MHC-peptide complexes are associated. The MHC multimer can generally be formed by association of the 2 or more MHC-peptide complexes with the multimerization domain to which the 2 or more MHC-peptide complexes are capable of associating.

The multimerization domain can be a scaffold associated with one or more MHC-peptide complexes, or a carrier associated with one or more, preferably more than one, MHC-peptide complex(es), or a carrier associated with a plurality of scaffolds each associated with one or more MHC-peptide complexes, such as 2 MHC-peptide complexes, 3 MHC-peptide complexes, 4 MHC-peptide complexes, 5 MHC-peptide complexes or more than 5 MHC-peptide complexes. Accordingly, multimerization domain collectively refers to each and every of the above. It will be clear from the detailed description of the invention provided herein below when the multimerization domain refers to a scaffold or a carrier or a carrier comprising one or more scaffolds.

Generally, when a multimerization domain comprising a carrier and/or a scaffold is present, the MHC complexes can be associated with this domain either directly or via one or more binding entities. The association can be covalent or non-covalent.

Accordingly, there is provided in one embodiment a MHC complex comprising one or more entities (a-b-P)$_n$, wherein a and b together form a functional MHC protein capable of binding a peptide P, and wherein (a-b-P) is the MHC-peptide complex formed when the peptide P binds to the functional MHC protein, said MHC complex optionally further comprising a multimerization domain comprising a carrier molecule and/or a scaffold. "MHC complex" refers to any MHC complex, including MHC monomers in the form of a single MHC-peptide complex and MHC multimers comprising a multimerization domain to which more than one MHC peptide complex is associated.

When the invention is directed to complexes comprising a MHC multimer, i.e. a plurality of MHC peptide complexes of the general composition (a-b-P)$_n$ associated with a multimerization domain, n is by definition more than 1, i.e. at least 2 or more. Accordingly, the term "MHC multimer" is used herein specifically to indicate that more than one MHC-peptide complex is associated with a multimerization domain, such as a scaffold or carrier or carrier comprising one or more scaffolds. Accordingly, a single MHC-peptide complex can be associated with a scaffold or a carrier or a carrier comprising a scaffold and a MHC-multimer comprising 2 or more MHC-peptide complexes can be formed by association of the individual MHC-peptide complexes with a scaffold or a carrier or a carrier comprising one or more scaffolds each associated with one or more MHC-peptide complexes.

When the MHC complex comprises a multimerization domain to which the n MHC-peptide complexes are associated, the association can be a covalent linkage so that each or at least some of the n MHC-peptide complexes is covalently linked to the multimerization domain, or the association can be a non-covalent association so that each or at least some of the n MHC-peptide complexes are non-covalently associated with the multimerization domain.

The MHC complexes of the invention may be provided in non-soluble or soluble form, depending on the intended application.

Effective methods to produce a variety of MHC complexes comprising highly polymorphic human HLA encoded proteins makes it possible to perform advanced analyses of complex immune responses, which may comprise a variety of peptide epitope specific T-cell clones.

One of the benefits of the MHC complexes of the present invention is that the MHC complexes overcome low intrinsic affinities of monomer ligands and counter receptors. The MHC complexes have a large variety of applications that include targeting of high affinity receptors (e.g. hormone peptide receptors for insulin) on target cells. Taken together poly-ligand binding to target cells has numerous practical, clinical and scientifically uses.

Thus, the present invention provides MHC complexes which present mono-valent or multivalent binding sites for MHC recognising cells, such as MHC complexes optionally comprising a multimerization domain, such as a scaffold or a carrier molecule, which multimerization domain have attached thereto, directly or indirectly via one or more linkers, covalently or non-covalently, one or more MHC peptide complexes. "One or more" as used herein is intended to include one as well as a plurality, such as at least 2. This applies i.a. to the MHC peptide complexes and to the binding entities of the multimerization domain. The scaffold or carrier molecule may thus have attached thereto a MHC peptide complex or a plurality of such MHC peptide complexes, and/or a linker or a plurality of linkers.

Product

Figure 1:
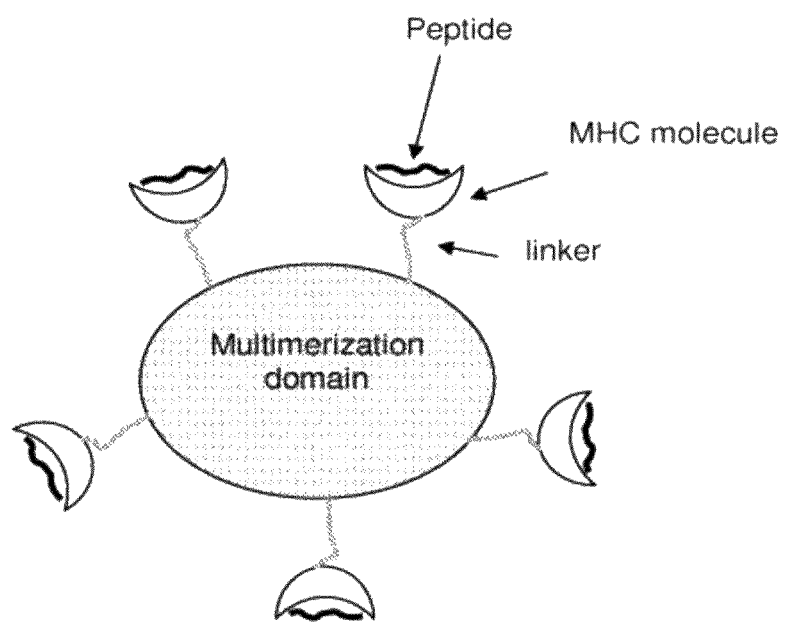
FIG. 1. Schematic representation of MHC multimer. A MHC multimer consist of a multimerization domain whereto one or more MHC-peptide complexes are attached through one or more linkers. The multimerization domain comprise one or more carriers and/or one or more scaffolds. The MHC-peptide complexes comprise a peptide and a MHC molecule.

The product of the present invention is a MHC multimer as described above. As used in the description of this invention, the term "MHC multimers" will be used interchangeably with the terms MHC'mers and MHCmers, and will include any number, (larger than one) of MHC-peptide complexes, held together in a large complex by covalent or non-covalent interactions between a multimerization domain and one or more MHC-peptide complexes, and will also include the monomeric form of the MHC-peptide complex, i.e. a MHC-peptide complex that is not attached to a multimerization domain. The multimerization domain consists of one or more carriers and/or one or more scaffolds while the MHC-peptide complex consists of MHC molecule and antigenic peptide. MHC-peptide complexes may be attached to the multimerization domain through one or more linkers. A schematic representation of a MHC multimer is presented in FIG. 1.

In one preferred embodiment the MHC multimer is between 50,000 Da and 1,000,000 Da, such as from 50,000 Da to 980,000; for example from 50,000 Da to 960,000; such as from 50,000 Da to 940,000; for example from 50,000 Da to 920,000; such as from 50,000 Da to 900,000; for example from 50,000 Da to 880,000; such as from 50,000 Da to 860,000; for example from 50,000 Da to 840,000; such as from 50,000 Da to 820,000; for example from 50,000 Da to 800,000; such as from 50,000 Da to 780,000; for example from 50,000 Da to 760,000; such as from 50,000 Da to 740,000; for example from 50,000 Da to 720,000; such as from 50,000 Da to 700,000; for example from 50,000 Da to 680,000; such as from 50,000 Da to 660,000; for example from 50,000 Da to 640,000; such as from 50,000 Da to 620,000; for example from 50,000 Da to 600,000; such as from 50,000 Da to 580,000; for example from 50,000 Da to 560,000; such as from 50,000 Da to 540,000; for example from 50,000 Da to 520,000; such as from 50,000 Da to 500,000; for example from 50,000 Da to 480,000; such as from 50,000 Da to 460,000; for example from 50,000 Da to 440,000; such as from 50,000 Da to 420,000; for example from 50,000 Da to 400,000; such as from 50,000 Da to 380,000; for example from 50,000 Da to 360,000; such as from 50,000 Da to 340,000; for example from 50,000 Da to 320,000; such as from 50,000 Da to 300,000; for example from 50,000 Da to 280,000; such as from 50,000 Da to 260,000; for example from 50,000 Da to 240,000; such as from 50,000 Da to 220,000; for example from 50,000 Da to 200,000; such as from 50,000 Da to 180,000; for example from 50,000 Da to 160,000; such as from 50,000 Da to 140,000; for example from 50,000 Da to 120,000; such as from 50,000 Da to 100,000; for example from 50,000 Da to 80,000; such as from 50,000 Da to 60,000; such as from 100,000 Da to 980,000; for example from 100,000 Da to 960,000; such as from 100,000 Da to 940,000; for example from 100,000 Da to 920,000; such as from 100,000 Da to 900,000; for example from 100,000 Da to 880,000; such as from 100,000 Da to 860,000; for example from 100,000 Da to 840,000; such as from 100,000 Da to 820,000; for example from 100,000 Da to 800,000; such as from 100,000 Da to 780,000; for example from 100,000 Da to 760,000; such as from 100,000 Da to 740,000; for example from 100,000 Da to 720,000; such as from 100,000 Da to 700,000; for example from 100,000 Da to 680,000; such as from 100,000 Da to 660,000; for example from 100,000 Da to 640,000; such as from 100,000 Da to 620,000; for example from 100,000 Da to 600,000; such as from 100,000 Da to 580,000; for example from 100,000 Da to 560,000; such as from 100,000 Da to 540,000; for example from 100,000 Da to 520,000; such as from 100,000 Da to 500,000; for example from 100,000 Da to 480,000; such as from 100,000 Da to 460,000; for example from 100,000 Da to 440,000; such as from 100,000 Da to 420,000; for example from 100,000 Da to 400,000; such as from 100,000 Da to 380,000; for example from 100,000 Da to 360,000; such as from 100,000 Da to 340,000; for example from 100,000 Da to 320,000; such as from 100,000 Da to 300,000; for example from 100,000 Da to 280,000; such as from 100,000 Da to 260,000; for example from 100,000 Da to 240,000; such as from 100,000 Da to 220,000; for example from 100,000 Da to 200,000; such as from 100,000 Da to 180,000; for example from 100,000 Da to 160,000; such as from 100,000 Da to 140,000; for example from 100,000 Da to 120,000; such as from 150,000 Da to 980,000; for example from 150,000 Da to 960,000; such as from 150,000 Da to 940,000; for example from 150,000 Da to 920,000; such as from 150,000 Da to 900,000; for example from 150,000 Da to 880,000; such as from 150,000 Da to 860,000; for example from 150,000 Da to 840,000; such as from 150,000 Da to 820,000; for example from 150,000 Da to 800,000; such as from 150,000 Da to 780,000; for example from 150,000 Da to 760,000; such as from 150,000 Da to 740,000; for example from 150,000 Da to 720,000; such as from 150,000 Da to 700,000; for example from 150,000 Da to 680,000; such as from 150,000 Da to 660,000; for example from 150,000 Da to 640,000; such as from 150,000 Da to 620,000; for example from 150,000 Da to 600,000; such as from 150,000 Da to 580,000; for example from 150,000 Da to 560,000; such as from 150,000 Da to 540,000; for example from 150,000 Da to 520,000; such as from 150,000 Da to 500,000; for example from 150,000 Da to 480,000; such as from 150,000 Da to 460,000; for example from 150,000 Da to 440,000; such as from 150,000 Da to 420,000; for example from 150,000 Da to 400,000; such as from 150,000 Da to 380,000; for example from 150,000 Da to 360,000; such as from 150,000 Da to 340,000; for example from 150,000 Da to 320,000; such as from 150,000 Da to 300,000; for example from 150,000 Da to 280,000; such as from 150,000 Da to 260,000; for example from 150,000 Da to 240,000; such as from 150,000 Da to 220,000; for example from 150,000 Da to 200,000; such as from 150,000 Da to 180,000; for example from 150,000 Da to 160,000.

In another preferred embodiment the MHC multimer is between 1,000,000 Da and 3,000,000 Da, such as from 1,000,000 Da to 2,800,000; for example from 1,000,000 Da to 2,600,000; such as from 1,000,000 Da to 2,400,000; for example from 1,000,000 Da to 2,200,000; such as from 1,000,000 Da to 2,000,000; for example from 1,000,000 Da to 1,800,000; such as from 1,000,000 Da to 1,600,000; for example from 1,000,000 Da to 1,400,000.

In the following it is described how to generate the product of the present invention.

Number of MHC Complexes pr Multimer

A non-exhaustive list of possible MHC mono- and multimers illustrates the possibilities.

n indicates the number of MHC complexes comprised in the multimer:

a) n=1, Monomers
b) n=2, Dimers, multimerization can be based on IgG scaffold, SA with two MHC's, coiled-coil dimerization e.g. Fos.Jun dimerization
c) n=3, Trimers, multimerization can be based on SA as scaffold with three MHC's, TNFalpha-MHC hybrids, triplex DNA-MHC conjugates or other trimer structures
d) n=4, Tetramers, multimerization can be based on SA with all four binding sites occupied by MHC molecules or on dimeric IgA
e) n=5, Pentamers, multimerization can take place around a pentameric coil-coil structure
f) n=6, Hexamers
g) n=7, Heptamers
h) n=8-12, Octa-dodecamers, multimerization can take place using Streptactin
i) n=10, Decamers, multimerization could take place using IgM
j) 1<n<100, Dextramers, as multimerization domain polymers such as polypeptide, polysaccharides and Dextrans can be used.
k) 1<n<1000, Multimerization make use of DC, APC, micelles, liposomes, beads, surfaces e.g. microtiterplate, tubes, microarray devices, micro-fluidic systems
l) 1<n, n in billions or trillions or higher, multimerization take place on beads, and surfaces e.g. microtiterplate, tubes, microarray devices, micro-fluidic systems MHC Origin Any of the three components of a MHC complex can be of any of the below mentioned origins. The list is non-exhaustive. A complete list would encompass all Chordate species. By origin is meant that the sequence is identical or highly homologous to a naturally occurring sequence of the specific species.

List of Origins:
   Human
   Mouse
   Primate
      Chimpansee
      Gorilla
      Orang Utan Monkey
  Macaques
Porcine (Swine/Pig)
Bovine (Cattle/Antilopes)
Equine (Horse)
Camelides (Camels)
Ruminants (Deears)
Canine (Dog)
Feline (Cat)
Bird
  Chicken
  Turkey
Fish
Reptiles
Amphibians Generation of MHC Multimers Different approaches to the generation of various types of MHC multimers are described in U.S. Pat. No. 5,635,363 (Altmann et al.), patent application WO 02/072631 A2 (Winther et al.), patent application WO 99/42597, US patent 2004209295, U.S. Pat. No. 5,635,363, and is described elsewhere in the present patent application as well. In brief, MHC multimers can be generated by first expressing and purifying the individual protein components of the MHC protein, and then combining the MHC protein components and the peptide, to form the MHC-peptide complex. Then an appropriate number of MHC-peptide complexes are linked together by covalent or non-covalent bonds to a multimerization domain. This can be done by chemical reactions between reactive groups of the multimerization domain (e.g. vinyl sulfone functionalities on a dextran polymer) and reactive groups on the MHC protein (e.g. amino groups on the protein surface), or by non-covalent interaction between a part of the MHC protein (e.g. a biotinylated peptide component) and the multimerization domain (e.g. four binding sites for biotin on the strepavidin tetrameric protein). As an alternative, the MHC multimer can be formed by the non-covalent association of amino acid helices fused to one component of the MHC protein, to form a pentameric MHC multimer, held together by five helices in a coiled-coil structure making up the multimerization domain.

Appropriate chemical reactions for the covalent coupling of MHC and the multimerization domain include nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions.

Appropriate molecules, capable of providing non covalent interactions between the multimerization domain and the MHC-peptide complex, involve the following molecule pairs and molecules: streptavidin/biotin, avidin/biotin, antibody/antigen, DNA/DNA, DNA/PNA, DNA/RNA, PNA/PNA, LNA/DNA, leucine zipper e.g. Fos/Jun, IgG dimeric protein, IgM multivalent protein, acid/base coiled-coil helices, chelate/metal ion-bound chelate, streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. In particular, when the MHC complex is tagged, the binding entity can be an "anti-tag". By "anti-tag" is meant an antibody binding to the tag and any other molecule capable of binding to such tag.

Generation of Components of MHC

When employing MHC multimers for diagnostic purposes, it is preferable to use a MHC allele that corresponds to the tissue type of the person or animal to be diagnosed. Once the MHC allele has been chosen, a peptide derived from the antigenic protein may be chosen. The choice will depend on factors such as known or expected binding affinity of the MHC protein and the various possible peptide fragments that may be derived from the full sequence of the antigenic peptide, and will depend on the expected or known binding affinity and specificity of the MHC-peptide complex for the TCR. Preferably, the affinity of the peptide for the MHC molecule, and the affinity and specificity of the MHC-peptide complex for the TCR, should be high.

Similar considerations apply to the choice of MHC allele and peptide for therapeutic and vaccine purposes. In addition, for some of these applications the effect of binding the MHC multimer to the TCR is also important. Thus, in these cases the effect on the T-cell's general state must be considered, e.g. it must be decided whether the desired end result is apoptosis or proliferation of the T-cell.

Likewise, it must be decided whether stability is important. For some applications low stability may be an advantage, e.g. when a short-term effect is desired; in other instances, a long-term effect is desired and MHC multimers of high stability is desired. Stabilities of the MHC protein and of the MHC-peptide complex may be modified as described elsewhere herein.

Finally, modifications to the protein structure may be advantageous for some diagnostics purposes, because of e.g. increased stability, while in for vaccine purposes modifications to the MHC protein structure may induce undesired allergenic responses.

Generation of Protein Chains of MHC

Generation of MHC Class I Heavy Chain and β2-Microglobulin

MHC class I heavy chain (HC) and β2-mircroglobulin (β2m) can be obtained from a variety of sources.

a) Natural sources by means of purification from eukaryotic cells naturally expressing the MHC class 1 or β2m molecules in question.
b) The molecules can be obtained by recombinant means e.g. using.
   a. in vitro translation of mRNA obtained from cells naturally expressing the MHC or β2m molecules in question
   b. by expression and purification of HC and/or β2m gene transfected cells of mammalian, yeast, bacterial or other origin. This last method will normally be the method of choice. The genetic material used for transfection/transformation can be:

i. of natural origin isolated from cells, tissue or organisms
ii. of synthetical origin i.e. synthetic genes identical to the natural DNA sequence or it could be modified to introduce molecular changes or to ease recombinant expression.

The genetic material can encode all or only a fragment of β2m, all or only a fragment of MHC class 1 heavy chain. Of special interest are MHC class 1 heavy chain fragments consisting of, the complete chain minus the intramembrane domain, a chain consisting of only the extracellular α1 and α2 class 1 heavy chain domains, or any of the mentioned β2m and heavy chain fragments containing modified or added designer domain(s) or sequence(s).

Generation of MHC Class 2 α- and β-Chains

MHC class 2 α- and β-chains can be obtained from a variety of sources:

a) Natural sources by means of purification from eukaryotic cells naturally expressing the MHC class 2 molecules in question.
b) By recombinant means e.g. using:
  a. in vitro translation of mRNA obtained from cells naturally expressing the MHC class 2 molecules in question
  b. By purification from MHC class 2 gene transfected cells of mammalian, yeast, bacterial or other origin. This last method will normally be the method of choice. The genetic material used for transfection/transformation can be
    i. of natural origin isolated from cells, tissue or organisms
    ii. of synthetical origin i.e. synthetic genes identical to the natural DNA sequence or it could be modified to introduce molecular changes or to ease recombinant expression.

The genetic material can encode all or only a fragment of MHC class 2 α- and β-chains. Of special interest are MHC class 2 α- and β-chain fragments consisting of, the complete α- and β-chains minus the intramembrane domains of either or both chains; and α- and β-chains consisting of only the extracellular domains of either or both, i.e α1 plus α2 and β1 plus β2 domains, respectively.

The genetic material can be modified to encode the interesting MHC class 2 molecule fragments consisting of domains starting from the amino terminal in consecutive order, MHC class 2 β1 plus MHC class 2 α1 plus MHC class 1 α3 domains or in alternative order, MHC class 2 α1 plus MHC class 2 β1 plus MHC class 1 α3 domains.

Lastly, the genetic material can encode any of the above mentioned MHC class 2 α- and β-chain molecules or fragments containing modified or added designer domain(s) or sequence(s).

c) The MHC material may also be of exclusively synthetic origin manufactured by solid phase protein synthesis. Any of the above mentioned molecules can be made this way.

Modified MHC I or MHC II Complexes

MHC I and MHC II complexes modified in any way as described above, can bind TCR. Modifications include mutations (substitutions, deletions or insertions of natural or non-natural amino acids, or any other organic molecule. The mutations are not limited to those that increase the stability of the MHC complex, and could be introduced anywhere in the MHC complex. One example of special interest is mutations introduced in the α3 subunit of MHC I heavy chain. The α3-subunit interacts with CD8 molecules on the surface of T cells. To minimize binding of MHC multimer to CD8 molecules on the surface of non-specific T cells, amino acids in α3 domain involved in the interaction with CD8 can be mutated. Such a mutation can result in altered or abrogated binding of MHC to CD8 molecules. Another example of special interest is mutations in areas of the β2-domain of MHC II molecules responsible for binding CD4 molecules.

Another embodiment is chemically modified MHC complexes where the chemical modification could be introduced anywhere in the complex, e.g. a MHC complex where the peptide in the peptide-binding cleft has a dinitrophenyl group attached.

Modified MHC complexes could also be MHC I or MHC II fusion proteins where the fusion protein is not necessarily more stable than the native protein. Of special interest is MHC complexes fused with genes encoding an amino acid sequence capable of being biotinylated with a Bir A enzyme (Schatz, P. J., (1993), Biotechnology 11(10):1138-1143). This biotinylation sequence could be fused with the COOH-terminal of β2m or the heavy chain of MHC I molecules or the COOH-terminal of either the α-chain or β-chain of MHC II. Similarly, other sequences capable of being enzymatically or chemically modified, can be fused to the $NH_2$ or COOH-terminal ends of the MHC complex.

Stabilization of Empty MHC Complexes and MHC-Peptide Complexes.

Classical MHC complexes are in nature embedded in the membrane. A preferred embodiment includes multimers comprising a soluble form of MHC II or I where the transmembrane and cytosolic domains of the membrane-anchored MHC complexes are removed. The removal of the membrane-anchoring parts of the molecules can influence the stability of the MHC complexes. The stability of MHC complexes is an important parameter when generating and using MHC multimers.

MHC I complexes consist of a single membrane-anchored heavy chain that contains the complete peptide binding groove and is stable in the soluble form when complexed with β2m. The long-term stability is dependent on the binding of peptide in the peptide-binding groove. Without a peptide in the peptide binding groove the heavy chain and β2m tend to dissociate. Similarly, peptides with high affinity for binding in the peptide-binding groove will typically stabilize the soluble form of the MHC complex while peptides with low affinity for the peptide-binding groove will typically have a smaller stabilizing effect.

In contrast, MHC II complexes consist of two membrane-anchored chains of almost equal size. When not attached to the cell membrane the two chains tend to dissociate and are therefore not stable in the soluble form unless a high affinity peptide is bound in the peptide-binding groove or the two chains are held together in another way.

In nature MHC I molecules consist of a heavy chain combined with β2m, and a peptide of typically 8-11 amino acids. Herein, MHC I molecules also include molecules consisting of a heavy chain and β2m (empty MHC), or a heavy chain combined with a peptide or a truncated heavy chain comprising α1 and α2 subunits combined with a peptide, or a full-length or truncated heavy chain combined with a full-length or truncated β2m chain. These MHC I molecules can be produced in *E. coli* as recombinant proteins, purified and refolded in vitro (Garboczi et al., (1992), Proc. Natl. Acad. Sci. 89, 3429-33). Alternatively, insect cell systems or mammalian cell systems can be used. To produce stable MHC I complexes and thereby generate reliable MHC I multimers several strategies can be followed. Stabilization strategies for MHC I complexes are described in the following.

Stabilization Strategies for MHC I Complexes
  Generation of Covalent Protein-Fusions.
    MHC I molecules can be stabilized by introduction of one or more linkers between the individual components of the MHC I complex. This could be a complex consisting of a heavy chain fused with β2m through a linker and a soluble peptide, a heavy chain fused to β2m through a linker, a heavy chain/β2m dimer covalently linked to a peptide through a linker to either heavy chain or β2m, and where there can or can not be a linker between the heavy chain and β2m, a heavy chain fused to a peptide through a linker, or the α1 and α2 subunits of the heavy chain fused to a peptide through a linker. In all of these example protein-fusions, each of the heavy chain, β2m and the peptide can be truncated.
    The linker could be a flexible linker, e.g. made of glycine and serine and e.g. between 5-20 residues long. The linker could also be rigid with a defined structure, e.g. made of amino acids like glutamate, alanine, lysine, and leucine creating e.g. a more rigid structure.
    In heavy chain-β2m fusion proteins the COOH terminus of β2m can be covalently linked to the NH$_2$ terminus of the heavy chain, or the NH$_2$ terminus of β2m can be linked to the COOH terminus of the heavy chain. The fusion-protein can also comprise a β2m domain, or a truncated β2m domain, inserted into the heavy chain, to form a fusion-protein of the form "heavy chain (first part)-β2m-heavy chain (last part)".
    Likewise, the fusion-protein can comprise a heavy chain domain, or a truncated heavy chain, inserted into the β2m chain, to form a fusion-protein of the form "β2m (first part)-heavy chain-β2m(last part)".
    In peptide-β2m fusion proteins the COOH terminus of the peptide is preferable linked to the NH$_2$ terminus of β2m but the peptide can also be linked to the COOH terminal of β2m via its NH$_2$ terminus. In heavy chain-peptide fusion proteins it is preferred to fuse the NH$_2$ terminus of the heavy chain to the COOH terminus of the peptide, but the fusion can also be between the COOH terminus of the heavy chain and the NH$_2$ terminus of the peptide. In heavy chain-β2m-peptide fusion proteins the NH$_2$ terminus of the heavy chain can be fused to the COOH terminus of β2m and the NH$_2$ terminus of β2m can be fused to the COOH terminus of the peptide.
  Non-Covalent Stabilization by Binding to an Unnatural Component
    Non-covalent binding of unnatural components to the MHC I complexes can lead to increased stability. The unnatural component can bind to both the heavy chain and the β2m, and in this way promote the assemble of the complex, and/or stabilize the formed complex. Alternatively, the unnatural component can bind to either β2m or heavy chain, and in this way stabilize the polypeptide in its correct conformation, and in this way increase the affinity of the heavy chain for β2m and/or peptide, or increase the affinity of β2m for peptide.
    Here, unnatural components mean antibodies, peptides, aptamers or any other molecule with the ability to bind peptides stretches of the MHC complex. Antibody is here to be understood as truncated or full-length antibodies (of isotype IgG, IgM, IgA, IgE), Fab, scFv or bi-Fab fragments or diabodies.
    An example of special interest is an antibody binding the MHC I molecule by interaction with the heavy chain as well as β2m. The antibody can be a bispecific antibody that binds with one arm to the heavy chain and the other arm to the β2m of the MHC complex. Alternatively the antibody can be monospecific, and bind at the interface between heavy chain and β2m.
    Another example of special interest is an antibody binding the heavy chain but only when the heavy chain is correct folded. Correct folded is here a conformation where the MHC complex is able to bind and present peptide in such a way that a restricted T cell can recognize the MHC-peptide complex and be activated. This type of antibody can be an antibody like the one produced by the clone W6/32 (M0736 from Dako, Denmark) that recognizes a conformational epitope on intact human and some monkey MHC complexes containing β2m, heavy chain and peptide.
  Generation of Modified Proteins or Protein Components
    One way to improve stability of a MHC I complex am to increase the affinity of the binding peptide for the MHC complex. This can be done by mutation/substitution of amino acids at relevant positions in the peptide, by chemical modifications of amino acids at relevant positions in the peptide or introduction by synthesis of non-natural amino acids at relevant positions in the peptide. Alternatively, mutations, chemical modifications, insertion of natural or non-natural amino acids or deletions could be introduced in the peptide binding cleft, i.e. in the binding pockets that accommodate peptide side chains responsible for anchoring the peptide to the peptide binding cleft. Moreover, reactive groups can be introduced into the antigenic peptide; before, during or upon binding of the peptide, the reactive groups can react with amino acid residues of the peptide binding cleft, thus covalently linking the peptide to the binding pocket.
    Mutations/substitutions, chemical modifications, insertion of natural or non-natural amino acids or deletions could also be introduced in the heavy chain and/or β2m at positions outside the peptide-binding cleft. By example, it has been shown that substitution of XX with YY in position nn of human β$_2$m enhance the biochemical stability of MHC Class I molecule complexes and thus may lead to more efficient antigen presentation of subdominant peptide epitopes.
    A preferred embodiment is removal of "unwanted cysteine residues" in the heavy chain by mutation, chemical modification, amino acid exchange or deletion. "Unwanted cysteine residues" is here to be understood as cysteines not involved in the correct folding of the final MHC I molecule. The presence of cysteine not directly involved in the formation of correctly folded MHC I molecules can lead to formation of intra molecular disulfide bridges resulting in a non correct folded MHC complex during in vitro refolding.
    Another method for covalent stabilization of MHC I complex am to covalently attach a linker between two of the subunits of the MHC complex. This can be a linker between peptide and heavy chain or between heavy chain and beta2microglobulin.
Stabilization with Soluble Additives.
  The stability of proteins in aqueous solution depends on the composition of the solution. Addition of salts, detergents organic solvent, polymers etc. can influence the stability. Of special interest are additives that increase surface tension of the MHC molecule without binding the molecule. Examples are sucrose, mannose, glycine, betaine, alanine, glutamine, glutamic acid and ammoniumsulfate. Glycerol, mannitol and sorbitol are also included in this group even though they are able to bind polar regions.

Another group of additives of special interest are able to increase surface tension of the MHC molecule and simultaneously interact with charged groups in the protein. Examples are $MgSO_4$, NaCl, polyethylenglycol, 2-methyl-2,4-pentandiol and guanidiniumsulfate.

Correct folding of MHC I complexes is very dependent on binding of peptide in the peptide-binding cleft and the peptide binding stabilises correct conformation. Addition of molar excess of peptide will force the equilibrium against correct folded MHC-peptide complexes. Likewise is excess β2m also expected to drive the folding process in direction of correct folded MHC I complexes. Therefore peptide identical to the peptide bound in the peptide-binding cleft and β2m are included as stabilizing soluble additives.

Other additives of special interest for stabilization of MHC I molecules are BSA, fetal and bovine calf serum or individual protein components in serum with a protein stabilizing effect.

All of the above mentioned soluble additives could be added to any solution containing MHC I molecules in order to increase the stability of the molecule. That could be during the refolding process, to the soluble monomer or to a solutions containing MHC I bound to a carrier.

MHC II molecules as used herein are defined as classical MHC II molecule consisting of a α-chain and a β-chain combined with a peptide. It could also be a molecule only consisting of α-chain and β-chain (α/β dimer or empty MHC II), a truncated α-chain (e.g. α1 domain alone) combined with full-length β-chain either empty or loaded with a peptide, a truncated β-chain (e.g. β1 domain alone) combined with a full-length α-chain either empty or loaded with a peptide or a truncated α-chain combined with a truncated β-chain (e.g. α1 and β1 domain) either empty or loaded with a peptide.

In contrast to MHC I molecules MHC II molecules are not easily refolded in vitro. Only some MHC II alleles may be produced in *E. coli* followed by refolding in vitro.

Therefore preferred expression systems for production of MHC II molecules are eukaryotic systems where refolding after expression of protein is not necessary. Such expression systems could be stable *Drosophila* cell transfectants, baculovirus infected insect cells, CHO cells or other mammalian cell lines suitable for expression of proteins.

Stabilization of soluble MHC II molecules is even more important than for MHC I molecules since both α- and β-chain are participants in formation of the peptide binding groove and tend to dissociate when not embedded in the cell membrane.

Stabilization Strategies for MHC II Complexes
  Generation of Covalent Protein-Fusions.
    MHC II complexes can be stabilized by introduction of one or more linkers between the individual components of the MHC II complex. This can be a α/β dimer with a linker between α-chain and β-chain; a α/β dimer covalently linked to the peptide via a linker to either the α-chain or β-chain; a α/β dimer, covalently linked by a linker between the α-chain and β-chain, and where the dimer is covalently linked to the peptide; a α/β dimer with a linker between α-chain and β-chain, where the dimer is combined with a peptide covalently linked to either α-chain or β-chain.

The linker can be a flexible linker, e.g. made of glycine and serine, and is typically between 5-20 residues long, but can be shorter or longer. The linker can also be more rigid with a more defined structure, e.g. made of amino acids like glutamate, alanine, lysine, and leucine.

The peptides can be linked to the $NH_2$- or COOH-terminus of either α-chain or β-chain. Of special interest are peptides linked to the $NH_2$-terminus of the β-chain via their COOH-terminus, since the linker required is shorter than if the peptide is linked to the COOH-terminus of the β-chain.

Linkage of α-chain to β-chain can be via the COOH-terminus of the β-chain to the $NH_2$-terminus of the α-chain or from the COOH-terminus of the α-chain to the $NH_2$-terminus of the β-chain.

In a three-molecule fusion protein consisting of α-chain, β-chain and peptide a preferred construct is where one linker connect the COOH-terminus of the β-chain with the $NH_2$-terminus of the α-chain and another linker connects the COOH-terminal of the peptide with the $NH_2$-terminal of the β-chain. Alternatively one linker joins the COOH-terminus of the α-chain with the $NH_2$-terminus of the β-chain and the second linker joins the $NH_2$-terminus of the peptide with the COOH-terminus of the β-chain. The three peptides of the MHC complex can further be linked as described above for the three peptides of the MHC complex, including internal fusion points for the proteins.

Non-Covalent Stabilization by Binding Ligand.
Non-covalent binding of ligands to the MHC II complex can promote assembly of α- and β-chain by bridging the two chains, or by binding to either of the α- or β-chains, and in this way stabilize the conformation of α or β, that binds β or α, respectively, and/or that binds the peptide. Ligands here mean antibodies, peptides, aptamers or any other molecules with the ability to bind proteins.

A particular interesting example is an antibody binding the MHC complex distal to the interaction site with TCR, i.e. distal to the peptide-binding cleft. An antibody in this example can be any truncated or full length antibody of any isotype (e.g. IgG, IgM, IgA or IgE), a bi-Fab fragment or a diabody. The antibody could be bispecific with one arm binding to the α-chain and the other arm binding to the β-chain. Alternatively the antibody could be monospecific and directed to a sequence fused to the α-chain as well as to the β-chain.

Another example of interest is an antibody binding more central in the MHC II molecule, but still interacting with both α- and β-chain. Preferable the antibody binds a conformational epitope, thereby forcing the MHC molecule into a correct folded configuration. The antibody can be bispecific binding with one arm to the α-chain and the other arm to the β-chain. Alternatively the antibody is monospecific and binds to a surface of the complex that involves both the α- and β-chain, e.g. both the α2- and β2-domain or both the α1- and β1-domain.

The antibodies described above can be substituted with any other ligand that binds at the α-/β-chain interface, e.g. peptides and aptamers. The ligand can also bind the peptide, although, in this case it is important that the ligand does not interfere with the interaction of the peptide or binding cleft with the TCR.

Non-Covalent Stabilization by Induced Multimerization.

In nature the anchoring of the α- and β-chains in the cell membrane stabilizes the MHC II complexes considerably. As mentioned above, a similar concept for stabilization of the α/β-dimer was employed by attachment of the MHC II chains to the Fc regions of an antibody, leading to a stable α/β-dimer, where α and β are held together by the tight interactions between two Fc domains of an antibody. Other dimerization domains can be used as well.

In one other example of special interest MHC II molecules are incorporated into artificial membrane spheres like liposomes or lipospheres. MHC II molecules can be incorporated as monomers in the membrane or as dimers like the MHC II-antibody constructs describes above. In addition to stabilization of the MHC II complex an increased avidity is obtained. The stabilization of the dimer will in most cases also stabilize the trimeric MHC-peptide complex.

Induced multimerization can also be achieved by biotinylation of α- as well as β-chain and the two chains brought together by binding to streptavidin. Long flexible linkers such as extended glycine-serine tracts can be used to extend both chains, and the chains can be biotinylated at the end of such extended linkers. Then streptavidin can be used as a scaffold to bring the chains together in the presence of the peptide, while the flexible linkers still allow the chains to orientate properly.

Generation of Modified Proteins or Protein Components

Stability of MHC II complexes can be increased by covalent modifications of the protein. One method is to increase the affinity of the peptide for the MHC complex. This can be done by exchange of the natural amino acids with other natural or non-natural amino acids at relevant positions in the peptide or by chemical modifications of amino acids at relevant positions in the peptide. Alternatively, mutations, chemical modifications, insertion of natural or non-natural amino acids or deletions can be introduced in the peptide-binding cleft.

Mutations, chemical modifications, insertion of natural or non-natural amino acids or deletions can alternatively be introduced in α- and/or β-chain at positions outside the peptide-binding cleft.

In this respect a preferred embodiment is to replace the hydrophobic transmembrane regions of α-chain and β-chain by leucine zipper dimerisation domains (e.g. Fos-Jun leucine zipper; acid-base coiled-coil structure) to promote assembly of α-chain and β-chain.

Another preferred embodiment is to introduce one or more cysteine residues by amino acid exchange at the COOH-terminal of both α-chain and β-chain, to create disulfide bridges between the two chains upon assembly of the MHC complex.

Another embodiment is removal of "unwanted cysteine residues" in either of the chains by mutation, chemical modification, amino acid exchange or deletion. "Unwanted cysteine residues" is here to be understood as cysteines not involved in correct folding of the MHC II-peptide complex. The presence of cysteines not directly involved in the formation of correctly folded MHC II complexes can lead to formation of intra molecular disulfide bridges and incorrectly folded MHC complexes.

MHC II complexes can also be stabilized by chemically linking together the subunits and the peptide. That can be a linker between peptide and α-chain, between peptide and β-chain, between α-chain and β-chain, and combination thereof.

Such linkages can be introduced prior to folding by linking two of the complex constituents together, then folding this covalent hetero-dimer in the presence of the third constituent. An advantage of this method is that it only requires complex formation between two, rather than three species.

Another possibility is to allow all three constituents to fold, and then to introduce covalent cross-links on the folded MHC-complex, stabilizing the structure. An advantage of this method is that the two chains and the peptide will be correctly positioned relatively to each other when the cross linkages are introduced.

Stabilization with Soluble Additives.

Salts, detergents, organic solvent, polymers and any other soluble additives can be added to increase the stability of MHC complexes. Of special interest are additives that increase surface tension of the MHC complex. Examples are sucrose, mannose, glycine, betaine, alanine, glutamine, glutamic acid and ammonium sulfate. Glycerol, mannitol and sorbitol are also included in this group even though they are able to bind polar regions.

Another group of additives of special interest increases surface tension of the MHC complex and simultaneously can interact with charged groups in the protein. Examples are $MgSO_4$, NaCl, polyethylenglycol, 2-methyl-2,4-pentanediol and guanidiniumsulphate.

Correct formation of MHC complexes is dependent on binding of peptide in the peptide-binding cleft; the bound peptide appears to stabilize the complex in its correct conformation. Addition of molar excess of peptide will force the equilibrium towards correctly folded MHC-peptide complexes. Likewise, excess β2m is also expected to drive the folding process in direction of correctly folded MHC complexes. Therefore peptide identical to the peptide bound in the peptide-binding cleft and β2m can be included as stabilizing soluble additives.

Other additives of special interest for stabilization of MHC complexes are BSA, fetal and bovine calf serum, and other protein components in serum with a protein stabilizing effect.

All of the above mentioned soluble additives could be added to any solution containing MHC complexes in order to increase the stability of the molecule. This can be during the refolding process, to the formed MHC complex or to a solution of MHC multimers comprising several MHC complexes That could be to the soluble monomer, to a solution containing MHC II bound to a carrier or to solutions used during analysis of MHC II specific T cells with MHC II multimers.

Other additives of special interest for stabilization of MHC II molecules are BSA, fetal and bovine calf serum or individual protein components in serum with a protein stabilizing effect.

All of the above mentioned soluble additives could be added to any solution containing MHC II molecules in order to increase the stability of the molecule. That could be to the soluble monomer, to a solution containing MHC II bound to a carrier or to solutions used during analysis of MHC II specific T cells with MHC II multimers.

Chemically Modified MHC I and II Complexes

There are a number of amino acids that are particularly reactive towards chemical cross linkers. In the following, chemical reactions are described that are particularly preferable for the cross-linking or modification of MHC I or MHC II complexes.

The amino group at the N-terminal of both chains and of the peptide, as well as amino groups of lysine side chains, are nucleophilic and can be used in a number of chemical reactions, including nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions. Example reagents that can be used in a reaction with the amino groups are activated carboxylic acids such as NHS-ester, tetra and pentafluoro phenolic esters, anhydrides, acid chlorides and fluorides, to form stable amide bonds. Likewise, sulphonyl chlorides can react with these amino groups to form stable sulphoneamides. Iso-Cyanates can also react with amino groups to form stable ureas, and isothiocyanates can be used to introduce thio-urea linkages.

Aldehydes, such as formaldehyde and glutardialdehyde will react with amino groups to form shiff's bases, than can be further reduced to secondary amines.

The guanidino group on the side chain of arginine will undergo similar reactions with the same type of reagents.

Another very useful amino acid is cysteine. The thiol on the side chain is readily alkylated by maleimides, vinyl sulphones and halides to form stable thioethers, and reaction with other thiols will give rise to disulphides.

Carboxylic acids at the C-terminal of both chains and peptide, as well as on the side chains of glutamic and aspartic acid, can also be used to introduce cross-links. They will require activation with reagents such as carbodiimides, and can then react with amino groups to give stable amides.

Thus, a large number of chemistries can be employed to form covalent cross-links. The crucial point is that the chemical reagents are bi-functional, being capable of reacting with two amino acid residues.

They can be either homo bi-functional, possessing two identical reactive moieties, such as glutardialdehyde or can be hetero bi-functional with two different reactive moieties, such as GMBS (MaleimidoButyryloxy-Succinimide ester).

Alternatively, two or more reagents can be used; i.e. GMBS can be used to introduce maleimides on the α-chain, and iminothiolane can be used to introduce thiols on the β-chain; the malemide and thiol can then form a thioether link between the two chains. For the present invention some types of cross-links are particularly useful. The folded MHC-complex can be reacted with dextrans possessing a large number (up to many hundreds) of vinyl sulphones. These can react with lysine residues on both the α and β chains as well as with lysine residues on the peptide protruding from the binding site, effectively cross linking the entire MHC-complex. Such cross linking is indeed a favored reaction because as the first lysine residue reacts with the dextran, the MHC-complex becomes anchored to the dextran favoring further reactions between the MHC complex and the dextran multimerization domain. Another great advantage of this dextran chemistry is that it can be combined with fluorochrome labelling; i.e. the dextran is reacted both with one or several MHC-complexes and one or more fluorescent protein such as APC.

Another valuable approach is to combine the molecular biological tools described above with chemical cross linkers. As an example, one or more lysine residues can be inserted into the α-chain, juxtaposed with glutamic acids in the β-chain, where after the introduced amino groups and carboxylic acids are reacted by addition of carbodiimide. Such reactions are usually not very effective in water, unless as in this case, the groups are well positioned towards reaction. This implies that one avoids excessive reactions that could otherwise end up denaturing or changing the conformation of the MHC-complex.

Likewise a dextran multimerization domain can be cross-linked with appropriately modified MHC-complexes; i.e. one or both chains of the MHC complex can be enriched with lysine residues, increasing reactivity towards the vinylsulphone dextran. The lysine's can be inserted at positions opposite the peptide binding cleft, orienting the MHC-complexes favorably for T-cell recognition.

Another valuable chemical tool is to use extended and flexible cross-linkers. An extended linker will allow the two chains to interact with little or no strain resulting from the linker that connects them, while keeping the chains in the vicinity of each other should the complex dissociate. An excess of peptide should further favor reformation of dissociated MHC-complex.

Other TCR Binding Molecules

MHC I and MHC II complexes bind to TCRs. However, other molecules also bind TCR. Some TCR-biding molecules are described in the following. MHC I and MHC II complexes binding to TCRs may be substituted with other molecules capable of binding TCR or molecules that have homology to the classical MHC molecules and therefore potentially could be TCR binding molecules. These other TCR binding or MHC like molecules include:

Non-Classical MHC Complexes and Other MHC-Like Molecules:

Non-classical MHC complexes include protein products of MHC Ib and MHC IIb genes. MHC Ib genes encode β2m-associated cell-surface molecules but show little polymorphism in contrast to classical MHC class I genes. Protein products of MHC class Ib genes include HLA-E, HLA-G, HLA-F, HLA-H, MIC A, MIC B, ULBP-1, ULBP-2, ULBP-3 in humans and H2-M, H2-Q, H2-T and Rae1 in mice.

Non-classical MHC II molecules (protein products of MHC IIb genes) include HLA-DM, HLA-DO in humans and H2-DM and H2-DO in mice that are involved in regulation of peptide loading into MHC II molecules.

Another MHC-like molecule of special interest is the MHC I-like molecule CD1. CD1 is similar to MHC I molecules in its organization of subunits and association with β2m but presents glycolipids and lipids instead of peptides.

Artificial Molecules Capable of Binding Specific TCRs

Of special interest are antibodies that bind TCRs. Antibodies herein include full length antibodies of isotype IgG, IgM, IgE, IgA and truncated versions of these, antibody fragments like Fab fragments and scFv. Antibodies also include antibodies of antibody fragments displayed on various supramolecular structures or solid supports, including filamentous phages, yeast, mammalian cells, fungi, artificial cells or micelles, and beads with various surface chemistries.

Peptide Binding TCR

Another embodiment of special interest is peptides that bind TCRs. Peptides herein include peptides composed of natural, non-natural and/or chemically modified amino acids with a length of 8-20 amino acid. The peptides could also be longer than 20 amino acids or shorter than 8 amino acids. The peptides can or can not have a defined tertiary structure.

Aptamers

Aptamers are another preferred group of TCR ligands. Aptamers are herein understood as natural nucleic acids (e.g. RNA and DNA) or unnatural nucleic acids (e.g. PNA, LNA, morpholinos) capable of binding TCR. The aptamer molecules consist of natural or modified nucleotides in various lengths.

Other TCR-binding molecules can be ankyrin repeat proteins or other repeat proteins, Avimers, or small chemical molecules, as long as they are capable of binding TCR with a dissociation constant smaller than $10^{-3}$ M.

Generation of Antigenic Peptide

Approaches and Methods for the Identification and Design of Appropriate Peptides MHC class 1 molecules normally binds octa-, nona-, deca- or ondecamer (8-, 9-, 10, -11-mer) peptides in their peptide binding groove. The individual MHC class 1 alleles have individual preferences for the peptide length within the given range. MHC class 2 molecules bind peptides most often with a total length of 13-18 amino acids around a 9-mer core motif containing the important amino acid anchor residues. However the total length is not strictly defined as for most MHC class 1 molecules.

For some of the MHC alleles the optimal peptide length is known and also the demands for specific amino acid residues in the so called anchor positions.

To identify binding peptides derived from a specific protein for a given MHC allele it is necessary to systematically work through the amino acid sequence of the protein to identify the putative binding peptides. Although a given peptide is a binder it is not necessarily a functional T-cell epitope. Functionality needs to be confirmed by a functional analysis e.g. ELISPOT, CTL killing assay or flow cytometry assay.

A measure for binding affinity of the peptide to the MHC molecules can for some MHC molecules be found in databases such as www.syfpeithi.de; www-bimas.cit.nih.gov/molbio/hla_bind/; www.cbs.dtu.dk/services/NetMHC/; www.cbs.dtu.dk/services/NetMHCII/.

Design of Binding Peptides a) From Genomic DNA Sequences without Introns

When only the genomic DNA sequences are known and thereby reading frame and direction of transcription of the genes are unknown, the DNA sequence needs to be translated in all three reading frames in both directions leading to a total of six amino acid sequences for a given genome. From these amino acid sequences binding peptides can then be identified.

b) From Genomic DNA Sequences with Introns

In organisms having intron/exon gene structure the present approach will not be able to identify peptide sequence motifs that are derived by combination of amino acid sequences derived partly from two separate introns.

c) From cDNA Sequences cDNA sequences can be translated into the actual amino acid sequences to allow peptide identification.

d) From Known Amino Acid Sequences

In the case of known protein sequences these can directly be applied to software analysis for prediction of peptide epitopes.

Binding peptide sequences can be predicted from any protein sequence by either a total approach generating binding peptide sequences for potentially any MHC allele or by a directed approach using software that specifically can predict the binding peptide sequences for a subset of MHC alleles for which the binding characteristics of the peptide is known.

Design of MHC Class 1 Binding Peptide Sequence a) Total Approach

The MHC class 1 binding peptide prediction is done as follows using the total approach. The actual protein sequence is split up into 8-, 9-, 10-, and 11-mer peptide sequences. This is performed by starting at amino acid position 1 identifying the first 8-mer; then move the start position by one amino acid identifying the second 8-mer; then move the start position by one amino acid, identifying the third 8-mer. This procedure continues by moving start position by one amino acid for each round of peptide identification. Generated peptides will be amino acid position 1-8, 2-9, 3-10 etc. All peptides carrying one or more stop codons are omitted for further consideration. This procedure can be carried out manually or by means of a software program (FIG. 2). This procedure is then repeated in an identical fashion for 9-, 10 and 11-mers, respectively.

b) Directed Approach

Using a directed approach is only possible when working on prediction of peptide sequences binding to MHC class I alleles with known binding preferences. Examples of such programs are www.syfpeithi.de; www.imtech.res.in/raghava/propred1/index.html; www.cbs.dtu.dk/services/NetMHC/. Identified peptides can then be tested for biological relevance in functional assays such as Cytokine release assays, ELISPOT and CTL killing assays.

Prediction of good HLA class 1 peptide binders can be done at the HLA superfamily level even taking the combined action of endocolic and membrane bound protease activities as well as the TAP1 and TAP2 transporter specificities into consideration using the program www.cbs.dtu.dk/services/NetCTL/.

Design of MHC Class 2 Binding Peptide Sequence.

a) Total Approach and b) Directed Approach

The approach to predict putative peptide binders for MHC class 2 is similar as given above for MHC class 1 binding peptide prediction. The only change is the different size of the peptides, which is preferably 13-16 amino acids long for MHC class 2. The putative binding peptide sequences only describe the central part of the peptide including the 9-mer core peptide; in other words, the peptide sequences shown represent the core of the binding peptide with a few important flanking amino acids, which in some cases may be of considerably length generating binding peptides longer than the 13-16 amino acids.

Choice of MHC Allele

Figure 4:
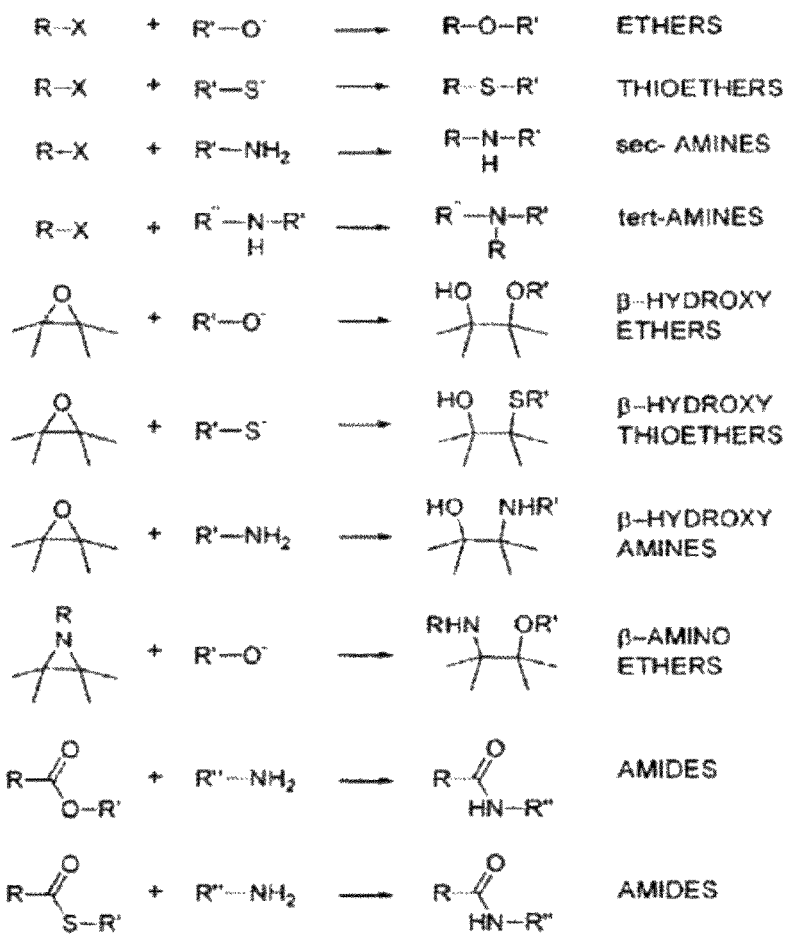
FIG. 4. List of top 30 HLA class 1 alleles in different human ethnic groups.

More than 600 MHC alleles (class 1 and 2) are known in humans; for many of these, the peptide binding characteristics are known. FIG. 3 presents an updated list of the HLA class 1 alleles. The frequency of the different HLA alleles varies considerably, also between different ethnic groups (FIG. 4). Thus it is of outmost importance to carefully select the MHC alleles that corresponds to the human group that one wish to study.

Peptide Modifications
Homologous Peptides

Predictions of the primary amino acid sequence for the binding peptides of MHC class I and class II molecules can be done as described above on the basis of the genetic information. Peptides homologous to the predicted peptide sequences may also be bound if they are sufficiently homologous i.e. are having an amino acid sequence identity greater than e.g. more than 90%, more than 80% or more than 70%. Identity being most important for the anchor residues.

Homologues MHC peptide sequences may arise from the existence of multiple strongly homologous alleles, from small insertions, deletions, inversions or substitutions.

Uncommon Amino Acids

Peptides having un-common amino acids may be bound in the MHC groove as well. Two un-common amino acids found in nature are selenocysteine and pyrrolysine.

Artificial Amino Acids

Artificial amino acids e.g. having the isomeric D-form may also make up isomeric D-peptides that can bind in the binding groove of the MHC molecules.

Chemically Modified Amino Acids

Bound peptides may also contain amino acids that are chemically modified or being linked to reactive groups that can be activated to induce changes in or disrupt the peptide.

Split or Combinatorial Peptide

A MHC binding peptide may also be of split- or combinatorial epitope origin i.e. formed by linkage of peptide fragments derived from two different peptide fragments and/or proteins. Such peptides can be the result of either genetic recombination on the DNA level or due to peptide fragment association during the complex break down of proteins during protein turnover. Possibly it could also be the result of faulty reactions during protein synthesis i.e. caused by some kind of mixed RNA handling. A kind of combinatorial peptide epitope can also be seen if a portion of a longer peptide make a loop out leaving only the terminal part of the peptide bound in the groove.

Position in Peptide of Amino Acid Change

Any of the mentioned changes of the bound peptide amino acid sequence, can be found individually or in combination at any position of the peptide e.g. position 1, 2, 3, 4, 5, 6, etc up to n, n being the final amino acid of the peptide.

TABLE 1

Post translational modification of peptides
Protein primary structure and posttranslational modifications

| | |
|---|---|
| N-terminus | Acetylation, Formylation, Pyroglutamate, Methylation, Glycation, Myristoylation (Gly), carbamylation |
| C-terminus | Amidation, Glycosyl phosphatidylinositol (GPI), O-methylation, Glypiation, Ubiquitmation, Sumoylation. |
| Lysine | Methylation, Acetylation, Acylation, Hydroxylation, Ubiquitination, SUMOylation, Desmosine formation, ADP-ribosylation, Deamination and Oxidation to aldehyde |
| Cysteine | Disulfide bond, Prenylation, Palmitoylation |
| Serine/Threonine | Phosphorylation, Glycosylation |
| Tyrosine | Phosphorylation, Sulfation, Porphyrin ring linkage, Flavin linkage GFP prosthetic group (Thr-Tyr-Gly sequence) formation, Lysine tyrosine quinone (LTQ) formation, Topaquinone (TPQ) formation |
| Asparagine | Deamidation, Glycosylation |
| Aspartate | Succinimide formation |
| Glutamine | Transglutamination |
| Glutamate | Carboxylation, Methylation, Polyglutamylation, Polyglycylation |
| Arginine | Citrullination, Methylation |
| Proline | Hydroxylation |

Post Translationally Modified Peptides

The amino acids of the MHC bound peptides can also be modified in various ways dependent on the amino acid in question or the modification can affect the amino- or carboxy-terminal end of the peptide. See table 1. Such peptide modifications are occurring naturally as the result of post translational processing of the parental protein. A non-exhaustive description of the major post translational modifications is given below, divided into three main types a) Involving Addition Include:
   acylation, the addition of an acetyl group, usually at the N-terminus of the protein
   alkylation, the addition of an alkyl group (e.g. methyl, ethyl). Methylation, the addition of a methyl group, usually at lysine or arginine residues is a type of alkylation. Demethylation involves the removal of a methyl-group.
   amidation at C-terminus
   biotinylation, acylation of conserved lysine residues with a biotin appendage
   formylation
   gamma-carboxylation dependent on Vitamin K
   glutamylation, covalent linkage of glutamic acid residues to tubulin and some other proteins by means of tubulin polyglutamylase
   glycosylation, the addition of a glycosyl group to either asparagine, hydroxylysine, serine, or threonine, resulting in a glycoprotein. Distinct from glycation, which is regarded as a nonenzymatic attachment of sugars.
   glycylation, covalent linkage of one to more than 40 glycine residues to the tubulin C-terminal tail
   heme moiety may be covalently attached
   hydroxylation, is any chemical process that introduces one or more hydroxyl groups (—OH) into a compound (or radical) thereby oxidizing it. The principal residue to be hydroxylated is Proline. The hydroxilation occurs at the $C^\gamma$ atom, forming hydroxyproline (Hyp). In some cases, proline may be hydroxylated instead on its $C^\beta$ atom. Lysine may also be hydroxylated on its $C^\delta$ atom, forming hydroxylysine (Hyl).
   iodination (e.g. of thyroid hormones)
   isoprenylation, the addition of an isoprenoid group (e.g. farnesol and geranylgeraniol)
   lipoylation, attachment of a lipoate functionality, as in prenylation, GPI anchor formation, myristoylation, farnesylation, geranylation
   nucleotides or derivatives thereof may be covalently attached, as in ADP-ribosylation and flavin attachment
   oxidation, lysine can be oxidized to aldehyde
   pegylation, addition of poly-ethylen-glycol groups to a protein. Typical reactive amino acids include lysine, cysteine, histidine, arginine, aspartic acid, glutamic acid, serine, threonine, tyrosine. The N-terminal amino group and the C-terminal carboxylic acid can also be used
   phosphatidylinositol may be covalently attached
   phosphopantetheinylation, the addition of a 4'-phosphopantetheinyl moiety from coenzyme A, as in fatty acid, polyketide, non-ribosomal peptide and leucine biosynthesis phosphorylation, the addition of a phosphate group, usually to serine, tyrosine, threonine or histidine pyroglutamate formation as a result of N-terminal glutamine self-attack, resulting in formation of a cyclic pyroglutamate group.

racemization of proline by prolyl isomerase tRNA-mediated addition of amino acids such as arginylation sulfation, the addition of a sulfate group to a tyrosine.

Selenoylation (co-translational incorporation of selenium in selenoproteins)

b) Involving Addition of Other Proteins or Peptides

ISGylation, the covalent linkage to the ISG15 protein (Interferon-Stimulated Gene 15)

SUMOylation, the covalent linkage to the SUMO protein (Small Ubiquitin-related MOdifier)

ubiquitination, the covalent linkage to the protein ubiquitin.

c) Involving Changing the Chemical Nature of Amino Acids citrullination, or deimination the conversion of arginine to citrulline deamidation, the conversion of glutamine to glutamic acid or asparagine to aspartic acid The peptide modifications can occur as modification of a single amino acid or more than one i.e. in combinations. Modifications can be present on any position within the peptide i.e. on position 1, 2, 3, 4, 5, etc. for the entire length of the peptide.

Sources of Peptides a) From Natural Sources

Peptides can be obtained from natural sources by enzymatic digestion or proteolysis of natural proteins or proteins derived by in vitro translation of mRNA. Peptides may also be eluted from the MHC binding groove.

b) From Recombinant Sources

1) As Monomeric or Multimeric Peptide

Alternatively peptides can be produced recombinantly by transfected cells either as monomeric antigenic peptides or as multimeric (contatemeric) antigenic peptides.

2) As Part of a Bigger Recombinant Protein

Binding peptides may also constitute a part of a bigger recombinant protein e.g. consisting of, 2a) For MHC Class 1 Binding Peptides, Peptide-linker-β2m, β2m being full length or truncated;

Peptide-linker-MHC class 1 heavy chain, the heavy chain being full length or truncated. Most importantly the truncated class I heavy chain will consist of the extracellular part i.e the α1, α2, and a domains. The heavy chain fragment may also only contain the α1 and α2 domains, or α1 domain alone, or any fragment or full length β2m or heavy chain attached to a designer domain(s) or protein fragment(s).

2b) for MHC Class 2 Binding Peptides the Recombinant Construction can Consist of, Peptide-linker-MHC class 2 □-chain, full length or truncated;

Peptide-linker-MHC class 2 □-chain, full length or truncated;

Peptide-linker-MHC class 2 □-chain-linker-MHC class 2 □-chain, both chains can be full length or truncated, truncation may involve, omission of □- and/or □-chain intermembrane domain, or omission of □- and/or □-chain intermembrane plus cytoplasmic domains. MHC class 2 part of the construction may consist of fused domains from NH2-terminal, MHC class 2 □/domain-MHC class 2 □/domain-constant □3 of MHC class 1, or alternatively of fused domains from NH2-terminal, MHC class 2 □1domain-MHC class 2 □1domain-constant □3 of MHC class 1. In both cases □2m will be associated non-covalently in the folded MHC complex. □2m can also be covalently associated in the folded MHC class 2 complex if the following constructs are used from NH2 terminal, MHC class 2 □1domain-MHC class 2 □1domain-constant □3 of MHC class 1-linker-□2m, or alternatively of fused domains from NH2-terminal, MHC class 2 □1domain-MHC class 2 □1domain-constant □3 of MHC class 1-linker-□2m; the construct may also consist of any of the above MHC class 2 constructs with added designer domain(s) or sequence(s).

c) From Chemical Synthesis

MHC binding peptide may also be chemically synthesized by solid phase or fluid phase synthesis.

Loading of the Peptide into the MHCmer

Loading of the peptides into the MHCmer being either MHC class 1 or class 2 can be performed in a number of ways depending on the source of the peptide and the MHC. MHC class 2 molecules can in principle be loaded with peptides in similar ways as MHC class 1. However, due to complex instability the most successful approach have been to make the complexes recombinant in toto in eukaryotic cells from a gene construct encoding the following form □ chain-flexible linker-□ chain-flexible linker-peptide a) During MHC Complex Folding a1) As a Free Peptide MHC class I molecules are most often loaded with peptide during assembly in vitro by the individual components in a folding reaction i.e. consisting of purified recombinant heavy chain □ with the purified recombinant □2 microglobulin and a peptide or a peptide mix.

a2) As Part of a Recombinant Protein Construct

Alternatively the peptide to be folded into the binding groove can be encoded together with e.g. the □ heavy chain or fragment hereof by a gene construct having the structure, heavy chain-flexible linker-peptide. This recombinant molecule is then folded in vitro with □2-microglobulin.

b) By Exchange Reaction b1) In Solution

Loading of desired peptide can also be made by an in vitro exchange reaction where a peptide already in place in the binding groove are being exchanged by another peptide species.

b2) "In Situ"

Peptide exchange reactions can also take place when the parent molecule is attached to other molecules, structures, surfaces, artificial or natural membranes and nano-particles.

b3) By Aided Exchange

This method can be refined by making the parent construct with a peptide containing a meta-stable amino acid analog that is split by either light or chemically induction thereby leaving the parent structure free for access of the desired peptide in the binding groove.

b4) By In Vivo Loading

Loading of MHC class I and II molecules expressed on the cell surface with the desired peptides can be performed by an exchange reaction. Alternatively cells can be transfected by the peptides themselves or by the mother proteins that are then being processed leading to an in vivo analogous situation where the peptides are bound in the groove during the natural cause of MHC expression by the transfected cells. In the case of professional antigen presenting cells e.g. dendritic cells, macrophages, Langerhans cells, the proteins and peptides can be taken up by the cells themselves by phagocytosis and then bound to the MHC complexes the natural way and expressed on the cell surface in the correct MHC context.

Verification of Correctly Folded MHC-Peptide Complexes
Quantitative ELISA and Other Techniques to Quantify Correctly Folded MHC Complexes When producing MHC multimers, it is desirable to determine the degree of correctly folded MHC.

The fraction or amount of functional and/or correctly folded MHC can be tested in a number of different ways, including:

- Measurement of correctly folded MHC in a quantitative ELISA, e.g. where the MHC bind to immobilized molecules recognizing the correctly folded complex.
- Measurement of functional MHC in an assay where the total protein concentration is measured before functional MHC is captured, by binding to e.g. immobilized TCR, and the excess, non-bound protein are measured. If the dissociation constant for the interaction is known, the amount of total and the amount of non-bound protein can be determined. From these numbers, the fraction of functional MHC complex can be determined.
- Measurement of functional MHC complex by a non-denaturing gel-shift assay, where functional MHC complexes bind to TCR (or another molecule that recognize correctly folded MHC complex), and thereby shifts the TCR to another position in the gel.

Multimerization Domain

A number of MHC complexes associate with a multimerization domain to form a MHC multimer. The size of the multimerization domain spans a wide range, from multimerisation domains based on small organic molecule scaffolds to large multimers based on a cellular structure or solid support. The multimerization domain may thus be based on different types of carriers or scaffolds, and likewise, the attachment of MHC complexes to the multimerization domain may involve covalent or non-covalent linkers.

Characteristics of different kinds of multimerization domains are described below.

Molecular Weight of Multimerization Domain.

- In one embodiment the multimerization domain(s) in the present invention is preferably less than 1,000 Da (small molecule scaffold). Examples include short peptides (e.g. comprising 10 amino acids), and various small molecule scaffolds (e.g. aromatic ring structures).
- In another embodiment the multimerization domain(s) is preferably between 1,000 Da and 10,000 Da (small molecule scaffold, small peptides, small polymers). Examples include polycyclic structures of both aliphatic and aromatic compounds, peptides comprising e.g. 10-100 amino acids, and other polymers such as dextran, polyethylenglycol, and polyureas.
- In another embodiment the multimerization domain(s) is between 10,000 Da and 100,000 Da (Small molecule scaffold, polymers e.g. dextran, streptavidin, IgG, pentamer structure). Examples include proteins and large polypeptides, small molecule scaffolds such as steroids, dextran, dimeric streptavidin, and multi-subunit proteins such as used in Pentamers.
- In another embodiment the multimerization domain(s) is preferably between 100,000 Da and 1,000,000 Da (Small molecule scaffold, polymers e.g. dextran, streptavidin, IgG, pentamer structure). Typical examples include larger polymers such as dextran (used in e.g. Dextramers), and streptavidin tetramers.
- In another embodiment the multimerization domain(s) is preferably larger than 1,000,000 Da (Small molecule scaffold, polymers e.g. dextran, streptavidin, IgG, pentamer structure, cells, liposomes, artificial lipid bilayers, polystyrene beads and other beads. Most examples of this size involve cells or cell-based structures such as micelles and liposomes, as well as beads and other solid supports.

As mentioned elsewhere herein multimerisation domains can comprise carrier molecules, scaffolds or combinations of the two.

Type of Multimerization Domain.

In principle any kind of carrier or scaffold can be used as multimerization domain, including any kind of cell, polymer, protein or other molecular structure, or particles and solid supports. Below different types and specific examples of multimerization domains are listed.

- Cell. Cells can be used as carriers. Cells can be either alive and mitotic active, alive and mitotic inactive as a result of irradiation or chemically treatment, or the cells may be dead. The MHC expression may be natural (i.e. not stimulated) or may be induced/stimulated by e.g. Inf-γ. Of special interest are natural antigen presenting cells (APCs) such as dendritic cells, macrophages, Kupfer cells, Langerhans cells, B-cells and any MHC expressing cell either naturally expressing, being transfected or being a hybridoma.
- Cell-like structures. Cell-like carriers include membrane-based structures carrying MHC-peptide complexes in their membranes such as micelles, liposomes, and other structures of membranes, and phages such as filamentous phages.
- Solid support. Solid support includes beads, particulate matters and other surfaces. A preferred embodiment include beads (magnetic or non-magnetic beads) that carry electrophilic groups e.g. divinyl sulfone activated polysaccharide, polystyrene beads that have been functionalized with tosyl-activated esters, magnetic polystyrene beads functionalized with tosyl-activated esters), and where MHC complexes may be covalently immobilized to these by reaction of nucleophiles comprised within the MHC complex with the electrophiles of the beads. Beads may be made of sepharose, sephacryl, polystyrene, agarose, polysaccharide, polycarbamate or any other kind of beads that can be suspended in aqueous buffer.
- Another embodiment includes surfaces, i.e. solid supports and particles carrying immobilized MHC complexes on the surface. Of special interest are wells of a microtiter plate or other plate formats, reagent tubes, glass slides or other supports for use in microarray analysis, tubings or channels of micro fluidic chambers or devices, Biacore chips and beads
- Molecule. Multimerization domains may also be molecules or complexes of molecules held together by non-covalent bonds. The molecules constituting the multimerization domain can be small organic molecules or large polymers, and may be flexible linear molecules or rigid, globular structures such as e.g. proteins. Different kinds of molecules used in multimerization domains are described below.
  - Small organic molecules. Small organic molecules here includes steroids, peptides, linear or cyclic structures, and aromatic or aliphatic structures, and many others. The prototypical small organic scaffold is a functionalized benzene ring, i.e. a benzene ring functionalized with a number of reactive groups such as amines, to which a number of MHC molecules may be covalently linked. However, the types of reactive groups constituting the linker connecting the MHC complex and the multimerization domain, as well as the type of scaffold structure, can be chosen from a long list of chemical structures. A non-comprehensive list of scaffold structures are listed below.

Typical scaffolds include aromatic structures, benzodiazepines, hydantoins, piperazines, indoles, furans, thiazoles, steroids, diketopiperazines, morpholines, tropanes, coumarines, qinolines, pyrroles, oxazoles, amino acid precursors, cyclic or aromatic ring structures, and many others.

Typical carriers include linear and branched polymers such as peptides, polysaccharides, nucleic acids, and many others. Multimerization domains based on small organic or polymer molecules thus include a wealth of different structures, including small compact molecules, linear structures, polymers, polypeptides, polyureas, polycarbamates, cyclic structures, natural compound derivatives, alpha-, beta-, gamma-, and omega-peptides, mono-, di- and tri-substituted peptides, L- and D-form peptides, cyclohexane- and cyclopentane-backbone modified beta-peptides, vinylogous polypeptides, glycopolypeptides, polyamides, vinylogous sulfonamide peptide, Polysulfonamide-conjugated peptide (i.e., having prosthetic groups), Polyesters, Polysaccharides such as dextran and aminodextran, polycarbamates, polycarbonates, polyureas, poly-peptidyl-phosphonates, Azatides, peptoids (oligo N-substituted glycines), Polyethers, ethoxyformacetal oligomers, poly-thioethers, polyethylene, glycols (PEG), polyethylenes, polydisulfides, polyarylene sulfides, Polynucleotides, PNAs, LNAs, Morpholinos, oligo pyrrolinone, polyoximes, Poly-imines, Polyethyleneimine, Polyacetates, Polystyrenes, Polyacetylene, Polyvinyl, Lipids, Phospholipids, Glycolipids, polycycles, (aliphatic), polycycles (aromatic), polyheterocycles, Proteoglycan, Polysi-loxanes, Polyisocyanides, Polyisocyanates, polymethacrylates, Monofunctional, Difunctional, Trifunctional and Oligofunctional open-chain hydrocarbons, Monofunctional, Difunctional, Trifunctional and Oligofunctional Nonaromat Carbocycles, Monocyclic, Bicyclic, Tricyclic and Polycyclic Hydrocarbons, Bridged Polycyclic Hydrocarbones, Monofunctional, Difunctional, Trifunctional and Oligofunctional Nonaromatic, Heterocycles, Monocyclic, Bicyclic, Tricyclic and Polycyclic Heterocycles, bridged Polycyclic Heterocycles, Monofunctional, Difunctional, Trifunctional and Oligofunctional Aromatic Carbocycles, Monocyclic, Bicyclic, Tricyclic and Polycyclic Aromatic Carbocycles, Monofunctional, Difunctional, Trifunctional and Oligofunctional Aromatic Hetero-cycles. Monocyclic, Bicyclic, Tricyclic and Polycyclic Hetero-cycles. Chelates, fullerenes, and any combination of the above and many others.

Biological polymers. Biological molecules here include peptides, proteins (including antibodies, coiled-coil helices, streptavidin and many others), nucleic acids such as DNA and RNA, and polysaccharides such as dextran. The biological polymers may be reacted with MHC complexes (e.g. a number of MHC complexes chemically coupled to e.g. the amino groups of a protein), or may be linked through e.g. DNA duplex formation between a carrier DNA molecule and a number of DNA oligonucleotides each coupled to a MHC complex. Another type of multimerization domain based on a biological polymer is the streptavidin-based tetramer, where a streptavidin binds up to four biotinylated MHC complexes, as described above (see Background of the invention).

Self-assembling multimeric structures. Several examples of commercial MHC multimers exist where the multimer is formed through self-assembling. Thus, the Pentamers are formed through formation of a coiled-coil structure that holds together 5 MHC complexes in an apparently planar structure. In a similar way, the Streptamers are based on the Streptactin protein which oligomerizes to form a MHC multimer comprising several MHC complexes (see Background of the invention).

In the following, alternative ways to make MHC multimers based on a molecule multimerization domain are described. They involve one or more of the abovementioned types of multimerization domains.

MHC dextramers can be made by coupling MHC complexes to dextran via a streptavidin-biotin interaction. In principle, biotin-streptavidin can be replaced by any dimerization domain, where one half of the dimerization domain is coupled to the MHC-peptide complex and the other half is coupled to dextran. For example, an acidic helix (one half of a coiled-coil dimer) is coupled or fused to MHC, and a basic helix (other half of a coiled-coil dimmer) is coupled to dextran. Mixing the two results in MHC binding to dextran by forming the acid/base coiled-coil structure.

Antibodies can be used as scaffolds by using their capacity to bind to a carefully selected antigen found naturally or added as a tag to a part of the MHC molecule not involved in peptide binding. For example, IgG and IgE will be able to bind two MHC molecules, IgM having a pentameric structure will be able to bind 10 MHC molecules. The antibodies can be full-length or truncated; a standard antibody-fragment includes the Fab2 fragment.

Peptides involved in coiled-coil structures can act as scaffold by making stable dimeric, trimeric, tetrameric and pentameric interactions. Examples hereof are the Fos-Jun heterodimeric coiled coil, the *E. coli* homo-trimeric coiled-coil domain Lpp-56, the engineered Trp-zipper protein forming a discrete, stable, α-helical pentamer in water at physiological pH.

Further examples of suitable scaffolds, carriers and linkers are streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-tranferase), glutathione, Calmodulin-binding peptide (CBP), Strep-tag, Cellulose Binding Domain, Maltose Binding Protein, S-Peptide Tag, Chitin Binding Tag, Immunoreactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. Non-limiting examples are streptavidin-biotin and jun-fos. In particular, when the MHC molecule is tagged, the binding entity may be an "anti-tag". By "anti-tag" is meant an antibody binding to the tag, or any other molecule capable of binding to such tag.

MHC complexes can be multimerized by other means than coupling or binding to a multimerization domain. Thus, the multimerization domain may be formed during the multimerization of MHCs. One such method is to extend the bound antigenic peptide with dimerization domains. One end of the antigenic peptide is extended with dimerization domain A (e.g. acidic helix, half of a coiled-coil dimer) and the other end is extended with dimerization domain B (e.g. basic helix, other half of a coiled-coil dimer). When MHC complexes are loaded/mixed with these extended peptides the following multimer structure will be formed: A-MHC-BA-MHC-BA-MHC-B etc. The antigenic peptides in the mixture can either be identical or a mixture of peptides with comparable extended dimerization domains. Alternatively both ends of a peptide are extended with the same dimerization domain A and another peptide (same amino acid sequence or a different amino acid sequence) is extended with dimerization domain B. When MHC and peptides are mixed the following structures are formed: A-MHC-AB-MHC-BA-MHC-AB-MHC-B etc. Multimerization of MHC complexes by extension of peptides are restricted to MHC II molecules since the peptide binding groove of MHC I molecules is typically closed in both ends thereby limiting the size of peptide that can be embedded in the groove, and therefore preventing the peptide from extending out of the groove.

Another multimerization approach applicable to both MHC I and MHC II complexes is based on extension of N- and C-terminal of the MHC complex. For example the N-terminal of the MHC complex is extended with dimerization domain A and the C-terminal is extended with dimerization domain B. When MHC complexes are incubated together they pair with each other and form multimers like: A-MHC-BA-MHC-BA-MHC-BA-MHC-B etc. Alternatively the N-terminal and the C-terminal of a MHC complex are both extended with dimerization domain A and the N-terminal and C-terminal of another preparation of MHC complex (either the same or a different MHC) are extended with dimerization domain B. When these two types of MHC complexes are incubated together multimers will be formed: A-MHC-AB-MHC-BA-MHC-AB-MHC-B etc.

In all the above-described examples the extension can be either chemically coupled to the peptide/MHC complex or introduced as extension by gene fusion.

Dimerization domain AB can be any molecule pair able to bind to each other, such as acid/base coiled-coil helices, antibody-antigen, DNA-DNA, PNA-PNA, DNA-PNA, DNA-RNA, LNA-DNA, leucine zipper e.g. Fos/Jun, streptavidin-biotin and other molecule pairs as described elsewhere herein.

Linker Molecules.

A number of MHC complexes associate with a multimerization domain to form a MHC multimer. The attachment of MHC complexes to the multimerization domain may involve covalent or non-covalent linkers, and may involve small reactive groups as well as large protein-protein interactions.

The coupling of multimerization domains and MHC complexes involve the association of an entity X (attached to or part of the multimerization domain) and an entity Y (attached to or part of the MHC complex). Thus, the linker that connects the multimerization domain and the MHC complex comprises an XY portion.

Figure 5:
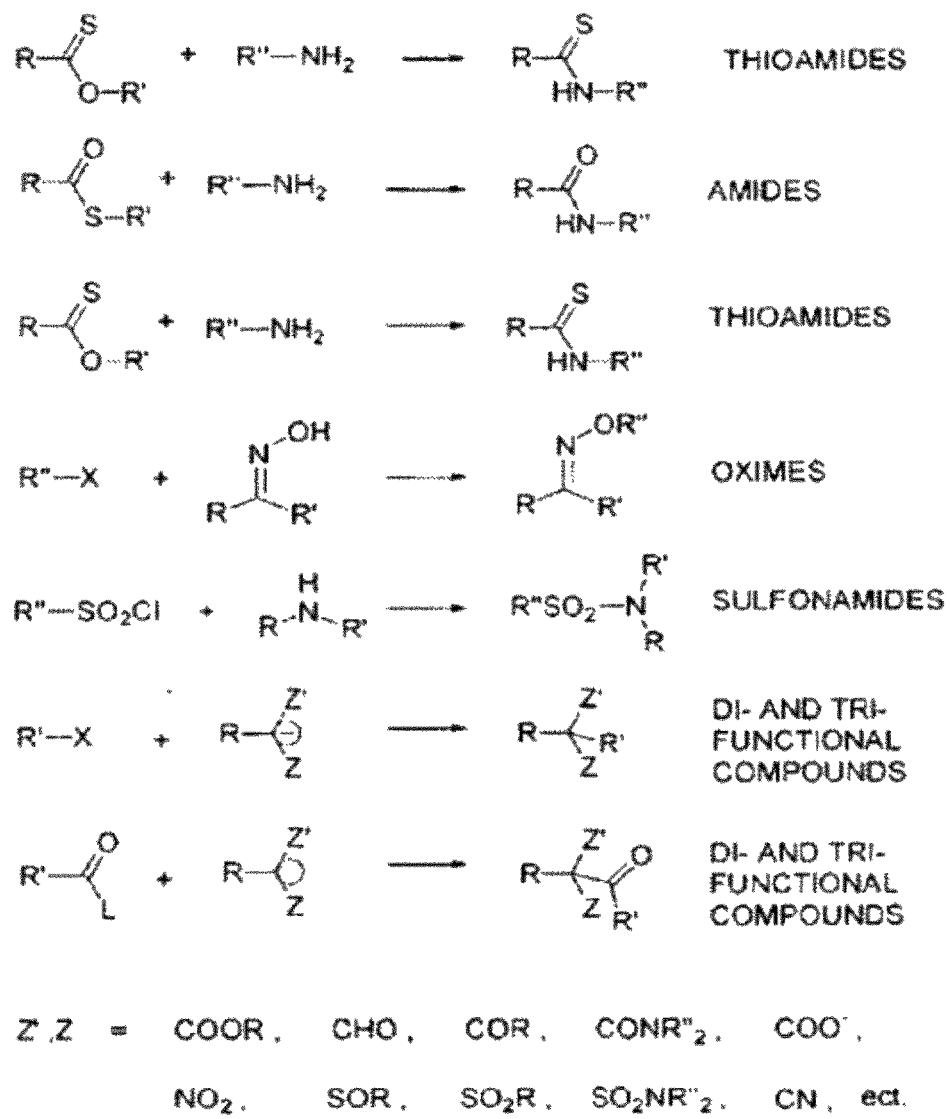
FIG. 5. Illustration of selected reaction groups.
Figure 5:
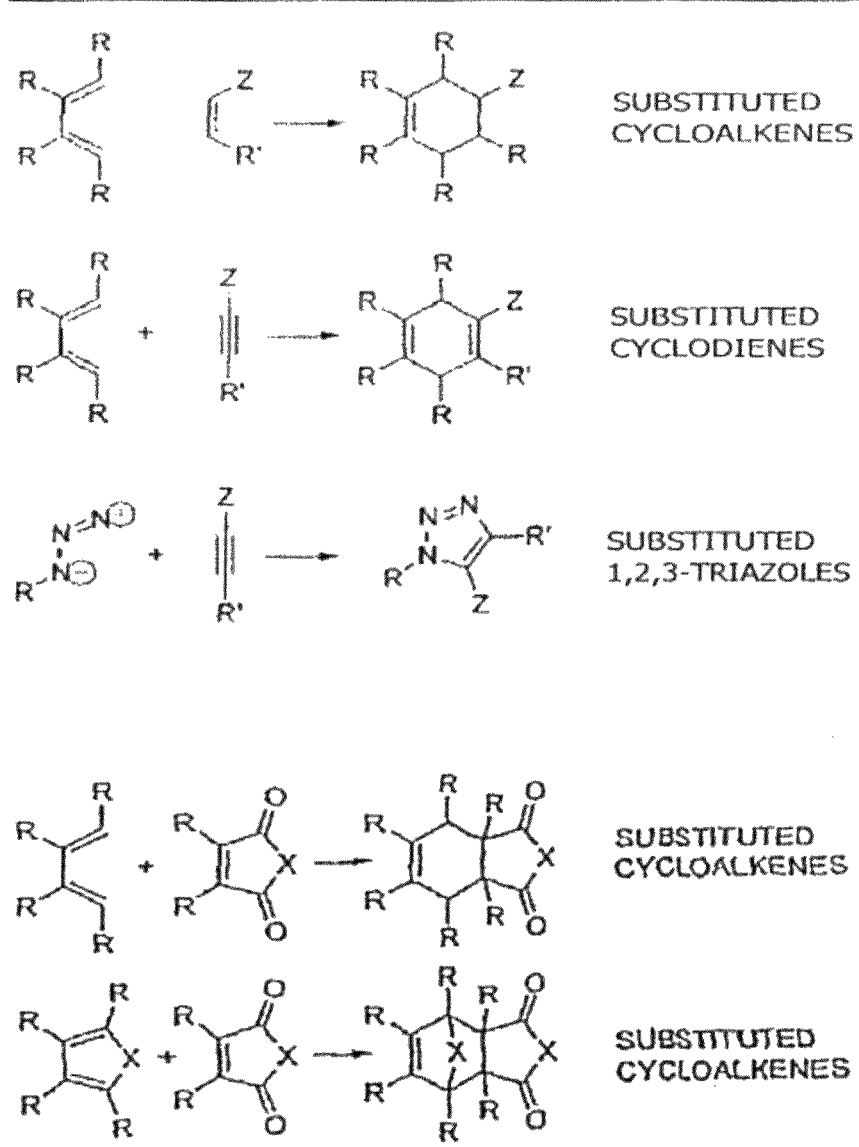
Figure 5:
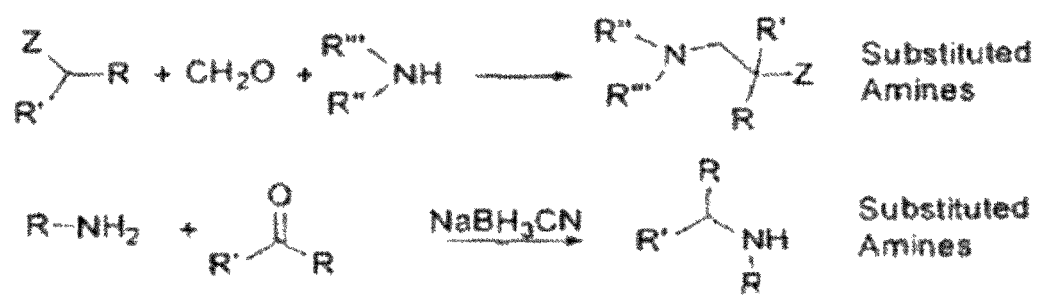

Covalent linker. The XY linkage can be covalent, in which case X and Y are reactive groups. In this case, X can be a nucleophilic group (such as —$NH_2$, —OH, —SH, —NH—$NH_2$), and Y an electrophilic group (such as CHO, COOH, CO) that react to form a covalent bond XY; or Y can be a nucleophilic group and X an electrophilic group that react to form a covalent bond XY. Other possibilities exist, e.g either of the reactive groups can be a radical, capable of reacting with the other reactive group. A number of reactive groups X and Y, and the bonds that are formed upon reaction of X and Y, are shown in FIG. 5.

X and Y can be reactive groups naturally comprised within the multimerization domain and/or the MHC complex, or they can be artificially added reactive groups. Thus, linkers containing reactive groups can be linked to either of the multimerization domain and MHC complex; subsequently the introduced reactive group(s) can be used to covalently link the multimerization domain and MHC complex.

Example natural reactive groups of MHC complexes include amino acid side chains comprising —$NH_2$, —OH, —SH, and —NH—. Example natural reactive groups of multimerization domains include hydroxyls of polysaccharides such as dextrans, but also include amino acid side chains comprising —$NH_2$, —OH, —SH, and —NH— of polypeptides, when the polypeptide is used as a multimerization domain. In some MHC multimers, one of the polypeptides of the MHC complex (i.e. the β2M, heavy chain or the antigenic peptide) is linked by a protein fusion to the multimerization domain. Thus, during the translation of the fusion protein, an acyl group (reactive group X or Y) and an amino group (reactive group Y or X) react to form an amide bond. Example MHC multimers where the bond between the multimerization domain and the MHC complex is covalent and results from reaction between natural reactive groups, include MHC-pentamers (described in US patent 2004209295) and MHC-dimers, where the linkage between multimerization domain and MHC complex is in both cases generated during the translation of the fusion protein.

Example artificial reactive groups include reactive groups that are attached to the multimerization domain or MHC complex, through association of a linker molecule comprising the reactive group. The activation of dextran by reaction of the dextran hydroxyls with divinyl sulfone, introduces a reactive vinyl group that can react with e.g. amines of the MHC complex, to form an amine that now links the multimerization domain (the dextran polymer) and the MHC complex. An alternative activation of the dextran multimerization domain involves a multistep reaction that results in the decoration of the dextran with maleimide groups, as described in the patent Siiman et al. U.S. Pat. No. 6,387,622. In this approach, the amino groups of MHC complexes are converted to —SH groups, capable of reacting with the maleimide groups of the activated dextran. Thus, in the latter example, both the reactive group of the multimerization domain (the maleimide) and the reactive group of the MHC complex (the thiol) are artificially introduced.

Sometimes activating reagents are used in order to make the reactive groups more reactive. For example, acids such as glutamate or aspartate can be converted to activated esters by addition of e.g. carbodiimid and NHS or nitrophenol, or by converting the acid moiety to a tosyl-activated ester. The activated ester reacts efficiently with a nucleophile such as —$NH_2$, —SH, —OH, etc.

For the purpose of this invention, the multimerization domains (including small organic scaffold molecules, proteins, protein complexes, polymers, beads, liposomes, micelles, cells) that form a covalent bond with the MHC complexes can be divided into separate groups, depending on the nature of the reactive group that the multimerization domain contains. One group comprise multimerization domains that carry nucleophilic groups (e.g. —$NH_2$, —OH, —SH, —CN, —NH—$NH_2$), exemplified by polysaccharides, polypeptides containing e.g. lysine, serine, and cysteine; another group of multimerization domains carry electrophilic groups (e.g. —COOH, —CHO, —CO, NHS-ester, tosyl-activated ester, and other activated esters, acid-anhydrides), exemplified by polypeptides containing e.g. glutamate and aspartate, or vinyl sulfone activated dextran; yet another group of multimerization domains carry radicals or conjugated double bonds.

The multimerization domains appropriate for this invention thus include those that contain any of the reactive groups shown in FIG. 5 or that can react with other reactive groups to form the bonds shown in FIG. 5.

Likewise, MHC complexes can be divided into separate groups, depending on the nature of the reactive group comprised within the MHC complex. One group comprise MHCs that carry nucleophilic groups (e.g. —$NH_2$, —OH, —SH, —CN, —NH—$NH_2$), e.g. lysine, serine, and cysteine; another group of MHCs carry electrophilic groups (e.g. —COOH, —CHO, —CO, NHS-ester, tosyl-activated ester, and other activated esters, acid-anhydrides), exemplified by e.g. glutamate and aspartate; yet another group of MHCs carry radicals or conjugated double bonds.

The reactive groups of the MHC complex are either carried by the amino acids of the MHC-peptide complex (and may be comprised by any of the peptides of the MHC-peptide complex, including the antigenic peptide), or alternatively, the reactive group of the MHC complex has been introduced by covalent or non-covalent attachment of a molecule containing the appropriate reactive group.

Preferred reactive groups in this regard include —$CSO_2OH$, phenylchloride, —SH, —SS, aldehydes, hydroxyls, isocyanate, thiols, amines, esters, thioesters, carboxylic acids, triple bonds, double bonds, ethers, acid chlorides, phosphates, imidazoles, halogenated aromatic rings, any precursors thereof, or any protected reactive groups, and many others. Example pairs of reactive groups, and the resulting bonds formed, are shown in FIG. 5.

Reactions that may be employed include acylation (formation of amide, pyrazolone, isoxazolone, pyrimidine, comarine, quinolinon, phthalhydrazide, diketopiperazine, benzodiazepinone, and hydantoin), alkylation, vinylation, disulfide formation, Wittig reaction, Horner-Wittig-Emmans reaction, arylation (formation of biaryl or vinylarene), condensation reactions, cycloadditions ((2+4), (3+2)), addition to carbon-carbon multiplebonds, cycloaddition to multiple bonds, addition to carbon-hetero multiple bonds, nucleophilic aromatic substitution, transition metal catalyzed reactions, and may involve formation of ethers, thioethers, secondary amines, tertiary amines, beta-hydroxy ethers, beta-hydroxy thioethers, beta-hydroxy amines, beta-amino ethers, amides, thioamides, oximes, sulfonamides, di- and tri-functional compounds, substituted aromatic compounds, vinyl substituted aromatic compounds, alkyn substituted aromatic compounds, biaryl compounds, hydrazines, hydroxylamine ethers, substituted cycloalkenes, substituted cyclodienes, substituted 1, 2, 3 triazoles, substituted cycloalkenes, beta-hydroxy ketones, beta-hydroxy aldehydes, vinyl ketones, vinyl aldehydes, substituted alkenes, substituted alkenes, substituted amines, and many others.

MHC dextramers can be made by covalent coupling of MHC complexes to the dextran backbone, e.g. by chemical coupling of MHC complexes to dextran backbones. The MHC complexes can be coupled through either heavy chain or β2-microglobulin if the MHC complexes are MHC I or through α-chain or β-chain if the MHC complexes are MHC II. MHC complexes can be coupled as folded complexes comprising heavy chain/beta2microglobulin or α-chain/β-chain or either combination together with peptide in the peptide-binding cleft. Alternatively either of the protein chains can be coupled to dextran and then folded in vitro together with the other chain of the MHC complex not coupled to dextran and together with peptide. Direct coupling of MHC complexes to dextran multimerization domain can be via an amino group or via a sulphide group. Either group can be a natural component of the MHC complex or attached to the MHC complex chemically. Alternatively, a cysteine may be introduced into the genes of either chain of the MHC complex.

Another way to covalently link MHC complexes to dextran multimerization domains is to use the antigenic peptide as a linker between MHC and dextran. Linker containing antigenic peptide at one end is coupled to dextran. Antigenic peptide here means a peptide able to bind MHC complexes in the peptide-binding cleft. As an example, 10 or more antigenic peptides may be coupled to one dextran molecule. When MHC complexes are added to such peptide-dextran construct the MHC complexes will bind the antigenic peptides and thereby MHC-peptide complexes are displayed around the dextran multimerization domain. The antigenic peptides can be identical or different from each other. Similarly MHC complexes can be either identical or different from each other as long as they are capable of binding one or more of the peptides on the dextran multimerization domain.

Non-covalent linker. The linker that connects the multimerization domain and the MHC complex comprises an XY portion. Above different kinds of covalent linkages XY were described. However, the XY linkage can also be non-covalent.

Non-covalent XY linkages can comprise natural dimerization pairs such as antigen-antibody pairs, DNA-DNA interactions, or can include natural interactions between small molecules and proteins, e.g. between biotin and streptavidin. Artificial XY examples include XY pairs such as $His_6$ tag (X) interacting with Ni-NTA (Y) and PNA-PNA interactions.

Protein-protein interactions. The non-covalent linker may comprise a complex of two or more polypeptides or proteins, held together by non-covalent interactions. Example polypeptides and proteins belonging to this group include Fos/Jun, Acid/Base coiled coil structure, antibody/antigen (where the antigen is a peptide), and many others.

A preferred embodiment involving non-covalent interactions between polypeptides and/or proteins are represented by the Pentamer structure described in US patent 2004209295.

Another preferred embodiment involves the use of antibodies, with affinity for the surface of MHC opposite to the peptide-binding groove. Thus, an anti-MHC antibody, with its two binding site, will bind two MHC complexes and in this way generate a bivalent MHC multimer. In addition, the antibody can stabilize the MHC complex through the binding interactions. This is particularly relevant for MHC class II complexes, as these are less stable than class I MHC complexes.

Polynucleotide-polynucleotide interactions. The non-covalent linker may comprise nucleotides that interact non-covalently. Example interactions include PNA/PNA, DNA/DNA, RNA/RNA, LNA/DNA, and any other nucleic acid duplex structure, and any combination of such natural and unnatural polynucleotides such as DNA/PNA, RNA/DNA, and PNA/LNA.

Protein-small molecule interactions. The non-covalent linker may comprise a macromolecule (e.g. protein, polynucleotide) and a small molecule ligand of the macromolecule. The interaction may be natural (i.e., found in Nature, such as the Streptavidin/biotin interaction) or non-natural (e.g. His-tag peptide/Ni-NTA interaction). Example interactions include Streptavidin/biotin and anti-biotin antibody/biotin.

Combinations—non-covalent linker molecules. Other combinations of proteins, polynucleotides, small organic molecules, and other molecules, may be used to link the MHC to the multimerization domain. These other combinations include protein-DNA interactions (e.g. DNA binding protein such as the gene regulatory protein CRP interacting with its DNA recognition sequence), RNA aptamer-protein interactions (e.g. RNA aptamer specific for growth hormone interacting with growth hormone)

Synthetic molecule-synthetic molecule interaction. The non-covalent linker may comprise a complex of two or more organic molecules, held together by non-covalent interactions. Example interactions are two chelate molecules binding to the same metal ion (e.g. EDTA-$Ni^{++}$-NTA), or a short polyhistidine peptide (e.g. $His_6$) bound to NTA-$Ni^{++}$.

In another preferred embodiment the multimerization domain is a bead. The bead is covalently or non-covalently coated with MHC multimers or single MHC complexes, through non-cleavable or cleavable linkers. As an example, the bead can be coated with streptavidin monomers, which in turn are associated with biotinylated MHC complexes; or the bead can be coated with streptavidin tetramers, each of which are associated with 0, 1, 2, 3, or 4 biotinylated MHC complexes; or the bead can be coated with MHC-dextramers where e.g. the reactive groups of the MHC-dextramer (e.g. the divinyl sulfone-activated dextran backbone) has reacted with nucleophilic groups on the bead, to form a covalent linkage between the dextran of the dextramer and the beads.

In another preferred embodiment, the MHC multimers described above (e.g. where the multimerization domain is a bead) further contains a flexible or rigid, and water soluble, linker that allows for the immobilized MHC complexes to interact efficiently with cells, such as T-cells with affinity for the MHC complexes. In yet another embodiment, the linker is cleavable, allowing for release of the MHC complexes from the bead. If T-cells have been immobilized, by binding to the MHC complexes, the T-cells can very gently be released by cleavage of this cleavable linker Appropriate cleavable linkers are shown in FIG. 6. Most preferably, the linker is cleaved at physiological conditions, allowing for the integrity of the isolated cells.

Further examples of linker molecules that may be employed in the present invention include Calmodulin-binding peptide (CBP), 6×HIS, Protein A, Protein G, biotin, Avidine, Streptavidine, Strep-tag, Cellulose Binding Domain, Maltose Binding Protein, S-Peptide Tag, Chitin Binding Tag, Immuno-reactive Epitopes, Epitope Tags, GST tagged proteins, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope.

The list of dimerization- and multimerization domains, described elsewhere in this document, define alternative non-covalent linkers between the multimerization domain and the MHC complex.

The abovementioned dimerization- and multimerization domains represent specific binding interactions. Another type of non-covalent interactions involves the non-specific adsorption of e.g. proteins onto surfaces. As an example, the non-covalent adsorption of proteins onto glass beads represents this class of XY interactions. Likewise, the interaction of MHC complexes (comprising full-length polypeptide chains, including the transmembrane portion) with the cell membrane of for example dendritic cells is an example of a non-covalent, primarily non-specific XY interaction.

In some of the abovementioned embodiments, several multimerization domains (e.g. streptavidin tetramers bound to biotinylated MHC complexes) are linked to another multimerization domain (e.g. the bead). For the purpose of this invention we shall call both the smaller and the bigger multimerization domain, as well as the combined multimerization domain, for multimerization domain Additional Features of Product Additional components may be coupled to carrier or added as individual components not coupled to carrier Attachment of Biologically Active Molecules to MHC Multimers Engagement of MHC complex to the specific T cell receptor leads to a signaling cascade in the T cell. However, T-cells normally respond to a single signal stimulus by going into apoptosis. T cells needs a second signal in order to become activated and start development into a specific activation state e.g. become an active cytotoxic T cell, helper T cell or regulatory T cell.

It is to be understood that the MHC multimer of the invention may further comprise one or more additional substituents. The definition of the terms "one or more", "a plurality", "a", "an", and "the" also apply here. Such biologically active molecules may be attached to the construct in order to affect the characteristics of the constructs, e.g. with respect to binding properties, effects, MHC molecule specificities, solubility, stability, or detectability. For instance, spacing could be provided between the MHC complexes, one or both chromophores of a Fluorescence Resonance Energy Transfer (FRET) donor/acceptor pair could be inserted, functional groups could be attached, or groups having a biological activity could be attached.

MHC multimers can be covalently or non-covalently associated with various molecules: having adjuvant effects; being immune targets e.g. antigens; having biological activity e.g. enzymes, regulators of receptor activity, receptor ligands, immune potentiators, drugs, toxins, co-receptors, proteins and peptides in general; sugar moieties; lipid groups; nucleic acids including siRNA; nano particles; small molecules. In the following these molecules are collectively called biologically active molecules. Such molecules can be attached to the MHC multimer using the same principles as those described for attachment of MHC complexes to multimerisation domains as described elsewhere herein. In brief, attachment can be done by chemical reactions between reactive groups on the biologically active molecule and reactive groups of the multimerisation domain and/or between reactive groups on the biologically active molecule and reactive groups of the MHC-peptide complex. Alternatively, attachment is done by non-covalent interaction between part of the multimerisation domain and part of the biological active molecule or between part of the MHC-peptide complex and part of the biological active molecule. In both covalent and non-covalent attachment of the biologically molecule to the multimerisation domain a linker molecule can connect the two. The linker molecule can be covalent or non-covalent attached to both molecules. Examples of linker molecules are described elsewhere herein. Some of the MHCmer structures better allows these kind of modifications than others.

Biological active molecules can be attached repetitively aiding to recognition by and stimulation of the innate immune system via Toll or other receptors.

MHC multimers carrying one or more additional groups can be used as therapeutic or vaccine reagents.

In particular, the biologically active molecule may be selected from
proteins such as MHC Class I-like proteins like MIC A, MIC B, CD1d, HLA E, HLA F, HLA G, HLA H, ULBP-1, ULBP-2, and ULBP-3,
co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, B7.1 (CD80), B7.2 (CD86), B7RP-1, B7-H3, PD-L1, PD-L2, CD134L, CD137L, ICOSL, LIGHT expressed on APC and/or tumour cells,
cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin,
accessory molecules such as LFA-1, CD11a/18, CD54 (ICAM-1), CD106 (VCAM), and CD49a,b,c,d,e,f/CD29 (VLA-4),
adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P,
toxic molecules selected from toxins, enzymes, antibodies, radioisotopes, chemiluminescent substances, bioluminescent substances, polymers, metal particles, and haptens, such as cyclophosphamide, methrotrexate, Azathioprine, mizoribine, 15-deoxyspergualin, neomycin, staurosporine, genestein, herbimycin A, *Pseudomonas* exotoxin A, saporin, Rituxan, Ricin, gemtuzumab ozogamicin, Shiga toxin, heavy metals like inorganic and organic mercurials, and FN18-CRM9, radioisotopes such as incorporated isotopes of iodide, cobalt, selenium, tritium, and phosphor, and haptens such as DNP, and digoxiginin,
and combinations of any of the foregoing, as well as antibodies (monoclonal, polyclonal, and recombinant) to the foregoing, where relevant. Antibody derivatives or fragments thereof may also be used.

Design and Generation of Product to be Used for Immune Monitoring, Diagnosis, Therapy or Vaccination The product of the present invention may be used for immune monitoring, diagnosis, therapy and/or vaccination. Generation of a useful product includes the following basic steps:

1. Design of antigenic peptides
2. Choice of MHC allele
3. Generation of product
4. Validation and optimization of product In the following strategies for generation of products are given:

How to Make a MHC Multimer Diagnostic or Immune Monitoring Reagent

1. Identify disease of interest. Most relevant diseases in this regard are infectious-, cancer-, auto immune-, transplantation-, or immuno-suppression-related diseases.
2. Identify relevant protein targets. This may be individual proteins, a group of proteins from a given tissue or all or subgroups of proteins from a complete organism.
3. Identify the protein sequence. Amino acid sequences can be directly found in databases or deduced from gene- or mRNA sequence e.g. using the following link www.ncbi.nlm.nih.gov/Genbank/index.html. If not in databases relevant proteins or genes encoding relevant proteins may be isolated and sequenced. In some cases only DNA sequences will be available without knowing which part of the sequence is protein coding. Then DNA sequence is translated into amino acid sequence in all reading frames.
4. Choose MHC allele. Decide on needed MHC allele population coverage. If a broad coverage of a given population is needed (i.e. when a generally applicable reagent is sought) the most frequently expressed MHC alleles by the population of interest may be chosen e.g. using the database www.allelefrequencies.net/test/default1.asp or epitope.liai.org:8080/tools/population/iedb_input.

In case of personalized medicine the patient is tissue typed (HLA type) and then MHC alleles may be selected according to that.
5. Run the general peptide epitope generator program described elsewhere herein on all selected amino acid sequences from step 3, thereby generating all possible epitopes of defined length (8, 9, 10 and/or 11'mers). This procedure is particularly useful when the amino acid sequence is derived from a DNA sequence not knowing the protein encoding areas.
6. If searching for broadly applicable epitope sequences, a good alternative to step 5 is to run the "intelligent" peptide epitope prediction programs on the selected amino acid sequences of step 3 using the selected MHC alleles from step 4 e.g. using epitope prediction programs like www.syfpeithi.de/, www.cbs.dtu.dk/services/NetMHC/, and www.cbs.dtu.dk/services/NetMHCII/.
7. If searching for broadly applicable epitope sequences, select the best peptide epitopes (the epitopes with highest binding score) for the chosen MHC alleles and run them through the BLAST program (www.ncbi.nlm.nih.gov/blast/Blast.cgi) to validate the uniqueness of the peptides. If the peptide sequences are present in other species, evaluate the potential risk of disease states caused by the non-relevant species in relation to causing false positive results. If considered being a potential problem for evaluating the future analysis outcome, leave out the peptide. In general, favour unique peptide sequences only present in the selected protein.
8. Make selected peptides as described elsewhere herein, and optionally test for binding to the desired MHC alleles by e.g in vitro folding, peptide exchange of already preloaded MHC complexes or another method able to test of peptide binding to MHC I or II molecules.

9. Generate desired MHC multimer as described elsewhere herein and test efficacy in detecting specific T-cells using methods described in the section "Detection".

The MHC multimer reagents may be used in a diagnostic procedure or kit for testing patient and control samples e.g. by flow cytometry, immune histochemistry, Elispot or other methods as described herein.

How to Make a MHC Multimer Therapeutic Reagent

1. As step 1-8 above for diagnostic reagent.
9. Select additional molecules (e.g. biologically active molecules, toxins) to attach to the MHC multimer as described elsewhere herein. The additional molecules can have different functionalities as e.g. adjuvants, specific activators, toxins etc.
10. Test the therapeutic reagent following general guidelines
11. Use for therapy Processes Involving MHC Multimers Thus, the present invention relates to methods for detecting the presence of MHC recognising cells in a sample comprising the steps of
(a) providing a sample suspected of comprising MHC recognising cells,
(b) contacting the sample with a MHC multimer as defined above, and
(c) determining any binding of the MHC multimer, which binding indicates the presence of MHC recognising cells.

Such methods are a powerful tool in diagnosing various diseases. Establishing a diagnosis is important in several ways. A diagnosis gives information about the disease, thus the patient can be offered a suitable treatment regime. Also, establishing a more specific diagnosis may give important information about a subtype of a disease for which a particular treatment will be beneficial (i.e. various subtypes of diseases may involve display of different peptides which are recognised by MHC recognising cells, and thus treatment can be targeted effectively against a particular subtype). In this way, it may also be possible to gain information about aberrant cells, which emerge through the progress of the disease or condition, or to investigate whether and how T-cell specificity is affected. The binding of the MHC multimer makes possible these options, since the binding is indicative for the presence of the MHC recognising cells in the sample, and accordingly the presence of MHC multimeres displaying the peptide.

The present invention also relates to methods for monitoring MHC recognising cells comprising the steps of
(a) providing a sample suspected of comprising MHC recognising cells,
(b) contacting the sample with a MHC complex as defined above, and
(c) determining any binding of the MHC multimer, thereby monitoring MHC recognising cells.

Such methods are a powerful tool in monitoring the progress of a disease, e.g. to closely follow the effect of a treatment. The method can i.a. be used to manage or control the disease in a better way, to ensure the patient receives the optimum treatment regime, to adjust the treatment, to confirm remission or recurrence, and to ensure the patient is not treated with a medicament which does not cure or alleviate the disease. In this way, it may also be possible to monitor aberrant cells, which emerge through the progress of the disease or condition, or to investigate whether and how T-cell specificity is affected during treatment. The binding of the MHC multimer makes possible these options, since the binding is indicative for the presence of the MHC recognising cells in the sample, and accordingly the presence of MHC multimers displaying the peptide.

The present invention also relates to methods for establishing a prognosis of a disease involving MHC recognising cells comprising the steps of
(a) providing a sample suspected of comprising MHC recognising cells,
(b) contacting the sample with a MHC multimer as defined above, and
(c) determining any binding of the MHC multimer, thereby establishing a prognosis of a disease involving MHC recognising cells.

Such methods are a valuable tool in order to manage diseases, i.a. to ensure the patient is not treated without effect, to ensure the disease is treated in the optimum way, and to predict the chances of survival or cure. In this way, it may also be possible to gain information about aberrant cells, which emerge through the progress of the disease or condition, or to investigate whether and how T-cell specificity is affected, thereby being able to establish a prognosis. The binding of the MHC multimer makes possible these options, since the binding is indicative for the presence of the MHC recognising cells in the sample, and accordingly the presence of MHC complexes displaying the peptide.

The present invention also relates to methods for determining the status of a disease involving MHC recognising cells comprising the steps of
(a) providing a sample suspected of comprising MHC recognising cells,
(b) contacting the sample with a MHC complex as defined above, and
(c) determining any binding of the MHC complex, thereby determining the status of a disease involving MHC recognising cells.

Such methods are a valuable tool in managing and controlling various diseases. A disease could, e.g. change from one stage to another, and thus it is important to be able to determine the disease status. In this way, it may also be possible to gain information about aberrant cells which emerge through the progress of the disease or condition, or to investigate whether and how T-cell specificity is affected, thereby determining the status of a disease or condition. The binding of the MHC complex makes possible these options, since the binding is indicative for the presence of the MHC recognising cells in the sample, and accordingly the presence of MHC complexes displaying the peptide.

The present invention also relates to methods for the diagnosis of a disease involving MHC recognising cells comprising the steps of
(a) providing a sample suspected of comprising MHC recognising cells,
(b) contacting the sample with a MHC multimer as defined above, and
(c) determining any binding of the MHC multimer, thereby diagnosing a disease involving MHC recognising cells.

Such diagnostic methods are a powerful tool in the diagnosis of various diseases. Establishing a diagnosis is important in several ways. A diagnosis gives information about the disease, thus the patient can be offered a suitable treatment regime. Also, establishing a more specific diagnosis may give important information about a subtype of a disease for which a particular treatment will be beneficial (i.e. various subtypes of diseases may involve display of different peptides which are recognised by MHC recognising cells, and thus treatment can be targeted effectively against a particular subtype). Valuable information may also be obtained about aberrant cells emerging through the progress of the disease or condition as well as whether and how T-cell specificity is affected. The binding of the MHC multimer makes possible these options, since the binding is indicative for the presence of the MHC recognising cells in the sample, and accordingly the presence of MHC multimers displaying the peptide.

The present invention also relates to methods of correlating cellular morphology with the presence of MHC recognising cells in a sample comprising the steps of
(a) providing a sample suspected of comprising MHC recognising cells,
(b) contacting the sample with a MHC multimer as defined above, and
(c) determining any binding of the MHC multimer, thereby correlating the binding of the MHC multimer with the cellular morphology.

Such methods are especially valuable as applied in the field of histochemical methods, as the binding pattern and distribution of the MHC multimeres can be observed directly. In such methods, the sample is treated so as to preserve the morphology of the individual cells of the sample. The information gained is important i.a. in diagnostic procedures as sites affected can be observed directly.

The present invention also relates to methods for determining the effectiveness of a medicament against a disease involving MHC recognising cells comprising the steps of
(a) providing a sample from a subject receiving treatment with a medicament,
(b) contacting the sample with a as defined herein, and
(c) determining any binding of the MHC multimer, thereby determining the effectiveness of the medicament.

Such methods are a valuable tool in several ways. The methods may be used to determine whether a treatment is effectively combating the disease. The method may also provide information about aberrant cells which emerge through the progress of the disease or condition as well as whether and how T-cell specificity is affected, thereby providing information of the effectiveness of a medicament in question. The binding of the MHC multimer makes possible these options, since the binding is indicative for the presence of the MHC recognising cells in the sample, and accordingly the presence of MHC multimeres displaying the peptide.

The present invention also relates to methods for manipulating MHC recognising cells populations comprising the steps of
(a) providing a sample comprising MHC recognising cells,
(b) contacting the sample with a MHC multimer immobilised onto a solid support as defined above,
(c) isolating the relevant MHC recognising cells, and
(d) expanding such cells to a clinically relevant number, with or without further manipulation.

Such ex vivo methods are a powerful tool to generate antigen-specific, long-lived human effector T-cell populations that, when re-introduced to the subject, enable killing of target cells and has a great potential for use in immunotherapy applications against various types of cancer and infectious diseases.

As used everywhere herein, the term "MHC recognising cells" are intended to mean such which are able to recognise and bind to MHC multimeres. The intended meaning of "MHC multimeres" is given above. Such MHC recognising cells may also be called MHC recognising cell clones, target cells, target MHC recognising cells, target MHC molecule recognising cells, MHC molecule receptors, MHC receptors, MHC peptide specific receptors, or peptide-specific cells. The term "MHC recognising cells" is intended to include all subsets of normal, abnormal and defect cells, which recognise and bind to the MHC molecule. Actually, it is the receptor on the MHC recognising cell that binds to the MHC molecule.

As described above, in diseases and various conditions, peptides are displayed by means of MHC multimeres, which are recognised by the immune system, and cells targeting such MHC multimeres are produced (MHC recognising cells). Thus, the presence of such MHC protein recognising cells is a direct indication of the presence of MHC multimeres displaying the peptides recognised by the MHC protein recognising cells. The peptides displayed are indicative and may involved in various diseases and conditions.

For instance, such MHC recognising cells may be involved in diseases of inflammatory, auto-immune, allergic, viral, cancerous, infectious, allo- or xenogene (graft versus host and host versus graft) origin.

The MHC multimeres of the present invention have numerous uses and are a valuable and powerful tool e.g. in the fields of therapy, diagnosis, prognosis, monitoring, stratification, and determining the status of diseases or conditions. Thus, the MHC multimeres may be applied in the various methods involving the detection of MHC recognising cells.

Furthermore, the present invention relates to compositions comprising the MHC multimeres in a solubilising medium. The present invention also relates to compositions comprising the MHC multimeres immobilised onto a solid or semi-solid support.

The MHC multimers can be used in a number of applications, including analyses such as flow cytometry, immunohistochemistry (IHC), and ELISA-like analyses, and can be used for diagnostic, prognostic or therapeutic purposes including autologous cancer therapy or vaccines such as HIV vaccine or cancer vaccine.

The MHC multimeres are very suitable as detection systems. Thus, the present invention relates to the use of the MHC multimeres as defined herein as detection systems.

In another aspect, the present invention relates to the general use of MHC peptide complexes and multimers of such MHC peptide complexes in various methods. These methods include therapeutic methods, diagnostic methods, prognostic methods, methods for determining the progress and status of a disease or condition, and methods for the stratification of a patient.

The MHC multimeres of the present invention are also of value in testing the expected efficacy of medicaments against or for the treatment of various diseases. Thus, the present invention relates to methods of testing the effect of medicaments or treatments, the methods comprising detecting the binding of the MHC multimeres to MHC recognising cells and establishing the effectiveness of the medicament or the treatment in question based on the specificity of the MHC recognising cells.

As mentioned above, the present invention also relates generally to the field of therapy. Thus, the present invention relates per se to the MHC multimer as defined herein for use as medicaments, and to the MHC multimeres for use in in vivo and ex vivo therapy.

The present invention relates to therapeutic compositions comprising as active ingredients the MHC multimeres as defined herein.

An important aspect of the present invention is therapeutic compositions comprising as active ingredients effective amounts of MHC recognising cells obtained using the MHC multimeres as defined herein to isolate relevant MHC recognising cells, and expanding such cells to a clinically relevant number.

The present invention further relates to methods for treating, preventing or alleviating diseases, methods for inducing anergy of cells, as well as to methods for up-regulating, down-regulating, modulating, stimulating, inhibiting, restoring, enhancing and/or otherwise manipulating immune responses.

The invention also relates to methods for obtaining MHC recognising cells by using the MHC multimeres as described herein.

Also encompassed by the present invention are methods for preparing the therapeutic compositions of the invention.

The present invention is also directed to generating MHC multimeres for detecting and analysing receptors on MHC recognising cells, such as epitope specific T-cell clones or other immune competent effector cells.

It is a further object of the present invention to provide new and powerful strategies for the development of curative vaccines. This in turn will improve the possibilities for directed and efficient immune manipulations against diseases caused by tumour genesis or infection by pathogenic agent like viruses and bacteria. HIV is an important example. The ability to generate and optionally attach recombinant MHC multimeres to multimerization domains, such as scaffolds and/or carrier molecules, will enable the development of a novel analytical and therapeutic tool for monitoring immune responses and contribute to a rational platform for novel therapy and "vaccine" applications.

Therapeutic compositions (e.g. "therapeutical vaccines") that stimulate specific T-cell proliferation by peptide-specific stimulation is indeed a possibility within the present invention. Thus, quantitative analysis and ligand-based detection of specific T-cells that proliferate by the peptide specific stimulation should be performed simultaneously to monitoring the generated response.

For all of those applications, it is important to choose the right MHC allele as well as a peptide that binds well to the MHC protein. It is also important that the chosen MHC allele and peptide forms a MHC-peptide complex that is efficiently and specifically recognized by the TCR. For applications that involve binding as well as activation of cells, further restrictions on the choice of MHC and peptide can apply.

Application of MHC Multimers in Immune Monitoring, Diagnostics, Therapy, Vaccine MHC multimers detect antigen specific T cells of the various T cell subsets. T cells are pivotal for mounting an adaptive immune response. It is therefore of importance to be able to measure the number of specific T cells when performing a monitoring of a given immune response. Typically, the adaptive immune response is monitored by measuring the specific antibody response, which is only one of the effector arms of the immune system. This can lead to miss-interpretation of the actual clinical immune status.

In many cases intruders of the organism can hide away inside the cells, which can not provoke a humoral response. In other cases, e.g. in the case of certain viruses the intruder mutates fast, particularly in the genes encoding the proteins that are targets for the humoral response. Examples include the influenza and HIV viruses. The high rate of mutagenesis renders the humoral response unable to cope with the infection. In these cases the immune system relies on the cellular immune response. When developing vaccines against such targets one needs to provoke the cellular response in order to get an efficient vaccine.

Developing vaccines that should give rise to lifelong protection is another case where the cellular immune system needs to be activated. Commonly, various childhood vaccines are expected to give lifelong protection but will only come to trial many years after the vaccination has been performed and then there is only to hope that it actually have created effective immunity.

Therapeutically cancer vaccines generally rely on cytotoxic effector T cells and have short duration of function. Therefore, continuous monitoring is important.

MHC multimers are therefore very important for immune monitoring of vaccine responses both during vaccine development, as a means to verify the obtained immunity for lifelong vaccines and to follow cancer patients under treatment with therapeutically cancer vaccines.

The number of antigen specific cytotoxic T cells can be used as surrogate markers for the overall wellness of the immune system. The immune system can be compromised severely by natural causes such as HIV infections or big traumas or by immuno suppressive therapy in relation to transplantation. The efficacy of an anti HIV treatment can be evaluated by studying the number of common antigen-specific cytotoxic T cells, specific against for example Cytomegalovirus (CMV) and Epstein-Barr virus. In this case the measured T cells can be conceived as surrogate markers. The treatment can then be corrected accordingly and a prognosis can be made.

A similar situation is found for patients undergoing transplantation as they are severely immune compromised due to pharmaceutical immune suppression to avoid organ rejection. The suppression can lead to outbreak of opportunistic infections caused by reactivation of otherwise dormant viruses residing in the transplanted patients or the grafts. This can be the case for CMV and EBV viruses. Therefore measurement of the number of virus specific T cells can be used to give a prognosis for the outcome of the transplantation and adjustment of the immune suppressive treatment. Similarly, the BK virus has been implied as a causative reagent for kidney rejection. Therefore measurement of BK-virus specific T cells can have prognostic value.

In relation to transplantation, the presence of specific T cells directed against minor histocompatibility antigens (mHAgs) are important as they can cause graft versus host reaction/disease that can develop to a fatal situation for the patient. Again, a well-adjusted immune suppressive treatment is important. A similar reaction denoted graft versus cancer is sometimes employed in the treatment of malignancies of the lymphoid system. It is evident that such treatment is balancing on the edge of a knife and will benefit of specific measurement of relevant effector T cells.

Due to lack of organs, transplantations across greater mismatches are increasingly making harsher immune suppressive treatment more common. This calls for more efficient methods to monitor the immune status of the patient so that corrective measures in the treatment can be applied in due cause.

MHC multimers can be of importance in diagnosis of infections caused by bacteria, virus and parasites that hide away inside cells. Serum titers can be very low and direct measurement of the disease-causing organisms by PCR can be very difficult because the host cells are not identified or are inaccessible. Other clinical symptoms of a chronical infection can be unrecognizable in an otherwise healthy individuals, even though such persons still are disease-carriers and at risk of becoming spontaneously ill if being compromised by other diseases or stress. Likewise, cancers can also be diagnosed early in its development if increased numbers of cancer specific T cells can be measured in circulation, even though the tumor is not yet localized.

Antigen specific tumor infiltrating lymphocytes can be used to identify tumor lesions and metastases as the antigen specific T cells will migrate/home to the tumor site to exert their help or immuno modulatory action (CD4+ T helper cells) or cytotoxic killing of tumor cells expressing the tumor specific/tumor associated peptide MHC multimer (CD8+ T-cells). Likewise identification of sites of infection tumor lesions can be identified as they typically attract antigen specific T-cells.

Localization of tumors and sites of infection can be carried out using antigen specific T-cells labelled with a paramagnetic isotope in conjunction with magnetic resonance imaging (MRI) or electron spin resonance (ESR). In general, any conventional method for diagnostic imaging visualization can be utilized. Usually gamma and positron emitting radioisotopes are used for camera and paramagnetic isotopes for MRI.

For peripheral cancer lesion in skin (e.g. melanoma) fluorescently labeled antigen specific T-cells can be used likewise.

MHC multimers may be used to label the tumor infiltration lymphocytes, e.g. MHC multimers may be labeled with a paramagnetic isotope are injected into the patient, the labeled MHC multimer binds specific T cells and are then internalized thereby introducing the paragmagnetic isotope to the T cell in this way labelling the T cell.

Antigen-specific T helper cells and regulatory T cells have been implicated in the development of autoimmune disorders. In most cases the timing of events leading to autoimmune disease is unknown and the exact role of the immune cells not clear. Use of MHC multimers to study these diseases will lead to greater understanding of the disease-causing scenario and make provisions for development of therapies and vaccines for these diseases.

Therapeutically use of MHC multimers can be possible, either directly or as part of therapeutically vaccines. When performing autologous cancer therapy it is often recognized that the in vitro amplified cancer-specific effector T cells do not home effectively to the correct target sites but ends up in the lungs. If the molecules responsible for interaction with the correct homing receptor can be identified these can be added to the MHC multimer making a dual, triple or multiple molecular structure that are able to aid the antigen-specific T cells home to the correct target, as the MHC multimer will bind to the specific T cell and the additional molecules will mediate binding to the target cells.

In a preferable embodiment, MHC multimers bound to other functional molecules are employed to directly block, regulate or kill these cells.

When it become possible to identify and pinpoint the exact function of regulatory T cells it may be possible to directly block, regulate or kill these cells by means of MHCmers bound other functional molecules. The MHC multimeres specifically recognize the target T cells and direct the action of the other molecules to the target.

Derivatives of MHC multimers can be useful as vaccines, as vaccine components or as engineered intelligent adjuvant. The possibility of combining MHC multimeres that specifically bind certain T cells with molecules that trigger, e.g. the humoral response or the innate immune response, can accelerate vaccine development and improve the efficiency of vaccines.

Diseases

In relation to the use and application of MHCmers in immune monitoring, diagnostics, prognostics, therapy and vaccines in relation to diseases several organisms and human proteins are of relevance, comprising but not limited to the following;

Infectious Diseases a) caused by virus such as,
Adenovirus (subgropus A-F), BK-virus, CMV (Cytomegalo virus, HHV-5), EBV (Epstein Barr Virus, HHV-4), HBV (Hepatitis B Virus), HCV (Hepatitis C virus), HHV-6a and b (Human Herpes Virus-6a and b), HHV-7, HHV-8, HSV-1 (Herpes simplex virus-1, HHV-1), HSV-2 (HHV-2), JC-virus, SV-40 (Simian virus 40), VZV (Varizella-Zoster-Virus, HHV-3), Parvovirus B19, *Haemophilus influenza*, HIV-1 (Human immunodeficiency Virus-1), HTLV-1 (Human T-lymphotrophic virus-1), HPV (Human Papillomavirus giving rise to clinical manifestions such as Hepatitis, AIDS, Measles, Pox, Chicken pox, Rubella, Herpes and others b) caused by bacteria such as,
Gram positive bacteria, gram negative bacteria, intracellular bacterium, extracellular bacterium, *Mycobacterium tuberculosis, Mycobacterium bovis, Mycobacterium avium* subsp. paratuberculosis *Borrelia burgdorferi*, other spirochetes, *Helicobacter pylori, Streptococcus pneumoniae, Listeria monocytogenes, Histoplasma capsulatum, Bartonella henselae, Bartonella quintana* giving rise to clinical manifestations such as Tuberculosis, Pneumonia, Stomach ulcers, Paratuberculosis and others c) caused by fungus such as,
*Aspergillus fumigatus, Candida albicans, Cryptococcus neoformans, Pneumocystis carinii* giving rise to clinical manifestations such as skin-, nail-, and mucosal infections, Meningitis, Sepsis and others Parasitic diseases caused by parasites such as,
*Plasmodium falciparum, Plasmodium vivax, Plasmodium malariae, Schistosoma mansoni, Schistosoma japonicum, Schistosoma haematobium, Trypanosoma cruzi, Trypanosoma rhodesiense, Trypanosoma gambiense, Leishmania donovani, Leishmania tropica* giving rise to clinical manifestations such as Allergic diseases caused by allergens such as,
Birch, Hazel, Elm, Ragweed, Wormwood, Grass, Mould, Dust Mite giving rise to clinical manifestations such as Asthma Transplantation related disease caused by
reactions to minor histocompatibility antigens such as HA-1, HA-8, USP9Y, SMCY, TPR-protein, HB-1Y and other antigens in relation to, Graft-versus-host-related disease, allo- or xenogene reactions i.e. graft-versus-host and host-versus-graft disease.

Cancerous diseases associated with antigens such as
Survivin, Survivin-2B, Livin/ML-IAP, Bcl-2, Mcl-1, Bcl-X (L), Mucin-1, NY-ESO-1, Telomerase, CEA, MART-1, HER-2/neu, bcr-abl, PSA, PSCA, Tyrosinase, p53, hTRT, Leukocyte Proteinase-3, hTRT, gp100, MAGE antigens, GASC, JMJD2C, JARD2 (JMJ), JHDM3a, WT-1, CA 9, Protein kinases, in relation to clinical manifestations such as malignant melanoma, renal carcinoma, breast cancer, lung cancer, cancer of the uterus, cervical cancer, prostatic cancer, pancreatic cancer, brain cancer, head and neck cancer, leukemia, cutaneous lymphoma, hepatic carcinoma, colorectal cancer, bladder cancer Autoimmune and inflammatory diseases, associated with antigens such as GAD64, Collagen, human cartilage glycoprotein 39, □-amyloid, A□42, APP, Presenilin 1, in relation to clinical manifestations such as Diabetes type 1, Rheumatoid arthritis, Alzheimer, chronic inflammatory bowel disease, Crohn's disease, ulcerative colitis uterosa, Multiple Sclerosis, Psoriasis Approaches to the Analysis or Treatment of Diseases.

For each application of a MHC multimer, a number of choices must be made. These include:
- A. Disease (to be e.g. treated, prevented, diagnosed, monitored).
- B. Application (e.g. analyze by flow cytometry, isolate specific cells, induce an immune response)
- C. Label (e.g. should the MHC multimer be labelled with a fluorophore or a chromophore)
- D. Biologically active molecule (e.g. should a biologically active molecule such as an interleukin be added or chemically linked to the complex)
- E. Peptide (e.g. decide on a peptide to be complexed with MHC)
- F. MHC (e.g. use a MHC allele that does not interfere with the patient's immune system in an undesired way).

A number of diseases $A_1$-$A_n$, relevant in connection with MHC multimeres, have been described herein; a number of applications $B_1$-$B_n$, relevant in connection with MHC multimeres, have been described herein; a number of Labels $C_1$-$C_n$, relevant in connection with MHC multimeres, have been described herein; a number of biologically active molecules $D_1$-$D_n$, relevant in connection with MHC multimeres, have been described herein; a number of peptides $E_1$-$E_n$, relevant in connection with MHC multimeres, have been described herein; and a number of MHC molecules $F_1$-$F_n$, relevant in connection with MHC multimeres, have been described herein.

Thus, each approach involves a choice to be made regarding all or some of the parameters A-F. A given application and the choices it involves can thus be described as follows:

$$Ai \times Bi \times Ci \times Di \times Ei \times Fi$$

Where i specifies a number between 1 and n. n is different for different choices A, B, C, D, E, or F. Consequently, the present invention describes a large number of approaches to the diagnosis, monitoring, prognosis, therapeutic or vaccine treatment of diseases. The total number of approaches, as defined by these parameters, are $$n(A) \times n(B) \times n(C) \times n(D) \times n(E) \times n(F),$$

where n(A) describes the number of different diseases A described herein, n(B) describes the number of different applications B described herein, etc.

Detection

Diagnostic procedures, immune monitoring and some therapeutic processes all involve identification and/or enumeration and/or isolation of antigen specific T cells. Identification and enumeration of antigen specific T cells may be done in a number of ways, and several assays are currently employed to provide this information.

In the following it is described how MHC multimers as described in the present invention can be used to detect specific T cell receptors (TCRs) and thereby antigen specific T cells in a variety of methods and assays. In the present invention detection includes detection of the presence of antigen specific T cell receptors/T cells in a sample, detection of and isolation of cells or entities with antigen specific T cell receptor from a sample and detection and enrichment of cells or entities with antigen specific T cell receptor in a sample.

The sample may be a biologic sample including solid tissue, solid tissue section or a fluid such as, but not limited to, whole blood, serum, plasma, nasal secretions, sputum, urine, sweat, saliva, transdermal exudates, pharyngeal exudates, bronchoalveolar lavage, tracheal aspirations, cerebrospinal fluid, synovial fluid, fluid from joints, vitreous fluid, vaginal or urethral secretions, or the like. Herein, disaggregated cellular tissues such as, for example, hair, skin, synovial tissue, tissue biopsies and nail scrapings are also considered as biological samples.

Many of the assays are particularly useful for assaying T-cells in blood samples. Blood samples are whole blood samples or blood processed to remove erythrocytes and platelets (e.g., by Ficoll density centrifugation or other such methods known to one of skill in the art) and the remaining PBMC sample, which includes the T-cells of interest, as well as B-cells, macrophages and dendritic cells, is used directly.

In order to be able to measure detection of specific T cells by MHC multimers, labels and marker molecules can be used.

Marker Molecules

Marker molecules are molecules or complexes of molecules that bind to other molecules. Marker molecules thus may bind to molecules on entities, including the desired entities as well as undesired entities. Labeling molecules are molecules that may be detected in a certain analysis, i.e. the labeling molecules provide a signal detectable by the used method. Marker molecules, linked to labeling molecules, constitute detection molecules. Likewise labeling molecules linked to MHC multimers also constitute detection molecules but in contrast to detection molecules made up of marker and labeling molecule labeled MHC multimers are specific for TCR.

Sometimes a marker molecule in itself provides a detectable signal, wherefore attachment to a labeling molecule is not necessary.

Marker molecules are typically antibodies or antibody fragments but can also be aptamers, proteins, peptides, small organic molecules, natural compounds (e.g. steroids), non-peptide polymers, or any other molecules that specifically and efficiently bind to other molecules are also marker molecules.

Labelling Molecules

Labelling molecules are molecules that can be detected in a certain analysis, i.e. the labelling molecules provide a signal detectable by the used method. The amount of labelling molecules can be quantified.

The labelling molecule is preferably such which is directly or indirectly detectable.

The labelling molecule may be any labelling molecule suitable for direct or indirect detection. By the term "direct" is meant that the labelling molecule can be detected per se without the need for a secondary molecule, i.e. is a "primary" labelling molecule. By the term "indirect" is meant that the labelling molecule can be detected by using one or more "secondary" molecules, i.e. the detection is performed by the detection of the binding of the secondary molecule(s) to the primary molecule.

The labelling molecule may further be attached via a suitable linker. Linkers suitable for attachment to labelling molecules would be readily known by the person skilled in the art and as described elsewhere herein for attachment of MHC molecules to multimerisation domains.

Examples of such suitable labelling compounds are fluorescent labels, enzyme labels, radioisotopes, chemiluminescent labels, bioluminescent labels, polymers, metal particles, haptens, antibodies, and dyes.

The labelling compound may suitably be selected: from fluorescent labels such as 5-(and 6)-carboxyfluorescein, 5- or 6-carboxyfluorescein, 6-(fluorescein)-5-(and 6)-carboxamido hexanoic acid, fluorescein isothiocyanate (FITC), rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeton Red, Green fluorescent protein (GFP) and analogues thereof, and conjugates of R-phycoerythrin or allophycoerythrin and e.g. Cy5 or Texas Red, and inorganic fluorescent labels based on semiconductor nanocrystals (like quantum dot and Qdot™ nanocrystals), and time-resolved fluorescent labels based on lanthanides like Eu3+ and Sm3+, from haptens such as DNP, biotin, and digoxiginin, from enzymic labels such as horse radish peroxidase (HRP), alkaline phosphatase (AP), beta-galactosidase (GAL), glucose-6-phosphate dehydrogenase, beta-N-acetylglucosaminidase, β-glucuronidase, invertase, Xanthine Oxidase, firefly luciferase and glucose oxidase (GO), from luminescence labels such as luminol, isoluminol, acridinium esters, 1,2-dioxetanes and pyridopyridazines, and from radioactivity labels such as incorporated isotopes of iodide, cobalt, selenium, tritium, and phosphor.

Radioactive labels may in particular be interesting in connection with labelling of the peptides harboured by the MHC multimeres.

Different principles of labelling and detection exist, based on the specific property of the labelling molecule. Examples of different types of labelling are emission of radioactive radiation (radionuclide, isotopes), absorption of light (e.g. dyes, chromophores), emission of light after excitation (fluorescence from fluorochromes), NMR (nuclear magnetic resonance form paramagnetic molecules) and reflection of light (scatter from e.g. such as gold-, plastic- or glass-beads/particles of various sizes and shapes). Alternatively, the labelling molecules can have an enzymatic activity, by which they catalyze a reaction between chemicals in the near environment of the labelling molecules, producing a signal, which include production of light (chemi-luminescence), precipitation of chromophor dyes, or precipitates that can be detected by an additional layer of detection molecules. The enzymatic product can deposit at the location of the enzyme or, in a cell based analysis system, react with the membrane of the cell or diffuse into the cell to which it is attached. Examples of labelling molecules and associated detection principles are shown in table 2 below.

TABLE 2

Examples of labelling molecules and associated detection principles.

| Labelling substance | Effect | Assay-principle |
|---|---|---|
| Fluorochromes | emission of light having a specific spectra | □Photometry, Microscopy, spectroscopy PMT, photographic film, CCD's (Color-Capture Device or Charge-coupled device). |
| Radionuclide | irradiation, α, β or gamma rays | Scintillation counting, GM-tube, photographic film, excitation of phosphor-imager screen |
| Enzyme; HRP, (horse reddish peroxidase), | catalysis of $H_2O_2$ reduction using luminol as Oxygen acceptor, resulting | □Photometry, Microscopy, spectroscopy PMT, photographic |

TABLE 2-continued

Examples of labelling molecules and associated detection principles.

| Labelling substance | Effect | Assay-principle |
|---|---|---|
| peroxidases in general | in oxidized luminal + light catalysis of $H_2O_2$ reduction using a soluble dye, or molecule containing a hapten, such as a biotin residue as Oxygen acceptor, resulting in precipitation. The habten can be recognized by a detection molecule. | film, CCD's (Colour-Capture Device or Charge-coupled device), Secondary label linked antibody |
| Particles; gold, polystyrene beads, pollen and other particles | Change of scatter, reflection and transparency of the associated entity | Microscopy, cytometry, electron microscopy PMT's, light detecting devices, flowcytometry scatter |
| AP (Alkaline Phosphatase) | Catalyze a chemical conversion of a non-detectable to a precipitated detectable molecule, such as a dye or a hapten | □Photometry, Microscopy, spectroscopy Secondary label linked antibody |
| Ionophores or chelating chemical compounds binding to specific ions, e.g. $Ca^{2+}$ | Change in absorption and emission spectrums when binding. Change in intensity | □Photometry, Cytometry, spectroscopy |
| Lanthanides | Fluorescence Phosphorescence | □photometry, cytometry, spectroscopy |
|  | Paramagnetic | NMR (Nuclear magnetic resonance) |
| DNA fluorescing stains | Propidium iodide Hoechst stain DAPI AMC DraQ5 ™ Acridine orange 7-AAD | □Photometry, cytometry, spectroscopy |

□Photometry; is to be understood as any method that can be applied to detect the intensity, analyze the wavelength spectra, and or measure the accumulation of light derived form a source emitting light of one or multiple wavelength or spectra.

Labelling molecules can be used to label MHC multimers as well as other reagents used together with MHC multimers, e.g. antibodies, aptamers or other proteins or molecules able to bind specific structures in another protein, in sugars, in DNA or in other molecules. In the following molecules able to bind a specific structure in another molecule are named a marker. Labelling molecules can be attached to a given MHC multimer or any other protein marker by covalent linkage as described for attachment of MHC multimeres to multimerization domains elsewhere herein. The attachment can be directly between reactive groups in the labelling molecule and reactive groups in the marker molecule or the attachment can be through a linker covalently attached to labelling molecule and marker, both as described elsewhere herein. When labelling MHC multimers the label can be attached either to the MHC complex (heavy chain, β2m or peptide) or to the multimerization domain.

In particular, one or more labelling molecules may be attached to the carrier molecule, or one or more labelling molecules may be attached to one or more of the scaffolds, or one or more labelling compounds may be attached to one or more of the MHC complexes, or one or more labelling compounds may be attached to the carrier molecule and/or one or more of the scaffolds and/or one or more of the MHC complexes, or one or more labelling compounds may be attached to the peptide harboured by the MHC molecule.

A single labelling molecule on a marker does not always generate sufficient signal intensity. The signal intensity can be improved by assembling single label molecules into large multi-labelling compounds, containing two or more label molecule residues. Generation of multi-label compounds can be achieved by covalent or non-covalent, association of labelling molecules with a major structural molecule. Examples of such structures are synthetic or natural polymers (e.g. dextramers), proteins (e.g. streptavidin), or polymers. The labelling molecules in a multi-labelling compound can all be of the same type or can be a mixture of different labelling molecules.

In some applications, it may be advantageous to apply different MHC complexes, either as a combination or in individual steps. Such different MHC multimeres can be differently labelled (i.e. by labelling with different labelling compounds) enabling visualisation of different target MHC recognising cells. Thus, if several different MHC multimeres with different labelling compounds are present, it is possible simultaneously to identify more than one specific receptor, if each of the MHC multimeres present a different peptide.

Detection principles, such as listed in Table 2, can be applied to flow cytometry, stationary cytometry, and batch-based analysis. Most batch-based approaches can use any of the labelling substances depending on the purpose of the assay. Flow cytometry primarily employs fluorescence, whereas stationary cytometry primarily employs light absorption, e.g. dyes or chromophore deposit from enzymatic activity. In the following section, principles involving fluorescence detection will be exemplified for flow cytometry, and principles involving chromophore detection will be exemplified in the context of stationary cytometry. However, the labelling molecules can be applied to any of the analyses described in this invention.

Labelling molecules of particular utility in Flow Cytometry:

In flow cytometry the typical label is detected by its fluorescence. Most often a positive detection is based on the presents of light from a single fluorochrome, but in other techniques the signal is detected by a shift in wavelength of emitted light; as in FRET based techniques, where the exited fluorochrome transfer its energy to an adjacent bound fluorochrome that emits light, or when using $Ca^{2+}$ chelating fluorescent props, which change the emission (and absorption) spectra upon binding to calcium.

Preferably labelling molecules employed in flow cytometry are illustrated in Table 3 and 4 and described in the following.

Simple fluorescent labels:
Fluor dyes, Pacific Blue™, Pacific Orange™, Cascade Yellow™,
AlexaFluor® (AF);
AF405, AF488, AF500, AF514, AF532, AF546, AF555, AF568, AF594, AF610, AF633, AF635, AF647, AF680, AF700, AF710, AF750, AF800
Quantum Dot based dyes, QDot® Nanocrystals (Invitrogen, MolecularProbs)
Qdot®525, Qdot®565, Qdot®585, Qdot®605, Qdot®655, Qdot®705, Qdot®800

DyLight™ Dyes (Pierce) (DL);
DL549, DL649, DL680, DL800
Fluorescein (Flu) or any derivate of that, ex. FITC
Cy-Dyes
Cy2, Cy3, Cy3.5, Cy5, Cy5.5, Cy7
Fluorescent Proteins;
RPE, PerCp, APC
Green fluorescent proteins;
GFP and GFP derivated mutant proteins; BFP, CFP, YFP, DsRed, T1, Dimer2, mRFP1, MBanana, mOrange, dTomato, tdTomato, mTangerine, mStrawberry, mCherry
Tandem dyes:
RPE-Cy5, RPE-Cy5.5, RPE-Cy7, RPE-AlexaFluor® tandem conjugates; RPE-Alexa610, RPE-TxRed
APC-Aleca600, APC-Alexa610, APC-Alexa750, APC-Cy5, APC-Cy5.5
Ionophors; ion chelating fluorescent props
Props that change wavelength when binding a specific ion, such as Calcium Props that change intensity when binding to a specific ion, such as Calcium
Combinations of fluorochromes on the same marker. Thus, the marker is not identified by a single fluorochrome but by a code of identification being a specific combination of fluorochromes, as well as inter related ratio of intensities.
Example: Antibody Ab1 and Ab2, are conjugated to both. FITC and BP but Ab1 have 1 FITC to 1 BP whereas Ab2 have 2 FITC to 1 BP. Each antibody may then be identified individually by the relative intensity of each fluorochrome. Any such combinations of n fluorochromes with m different ratios can be generated.

TABLE 3

Examples of preferable fluorochromes

| Fluorofor/Fluorochrome | Excitation nm | Emission nm |
|---|---|---|
| 2-(4'-maleimidylanilino)naphthalene-6-sulfonic acid, sodium salt | 322 | 417 |
| 5-((((2-iodoacetyl)amino)ethyl)amino) naphthalene-1-sulfonic acid | 336 | 490 |
| Pyrene-1-butanoic acid | 340 | 376 |
| AlexaFluor 350 (7-amino-6-sulfonic acid-4-methyl coumarin-3-acetic acid) | 346 | 442 |
| AMCA (7-amino-4-methyl coumarin-3-acetic acid) | 353 | 442 |
| 7-hydroxy-4-methyl coumarin-3-acetic acid | 360 | 455 |
| Marina Blue (6,8-difluoro-7-hydroxy-4-methyl coumarin-3-acetic acid) | 362 | 459 |
| 7-dimethylamino-coumarin-4-acetic acid | 370 | 459 |
| Fluorescamin-N-butyl amine adduct | 380 | 464 |
| 7-hydroxy-coumarine-3-carboxylic acid | 386 | 448 |
| CascadeBlue (pyrene-trisulphonic acid acetyl azide) | 396 | 410 |
| Cascade Yellow | 409 | 558 |
| Pacific Blue (6,8 difluoro-7-hydroxy coumarin-3-carboxylic acid) | 416 | 451 |
| 7-diethylamino-coumarin-3-carboxylic acid | 420 | 468 |
| N-(((4-azidobenzoyl)amino)ethyl)-4-amino-3,6-disulfo-1,8-naphthalimide, dipotassium salt | 426 | 534 |
| Alexa Fluor 430 | 434 | 539 |
| 3-perylenedodecanoic acid | 440 | 448 |
| 8-hydroxypyrene-1,3,6-trisulfonic acid, trisodium salt | 454 | 511 |
| 12-(N-(7-nitrobenz-2-oxa-1,3-diazol-4-yl)amino)dodecanoic acid | 467 | 536 |
| N,N'-dimethyl-N-(iodoacetyl)-N'-(7-nitrobenz-2-oxa-1,3-diazol-4-yl)ethylenediamine | 478 | 541 |
| Oregon Green 488 (difluoro carboxy fluorescein) | 488 | 518 |
| 5-iodoacetamidofluorescein | 492 | 515 |
| propidium iodide-DNA adduct | 493 | 636 |
| Carboxy fluorescein | 495 | 519 |

TABLE 4

Examples of preferable fluorochrome families

| Fluorochrome family | Example fluorochrome |
|---|---|
| AlexaFluor ®(AF) | AF ®350, AF405, AF430, AF488, AF500, AF514, AF532, AF546, AF555, AF568, AF594, AF610, AF633, AF635, AF647, AF680, AF700, AF710, AF750, AF800 |
| Quantum Dot (Qdot ®) based dyes | Qdot ®525, Qdot ®565, Qdot ®585, Qdot ®605, Qdot ®655, Qdot ®705, Qdot ®800 |
| DyLight ™ Dyes (DL) | DL549, DL649, DL680, DL800 |
| Small fluorescing dyes | FITC, Pacific Blue ™, Pacific Orange ™, Cascade Yellow ™, Marina blue ™, DSred, DSred-2, 7-AAD, TO-Pro-3, |
| Cy-Dyes | Cy2, Cy3, Cy3.5, Cy5, Cy5.5, Cy7 |
| Phycobili Proteins: | R-Phycoerythrin (RPE), PerCP, Allophycocyanin (APC), B-Phycoerythrin, C-Phycocyanin |
| Fluorescent Proteins | (E)GFP and GFP ((enhanced) green fluorescent protein) derived mutant proteins; BFP, CFP, YFP, DsRed, Ti, Dimer2, mRFP1,MBanana, mOrange, dTomato, tdTomato, mTangerine, mStrawberry, mCherry |
| Tandem dyes with RPE | RPE-Cy5, RPE-Cy5.5, RPE-Cy7, RPE-AlexaFluor ® tandem conjugates; RPE-Alexa610, RPE-TxRed |
| Tandem dyes with APC | APC-Aleca600, APC-Alexa610, APC-Alexa750, APC-Cy5, APC-Cy5.5 |
| Calcium dyes | Indo-1-Ca2+ Indo-2-Ca2+ |

Preferably Labelling Molecules Employed in Stationary Cytometry and IHC

Enzymatic labelling, as exemplified in Table 5:

Horse radish peroxidase; reduces peroxides ($H_2O_2$), and the signal is generated by the Oxygen acceptor when being oxidized.

Precipitating dyes; Dyes that when they are reduced they are soluble, and precipitate when oxidized, generating a coloured deposit at the site of the reaction.

Precipitating agent, carrying a chemical residue, a hapten, for second layer binding of marker molecules, for amplification of the primary signal.

Luminol reaction, generating a light signal at the site of reaction.

Other enzymes, such as Alkaline Phosphatase, capable of converting a chemical compound from a non-detectable molecule to a precipitated detectable molecule, which can be coloured, or carries a hapten as described above.

Fluorescent labels, as exemplified in Table 3 and 4; as those described for Flow cytometry are likewise important for used in stationary cytometry, such as in fluorescent microscopy.

TABLE 5

Examples of preferable labels for stationary cytometry

| Label | Enzyme substrate, Oxygen acceptor Chromogen/ precipitating agent | Precipitate or Residue, hapten* for secondary detection layer | Binding partner to hapten |
|---|---|---|---|
| HRP | diaminobenzidine (DAB) | Colored precipitate | — |
| HRP | 3-amino-9-ethyl-carbazole (AEC+) | Colored precipitate | — |
| AP | Fast red dye | Red precipitate | — |
| HRP | biotinyl tyramide | Exposed Biotin residue | Streptavidin, avidine |
| HRP | fluorescein tyramide | Exposed Fluorescein residue | Anti-Fluorecein Antibody |
| "Enzyme" | Substrate that when reacted precipitate | Primary label; being a dye, chemiluminescence's , or exposure of a hapten | Secondary label in case the primary label is a hapten |

Detection Methods and Principles

Detection of TCRs with multimers may be direct or indirect.

Direct Detection

Direct detection of TCRs is detection directly of the binding interaction between the specific T cell receptor and the MHC multimer. Direct detection includes detection of TCR when TCR is attached to lipid bilayer, when TCR is attached to or in a solid medium or when TCR is in solution.

Direct Detection of TCR Attached to Lipid Bilayer

One type of TCRs to detect and measure are TCRs attached to lipid bilayer including but is not limited to naturally occurring T cells (from blood, spleen, lymphnode, brain or any other tissue containing T cells), TCR transfected cells, T cell hybridomas, TCRs embedded in liposomes or any other membrane structure. In the following methods for direct detection of entities of TCRs attached to lipid bilayer will be described and any entity consisting of TCR attached to lipid bilayer will be referred to as T cells.

T cells can be directly detected either when in a fluid solution or when immobilized to a support.

Direct Detection of T Cells in Fluid Sample.

T cells can be detected in fluid samples as described elsewhere herein and in suspension of disrupted tissue, in culture media, in buffers or in other liquids. T cells in fluid samples can be detected individually or detected as populations of T cells. In the following different methods for direct detection of T cells in fluid samples are shown.

Direct Detection of Individual T Cells

Direct Detection of Individual T Cells Using Flow Cytometry.

A suspension of T cells are added MHC multimers, the sample washed and then the amount of MHC multimer bound to each cell are measured. Bound MHC multimers may be labelled directly or measured through addition of labelled marker molecules. The sample is analyzed using a flow cytometer, able to detect and count individual cells passing in a stream through a laser beam. For identification of specific T cells using MHC multimers, cells are stained with fluorescently labeled MHC multimer by incubating cells with MHC multimer and then forcing the cells with a large volume of liquid through a nozzle creating a stream of spaced cells. Each cell passes through a laser beam and any fluorochrome bound to the cell is excited and thereby fluoresces. Sensitive photomultipliers detect emitted fluorescence, providing information about the amount of MHC multimer bound to the cell. By this method MHC multimers can be used to identify specific T cell populations in liquid samples such as synovial fluid or blood.

When analyzing blood samples whole blood can be used with or without lysis of red blood cells. Alternatively lymphocytes can be purified before flow cytometry analysis using standard procedures like a Ficoll-Hypaque gradient. Another possibility is to isolate T cells from the blood sample for example by binding to antibody coated plastic surfaces, followed by elution of bound cells. This purified T cell population can then be used for flow cytometry analysis together with MHC multimers. Instead of actively isolating T cells unwanted cells like B cells and NK cells can be removed prior to the analysis. One way to do this is by affinity chromatography using columns coated with antibodies specific for the unwanted cells. Alternatively, specific antibodies can be added to the blood sample together with complement, thereby killing cells recognized by the antibodies.

Various gating reagents can be included in the analysis. Gating reagents here means labeled antibodies or other labeled markers identifying subsets of cells by binding to unique surface proteins. Preferred gating reagents when using MHC multimers are antibodies directed against CD3, CD4, and CD8 identifying major subsets of T cells. Other preferred gating reagents are antibodies against CD14, CD15, CD19, CD25, CD56, CD27, CD28, CD45, CD45RA, CD45RO, CCR7, CCR5, CD62L, Foxp3 recognizing specific proteins unique for different lymphocytes of the immune system. Following labelling with MHC multimers and before analysis on a flow cytometer stained cells can be treated with a fixation reagent like formaldehyde to cross-link bound MHC multimer to the cell surface. Stained cells can also be analyzed directly without fixation.

The number of cells in a sample can vary. When the target cells are rare, it is preferable to analyze large amounts of cells. In contrast, fewer cells are required when looking at T cell lines or samples containing many cells of the target cell type.

The flow cytometer can be equipped to separate and collect particular types of cells. This is called cell sorting. MHC multimers in combination with sorting on a flow cytometer can be used to isolate specific T cell populations. Isolated specific T cell populations can then be expanded in vitro. This can be useful in autologous cancer therapy.

Direct determination of the concentration of MHC-peptide specific T cells in a sample can be obtained by staining blood cells or other cell samples with MHC multimers and relevant gating reagents followed by addition of an exact amount of counting beads of known concentration. Counting beads is here to be understood as any fluorescent bead with a size that can be visualized by flow cytometry in a sample containing T cells. The beads could be made of polystyrene with a size of about 1-10 μm. They could also be made of agarose, polyacrylamide, silica, or any other material, and have any size between 0.1 μm and 100 m. The counting beads are used as reference population to measure the exact volume of analyzed sample. The sample are analyzed on a flow cytometer and the amount of MHC-specific T cell determined using a predefined gating strategy and then correlating this number to the number of counted counting beads in the same sample using the following equation: Amounts of MHC-peptide specific T cells in a blood sample can be determined by flow cytometry by calculating the amount of MHC'mer labeled cells in a given volume of sample with a given cell density and then back calculate. Exact enumeration of specific T cells is better achieved by staining with MHC'mers together with an exact amount of counting beads followed by flow cytometry analysis. The amount of T cells detected can then be correlated with the amount of counting beads in the same volume of the sample and an exact number of MHC-peptide specific T cells determined:

Concentration of MHC-specific *T*-cell in sample= (number of MHC-peptide specific *T* cells counted/number of counting beads counted)× concentration of counting beads in sample Direct Detection of Individual T Cells in Fluid Sample by Microscopy A suspension of T cells are added MHC multimers, the sample washed and then the amount of MHC multimer bound to each cell are measured. Bound MHC multimers may be labelled directly or measured through addition of labelled marker molecules. The sample is then spread out on a slide or similar in a thin layer able to distinguish individual cells and labelled cells identified using a microscope. Depending on the type of label different types of microscopes may be used, e.g. if fluorescent labels are used a fluorescent microscope is used for the analysis. For example MHC multimers can be labeled with a fluorochrome or bound MHC multimer detected with a fluorescent antibody. Cells with bound fluorescent MHC multimers can then be visualized using an immunofluorescence microscope or a confocal fluorescence microscope.

Direct Detection of Individual T Cells in Fluid Sample by Capture on Solid Support Followed by Elution.

MHC multimers are immobilized to a support e.g. beads, immunotubes, wells of a microtiterplate, CD, microchip or similar and as described elsewhere herein, then a suspension of T cells are added allowing specific T cells to bind MHC multimer molecules. Following washing bound T cells are recovered/eluted (e.g. using acid or competition with a competitor molecules) and counted.

Direct Detection of Populations of T Cells

Cell suspensions are added labeled MHC multimer, samples are washed and then total signal from label are measured. The MHC multimers may be labeled themselves or detected through a labeled marker molecule.

Cell suspensions are added labeled MHC multimer, samples are washed and then signal from label are amplified and then total signal from label and/or amplifier are measured.

Direct Detection of Immobilized T Cells.

T cells may be immobilized and then detected directly. Immobilization can be on solid support, in solid tissue or in fixator (e.g. paraffin, a sugar matrix or another medium fixing the T cells).

Direct Detection of T Cells Immobilized on Solid Support.

In a number of applications, it may be advantageous immobilise the T cell onto a solid or semi-solid support. Such support may be any which is suited for immobilisation, separation etc. Non-limiting examples include particles, beads, biodegradable particles, sheets, gels, filters, membranes (e.g. nylon membranes), fibres, capillaries, needles, microtitre strips, tubes, plates or wells, combs, pipette tips, micro arrays, chips, slides, or indeed any solid surface material. The solid or semi-solid support may be labelled, if this is desired. The support may also have scattering properties or sizes, which enable discrimination among supports of the same nature, e.g. particles of different sizes or scattering properties, colour or intensities.

Conveniently the support may be made of glass, silica, latex, plastic or any polymeric material. The support may also be made from a biodegradable material.

Generally speaking, the nature of the support is not critical and a variety of materials may be used. The surface of support may be hydrophobic or hydrophilic.

Preferred are materials presenting a high surface area for binding of the T cells. Such supports may be for example be porous or particulate e.g. particles, beads, fibres, webs, sinters or sieves.

Particulate materials like particles and beads are generally preferred due to their greater binding capacity. Particularly polymeric beads and particles may be of interest.

Conveniently, a particulate support (e.g. beads or particles) may be substantially spherical. The size of the particulate support is not critical, but it may for example have a diameter of at least 1 µm and preferably at least 2 µm, and have a maximum diameter of preferably not more than 10 µm and more preferably not more than 6 µm. For example, particulate supports having diameters of 2.8 µm and 4.5 µm will work well.

An example of a particulate support is monodisperse particles, i.e. such which are substantially uniform in size (e.g. size having a diameter standard deviation of less than 5%). Such have the advantage that they provide very uniform reproducibility of reaction. Monodisperse particles, e.g. made of a polymeric material, produced by the technique described in U.S. Pat. No. 4,336,173 (ref. 25) are especially suitable.

Non-magnetic polymer beads may also be applicable. Such are available from a wide range of manufactures, e.g. Dynal Particles AS, Qiagen, Amersham Biosciences, Serotec, Seradyne, Merck, Nippon Paint, Chemagen, Promega, Prolabo, Polysciences, Agowa, and Bangs Laboratories.

Another example of a suitable support is magnetic beads or particles. The term "magnetic" as used everywhere herein is intended to mean that the support is capable of having a magnetic moment imparted to it when placed in a magnetic field, and thus is displaceable under the action of that magnetic field. In other words, a support comprising magnetic beads or particles may readily be removed by magnetic aggregation, which provides a quick, simple and efficient way of separating out the beads or particles from a solution. Magnetic beads and particles may suitably be paramagnetic or superparamagnetic. Superparamagnetic beads and particles are e.g. described in EP 0 106 873 (Sintef, ref. 26). Magnetic beads and particles are available from several manufacturers, e.g. Dynal Biotech ASA (Oslo, Norway, previously Dynal AS, e.g. Dynabeads®).

The support may suitably have a functionalised surface. Different types of functionalisation include making the surface of the support positively or negatively charged, or hydrophilic or hydrophobic. This applies in particular to beads and particles. Various methods therefore are e.g. described in U.S. Pat. No. 4,336,173 (ref. 25), U.S. Pat. No. 4,459,378 (ref. 27) and U.S. Pat. No. 4,654,267 (ref. 28).

Immobilized T cells may be detected in several ways including:

Direct Detection of T Cells Directly Immobilized on Solid Support.

T cells may be directly immobilized on solid support e.g. by non-specifically adhesion. Then MHC multimers are added to the immobilized T cells thereby allowing specific T cells to bind the MHC multimers. Bound MHC multimer may be measured through label directly attached to the multimer or through labeled marker molecules. Individual T cells may be detected if the method for analysis is able to distinguish individual labeled cells, e.g. cells are immobilized in a monolayer on a cell culture well or a glass slide. Following staining with labeled multimer a digital picture is taken and labeled cells identified and counted.

Alternatively a population of T cells is detected by measurement of total signal from all labeled T cells, e.g. cells are plated to wells of a microtiter plate, stained with labeled MHC multimer and total signal from each well are measured.

Direct Detection of T Cells Immobilized on Solid Support Through Linker Molecule T cell can also be immobilized to solid support through a linker molecule. The linker molecule can be an antibody specific for the T cell, the linker can be MHC multimer or the linker can be any molecule able to bind the T cells. In any case the linker may be attached directly to the solid support, the linker may be attached to the solid support through another linker or the linker is embedded in a matrix, e.g. a sugar matrix.

Then MHC multimers are added to the immobilized T cells thereby allowing specific T cells to bind the MHC multimers. Bound MHC multimer may be measured through label directly attached to the multimer or through labeled marker molecules. Individual T cells may be detected if the method for analysis is able to distinguish individual labeled cells, e.g. a digital picture is taken and labeled cells identified and counted. Alternatively a population of T cells is detected by measurement of total signal from all labeled T cells.

Phenotyping T Cell Sample Using MHC Multimer Beads.

Different MHC multimers are immobilized to different beads with different characteristics (e.g. different size, different fluorescence's or different fluorescence intensities) where each kind of bead has a specific type of MHC multimer molecule immobilized. The immobilization may be direct or through a linker molecule as described above. The amount of bound T cells to a specific populations of beads can be analyzed, thereby, phenotyping the sample. The TCR on the T cell is defined by the bead to which it binds.

Direct Detection of T Cells Immobilized to Solid Support in a Defined Pattern.

Different MHC multimers are immobilized to a support to form a spatial array in a defined pattern, where the position specifies the identity of the MHC multimer immobilized at this position. The immobilization may be direct or through a linker molecule as described above. Then a suspension of labeled T cells are added or passed over the array of MHC multimers and specific T cells will bind the immobilized MHC multimer molecules. The label will thus be located at specific regions of the array, which will allow identification of the MHC multimers that bind the cells, and thus, allows the identification of T cells with recognition specificity for the immobilized MHC multimers. Alternatively, the cells can be labelled after they have been bound to the MHC multimers. The label can be specific for the type of cell that is expected to bind the MHC multimer (e.g. anti-CD4 for the labelling of T-helper cells in general, where some of the T-helper cells can be specific for a Class II MHC complex), or the label can stain cells in general (e.g. a label that binds DNA).

In this way T cells bound to the defined areas of the support are analyzed, thereby, phenotyping the sample. Each individual T cell is defined by the TCR it expose and depending on these TCRs each entity will bind to different types of MHC multimer molecules immobilized at defined positions on the solid support.

Direct Detection of Immobilized T Cells Followed by Sorting

T cells immobilized to solid support in either of the ways described above can following washing be eluted from the solid support and treated further. This is a method to sort out specific T cells from a population of different T cells. Specific T-cells can e.g. be isolated through the use of bead-based MHC multimers. Bead-based MHC multimers are beads whereto monomer MHC-peptide complexes or MHC multimers are immobilized. After the cells have been isolated they can be manipulated in many different ways. The isolated cells can be activated (to differentiate or proliferate), they can undergo induced apoptosis, or undesired cells of the isolated cell population can be removed. Then, the manipulated cell population can be re-introduced into the patient, or can be introduced into another patient.

A typical cell sorting experiment, based on bead-based MHC multimers, would follow some of the steps of the general procedure outlined in general terms in the following:

Acquire the sample, e.g. a cell sample from the bone marrow of a cancer patient.

Block the sample with a protein solution, e.g. BSA or skim milk.

Block the beads coated with MHC complexes, with BSA or skim milk.

Mix MHC-coated beads and the cell sample, and incubate.

Wash the beads with washing buffer, to remove unbound cells and non-specifically bound cells.

Isolate the immobilized cells, by either cleavage of the linker that connects MHC complex and bead; or alternatively, release the cells by a change in pH, salt-concentration addition of competitive binder or the like. Preferably, the cells are released under conditions that do not disrupt the integrity of the cells.

Manipulate the isolated cells (induce apoptosis, proliferation or differentiation)

Direct Detection of T Cells in Solid Tissue.

Direct Detection of T Cells in Solid Tissue In Vitro.

For in vitro methods of the present invention solid tissue includes tissue, tissue biopsies, frozen tissue or tissue biopsies, paraffin embedded tissue or tissue biopsies and sections of either of the above mentioned. In a preferred method of this invention sections of fixed or frozen tissues are incubated with MHC multimer, allowing MHC multimer to bind to specific T cells in the tissue section. The MHC multimer may be labeled directly or through a labeled marker molecule. As an example, the MHC multimer can be labeled with a tag that can be recognized by e.g. a secondary antibody, optionally labeled with HRP or another label. The bound MHC multimer is then detected by its fluorescence or absorbance (for fluorophore or chromophore), or by addition of an enzyme-labeled antibody directed against this tag, or another component of the MHC multimer (e.g. one of the protein chains, a label on the multimerization domain). The enzyme can be Horse Raddish Peroxidase (HRP) or Alkaline Phosphatase (AP), both of which convert a colorless substrate into a colored reaction product in situ. This colored deposit identifies the binding site of the MHC multimer, and can be visualized under a light microscope. The MHC multimer can also be directly labeled with e.g. HRP or AP, and used in IHC without an additional antibody.

The tissue sections may derive from blocks of tissue or tissue biopsies embedded in paraffin, and tissue sections from this paraffin-tissue block fixed in formalin before staining. This procedure may influence the structure of the TCR in the fixed T cells and thereby influence the ability to recognize specific MHC complexes. In this case, the native structure of TCR needs to be at least partly preserved in the fixed tissue. Fixation of tissue therefore should be gentle. Alternatively, the staining is performed on frozen tissue sections, and the fixation is done after MHC multimer staining.

Direct Detection of T Cells in Solid Tissue In Vivo

For in vivo detection of T cells labeled MHC multimers are injected in to the body of the individual to be investigated. The MHC multimers may be labeled with e.g. a paramagnetic isotope. Using a magnetic resonance imaging (MRI) scanner or electron spin resonance (ESR) scanner MHC multimer binding T cells can then be measured and localized. In general, any conventional method for diagnostic imaging visualization can be utilized. Usually gamma and positron emitting radioisotopes are used for camera and paramagnetic isotopes for MRI.

The methods described above for direct detection of TCR embedded in lipid bilayers collectively called T cells using MHC multimers also applies to detection of TCR in solution and detection of TCR attached to or in a solid medium. Though detection of individual TCRs may not be possible when TCR is in solution.

Indirect Detection of TCR

Indirect detection of TCR is primarily useful for detection of TCRs embedded in lipid bilayer, preferably natural occurring T cells, T cell hybridomas or transfected T cells. In indirect detection, the number or activity of T cells are measured, by detection of events that are the result of TCR-MHC-peptide complex interaction. Interaction between MHC multimer and T cell may stimulate the T cell resulting in activation of T cells, in cell division and proliferation of T cell populations or alternatively result in inactivation of T cells. All these mechanism can be measured using various detection methods.

Indirect Detection of T Cells by Measurement of Activation.

MHC multimers, e.g. antigen presenting cells, can stimulate T cells resulting in activation of the stimulated T cells. Activation of T cell can be detected by measurement of secretion of specific soluble factor from the stimulated T cell, e.g. secretion of cytokines like INFγ and IL2.

Stimulation of T cells can also be detected by measurement of changes in expression of specific surface receptors, or by measurement of T cell effector functions.

Measurement of activation of T cells involves the following steps:

a) To a sample of T cells, preferably a suspension of cells, is added MHC multimer to induce either secretion of soluble factor, up- or down-regulation of surface receptor or other changes in the T cell.

Alternatively, a sample of T cells containing antigen presenting cells is added antigenic peptide or protein/protein fragments that can be processed into antigenic peptides by the antigen presenting cell and that are able to bind MHC I or MHC II molecules expressed by the antigen presenting cells thereby generating a cell based MHC multimer in the sample. Several different peptides and proteins be added to the sample. The peptide-loaded antigen presenting cells can then stimulate specific T cells, and thereby induce the secretion of soluble factor, up- or down-regulation of surface receptors, or mediate other changes in the T cell, e.g. enhancing effector functions.

Optionally a second soluble factor, e.g. cytokine and/or growth factor(s) may be added to facilitate continued activation and expansion of T cell population.

b) Detect the presence of soluble factor, the presence/absence of surface receptor or detect effector function c) Correlate the measured result with presence of T cells. The measured signal/response indicate the presence of specific T cells that have been stimulated with particular MHC multimer.

The signal/response of a T lymphocyte population is a measure of the overall response. The frequency of specific T cells able to respond to a given MHC multimer can be determined by including a limiting-dilution culture in the assay also called a Limiting dilution assay.

The limiting-dilution culture method involves the following steps:
a) Sample of T cells in suspension are plated into culture wells at increasing dilutions
b) MHC multimers are added to stimulate specific T cells. Alternatively antigen presenting cells are provided in the sample and then antigenic peptide I added to the sample as described above.
Optionally growth factors, cytokines or other factors helping T cells to proliferate are added.
c) Cells are allowed to grow and proliferate (½-several days). Each well that initially contained a specific T cell will make a response to the MHC multimer and divide.
d) Wells are tested for a specific response e.g. secretion of soluble factors, cell proliferation, cytotoxicity or other effector function.

The assay is replicated with different numbers of T cells in the sample, and each well that originally contained a specific T cell will make a response to the MHC multimer. The frequency of specific T cells in the sample equals the reciprocal of the number of cells added to each well when 37% of the wells are negative, because due to Poisson distribution each well then on average contained one specific T cell at the beginning of the culture.

In the following various methods to measure secretion of specific soluble factor, expression of surface receptors, effector functions or proliferation is described.

Indirect Detection of T Cells by Measurement of Secretion of Soluble Factors.

Indirect Detection of T Cells by Measurement of Extracellular Secreted Soluble Factors.

Secreted soluble factors can be measured directly in fluid suspension, captured by immobilization on solid support and then detected or an effect of the secreted soluble factor can be detected.

Indirect Detection of T Cells by Measurement of Extracellular Secreted Soluble Factor Directly in Fluid Sample.

A sample of T cells are added MHC multimer or antigenic peptide as described above to induce secretion of soluble factors from antigen specific T cells. The secreted soluble factors can be measured directly in the supernatant using e.g. mass spectrometry.

Indirect Detection of T Cells by Capture of Extracellular Secreted Soluble Factor on Solid Support.

A sample of T cells are added MHC multimer or antigenic peptide as described above to induce secretion of soluble factors from antigen specific T cells. Secreted soluble factors in the supernatant are then immobilized on a solid support either directly or through a linker as described for immobilization of T cells elsewhere herein. Then immobilized soluble factors can be detected using labeled marker molecules.

Soluble factors secreted from individual T cells can be detected by capturing of the secreted soluble factors locally by marker molecules, e.g antibodies specific for the soluble factor. Soluble factor recognising marker molecules are then immobilised on a solid support together with T cells and soluble factors secreted by individual T cells are thereby captured in the proximity of each T cell. Bound soluble factor can be measured using labelled marker molecule specific for the captured soluble factor. The number of T cells that has given rise to labelled spots on solid support can then be enumerated and these spots indicate the presence of specific T cells that may be stimulated with particular MHC multimer.

Soluble factors secreted from a population of T cells are detected by capture and detection of soluble factor secreted from the entire population of specific T cells. In this case soluble factor do not have to be captured locally close to each T cell but the secreted soluble factors my be captured and detected in the same well as where the T cells are or transferred to another solid support with marker molecules for capture and detection e.g. beads or wells of ELISA plate.

Indirect Detection of T Cells Immobilized to Solid Support in a Defined Pattern.

Different MHC multimers of MHC-peptide complexes are immobilized to a support to form a spatial array in a defined pattern, where the position specifies the identity of the MHC multimer/MHC-peptide complex immobilized at this position. Marker molecules able to bind T cell secreted soluble factors are co-spotted together with MHC multimer/MHC-peptide complex. Such marker molecules can e.g. be antibodies specific for cytokines like INFγ or IL-2. The immobilization may be direct or through a linker molecule as described above. Then a suspension of labeled T cells are added or passed over the array of MHC multimers/MHC-peptide complexes and specific T cells will bind to the immobilized MHC multimers/MHC-peptide complexes and upon binding be stimulated to secrete soluble factors e.g. cytokines like INFγ ord IL-2. Soluble factors secreted by individual T cells are then captured in the proximity of each T cell and bound soluble factor can be measured using labelled marker molecule specific for the soluble factor. The number and position of different specific T cells that has given rise to labelled spots on solid support can then be identified and enumerated. In this way T cells bound to defined areas of the support are analyzed, thereby, phenotyping the sample. Each individual T cell is defined by the TCR it expose and depending on these TCRs each entity will bind to different types of MHC multimers/MHC-peptide complexes immobilized at defined positions on the solid support.

Indirect Detection of T Cells by Measurement of Effect of Extracellular Secreted Soluble Factor.

Secreted soluble factors can be measured and quantified indirectly by measurement of the effect of the soluble factor on other cell systems. Briefly, a sample of T cells are added MHC multimer or antigenic peptide as described above to induce secretion of soluble factors from antigen specific T cells. The supernatant containing secreted soluble factor are transferred to another cell system and the effect measured. The soluble factor may induce proliferation, secretion of other soluble factors, expression/downregulation of receptors, or the soluble factor may have cytotoxic effects on these other cells. All effects can be measured as described elsewhere herein.

Indirect Detection of T Cells by Measurement of Intracellular Secreted Soluble Factors Soluble factor production by stimulated T cells can be also be measured intracellular by e.g. flow cytometry. This can be done using block of secretion of soluble factor (e.g. by monensin), permeabilization of cell (by e.g. saponine) followed by immunofluorescent staining. The method involves the following steps: 1) Stimulation of T cells by binding specific MHC multimers, e.g. antigen presenting cells loaded with antigenic peptide. An reagent able to block extracellular secretion of cytokine is added, e.g. monensin that interrupt intracellular transport processes leading to accumulation of produced soluble factor, e.g. cytokine in the Golgi complex. During stimulation other soluble factors may be added to the T cell sample during stimulation to enhance activation and/or expansion. This other soluble factor can be cytokine and or growth factors. 2) addition of one or more labelled marker able to detect special surface receptors (e.g. CD8, CD4, CD3, CD27, CD28, CD2). 3) Fixation of cell membrane using mild fixator followed by permeabilization of cell membrane by. e.g. saponine. 4) Addition of labelled marker specific for the produced soluble factor to be determined, e.g. INFγ, IL-2, IL-4, IL-10. 5) Measurement of labelled cells using a flow cytometer.

An alternative to this procedure is to trap secreted soluble factors on the surface of the secreting T cell as described by Manz, R. et al., Proc. Natl. Acad. Sci. USA 92:1921 (1995).

Indirect Detection of T Cells by Measurement of Expression of Receptors

Activation of T cells can be detected by measurement of expression and/or down regulation of specific surface receptors. The method includes the following steps. A sample of T cells are added MHC multimer or antigenic peptide as described above to induce expression or downregulation of specific surface receptors on antigen specific T cells. These receptors include but are not limited to CD28, CD27, CCR7, CD45RO, CD45RA, IL2-receptor, CD62L, CCR5. Their expression level can be detected by addition of labelled marker specific for the desired receptor and then measure the amount of label using flow cytometry, microscopy, immobilization of activated T cell on solid support or any other method like those described for direct detection of TCR in lipid bilayer.

Indirect Detection of T Cells by Measurement of Effector Function

Activation of T cells can be detected indirectly by measurement of effector functions. A sample of T cells are added MHC multimer or antigenic peptide as described above to induce the T cell to be able to do effector function. The effector function is then measured. E.g. activation of antigen specific CD8 positive T cells can be measured in a cytotoxicity assay.

Indirect Detection of T Cells by Measurement of Proliferation

T cells can be stimulated to proliferate upon binding specific MHC multimers. Proliferation of T cells can be measured several ways including but not limited to:

Detection of mRNA

Proliferation of T cells can be detected by measurement of mRNA inside cell. Cell division and proliferation requires production of new protein in each cell which as an initial step requires production of mRNA encoding the proteins to be synthesized.

A sample of T cells are added MHC multimer or antigenic peptide as described above to induce proliferation of antigen specific T cells. Detection of levels of mRNA inside the proliferating T cells can be done by quantitative PCR and indirectly measure activation of a T cell population as a result of interaction with MHC multimer. An example is measurement of cytokine mRNA by in sity hybridization.

Detection of Incorporation of Thymidine

The proliferative capacity of T cells in response to stimulation by MHC multimer can be determined by a radioactive assay based on incorporation of [$^3$H]thymidine ([$^3$H]TdR) into newly generated DNA followed by measurement of radioactive signal.

Detection of Incorporation of BrdU

T cell proliferation can also be detected by of incorporation of bromo-2'-deoxyuridine (BrdU) followed by measurement of incorporated BrdU using a labeled anti-BrdU antibody in an ELISA based analysis.

Viability of cells may be measured by measurement ATP in a cell culture.

Indirect Detection of T Cells by Measurement of Inactivation

Not all MHC multimers will lead to activation of the T cells they bind. Under certain circumstances some MHC multimers may rather inactivate the T cells they bind to.

Indirect Detection of T Cells by Measurement of Effect of Blockade of TCR

Inactivation of T cells by MHC multimers may be measured be measuring the effect of blocking TCR on antigen specific T cells. MHC multimers, e.g. MHC-peptide complexes coupled to IgG scaffold can block the TCR of an antigen specific T cell by binding the TCR, thereby prevent the blocked T cell receptor interacting with e.g. antigen presenting cells. Blockade of TCRs of a T cell can be detected in any of the above described methods for detection of TCR by addition of an unlabeled blocking MHC multimer together with the labelled MHC multimer and then measuring the effect of the blockade on the readout.

Indirect Detection of T Cells by Measurement of Induction of Apoptosis

Inactivation of T cells by MHC multimers may be measured be measuring apoptosis of the antigen specific T cell. Binding of some MHC multimers to specific T cells may lead to induction of apoptosis. Inactivation of T cells by binding MHC multimer may therefore be detected by measuring apoptosis in the T cell population. Methods to measure apoptosis in T cells include but are not limited to measurement of the following:

DNA fragmentation

Alterations in membrane asymmetry (phosphatidylserine translocation)

Activation of apoptotic caspases

Release of cytochrome C and AIF from mitochondria into the cytoplasm

Positive Control Experiments for the Use of MHC Multimers in Flow Cytometry and Related Techniques When performing flow cytometry experiments, or when using similar technologies, it is important to include appropriate positive and negative controls. In addition to establishing proper conditions for the experiments, positive and negative control reagents can also be used to evaluate the quality (e.g. specificity and affinity) and stability (e.g. shelf life) of produced MHC multimers.

The quality and stability of a given MHC multimer can be tested in a number of different ways, including:

- Measurement of specific MHC multimer binding to beads, other types of solid support, or micelles and liposomes, to which TCR's have been immobilized. Other kinds of molecules that recognize specifically the MHC-peptide complex can be immobilized and used as well. Depending on the nature of the solid support or membrane structure to which the TCR is immobilized, the TCR can be full-length (i.e. comprise the intracellular- and intra-membrane domains), or can be truncated (e.g. only comprise the extracellular domains). Likewise, the TCR can be recombinant, and can be chemically or enzymatically modified.
- Measurement of MHC multimer binding to beads, other types of solid support, or micelles and liposomes, to which aptamers, antibodies or other kinds of molecules that recognize correctly folded MHC-peptide complexes have been immobilized.
- Measurement of specific MHC multimer binding to specific cell lines (e.g. T-cell lines) displaying MHC multimer-binding molecules, e.g. displaying TCRs with appropriate specificity and affinity for the MHC multimer in question.
- Measurement of specific MHC multimer binding to cells in blood samples, preparations of purified lymphocytes (HPBMCs), or other bodily fluids that contain cells carrying receptor molecules specific for the MHC multimer in question.
- Measurement of specific MHC multimer binding to soluble TCRs, aptamers, antibodies, or other soluble MHC-peptide complex-binding molecules, by density-gradient centrifugation (e.g. in CsCl) or by size exclusion chromatography, PAGE or other type of chromatographic method.
- Measurement of specific MHC binding to TCRs, aptamers, antibodies, streptavidin, or other MHC-peptide complex-binding molecules immobilized on a solid surface (e.g. a microtiter plate). The degree of MHC multimer binding can be visualized with a secondary component that binds the MHC multimer, e.g. a biotinylated fluorophore in cases where the MHC multimer contains streptavidin proteins, not fully loaded with biotin. Alternatively, the secondary component is unlabelled, and a labelled second component-specific compound is employed (e.g. EnVision System, Dako) for visualization. This solid surface can be beads, immunotubes, microtiterplates act. The principle for purification are basically the same I.e. T cells are added to the solid with immobilized MHC'mer, non-binding T cells are washed away and MHC-peptide specific T cells can be retrieved by elution with mild acid or a competitive binding reagent.
  - Measurement of specific MHC multimer binding to TCRs, aptamers, antibodies, streptavidin, or other MHC-peptide complex-binding molecules immobilized on a solid surface (e.g. a microtiter plate) visualized with a secondary component specific to MHC multimer (e.g. TCRs, aptamers, antibodies, streptavidin, or other MHC-peptide binding complex-binding molecules). Alternatively the secondary receptor is unlabelled, and a labelled second receptor-specific compound is employed (e.g. EnVision System, Dako) before visualization.

In the above mentioned approaches, positive control reagents include MHC multimers comprising correctly folded MHC, complexed with an appropriate peptide that allows the MHC multimer to interact specifically and efficiently with its cognate TCR. Negative control reagents include empty MHC multimers, or correctly folded MHC multimers complexed with so-called nonsense peptides that support a correct conformation of the MHC-peptide complex, but that do not efficiently bind TCRs through the peptide-binding site of the MHC complex.

Negative Control Reagents and Negative Control Experiments for the Use of MHC Multimers in Flow Cytometry and Related Techniques Experiments with MHC multimers require a negative control in order to determine background staining with MHC multimer. Background staining can be due to unwanted binding of any of the individual components of the MHC multimer, e.g., MHC complex or individual components of the MHC complex, multimerization domain or label molecules. The unwanted binding can be to any surface or intracellular protein or other cellular structure of any cell in the test sample, e.g. undesired binding to B cells, NK cells or T cells. Unwanted binding to certain cells or certain components on cells can normally be corrected for during the analysis, by staining with antibodies that bind to unique surface markers of these specific cells, and thus identifies these as false positives, or alternatively, that bind to other components of the target cells, and thus identifies these cells as true positives. A negative control reagent can be used in any experiment involving MHC multimers, e.g. flow cytometry analysis, other cytometric methods, immunohistochemistry (IHC) and ELISA. Negative control reagents include the following:

- MHC complexes or MHC multimers comprising MHC complexes carrying nonsense peptides. A nonsense peptide is here to be understood as a peptide that binds the MHC protein efficiently, but that does not support binding of the resultant MHC-peptide complex to the desired TCR. An example nonsense peptide is a peptide with an amino acid sequence different from the linear sequence of any peptide derived from any known protein. When choosing an appropriate nonsense peptide the following points are taken into consideration. The peptide should ideally have appropriate amino acids at relevant positions that can anchor the peptide to the peptide-binding groove of the MHC. The remaining amino acids should ideally be chosen in such a way that possible binding to TCR (through interactions with the peptide or peptide-binding site of MHC) are minimized. The peptide should ideally be soluble in water to make proper folding with MHC alpha chain and β2m possible in aqueous buffer. The length of the peptide should ideally match the type and allele of MHC complex. The final peptide sequence should ideally be taken through a blast search or similar analysis, to ensure that it is not identical with any peptide sequence found in any known naturally occurring proteins.
- MHC complexes or MHC multimers comprising MHC complexes carrying a chemically modified peptide in the peptide-binding groove. The modification should ideally allow proper conformation of the MHC-peptide structure, yet should not allow efficient interaction of the peptide or peptide-binding site of MHC with the TCR.

MHC complexes or MHC multimers comprising MHC complexes carrying a naturally occurring peptide different from the peptide used for analysis of specific T cells in the sample. When choosing the appropriate natural peptide the following should be taken into consideration. The peptide in complex with the MHC protein should ideally not be likely to bind a TCR of any T cell in the sample with such an affinity that it can be detected with the applied analysis method. The peptide should ideally be soluble in water to make proper folding with MHC alpha chain and β2m possible in aqueous buffer. The length of the peptide should match the type and allele of MHC complex.

Empty MHC complexes or MHC multimers comprising empty MHC complexes, meaning any correctly folded MHC complex without a peptide in the peptide-binding groove.

MHC heavy chain or MHC multimers comprising MHC heavy chain, where MHC heavy chain should be understood as full-length MHC I or MHC II heavy chain or any truncated version of MHC I or MHC II heavy chain. The MHC heavy chains can be either folded or unfolded. Of special interest is MHC I alpha chains containing the α3 domain that binds CD8 molecules on cytotoxic T cells. Another embodiment of special interest is MHC II β chains containing the β2 domain that binds CD4 on the surface of helper T cells.

Beta2microglobulin or subunits of beta2microglobulin, or MHC multimers comprising Beta2microglobulin or subunits of beta2microglobulin, folded or unfolded.

MHC-like complexes or MHC multimers comprising MHC-like complexes, folded or unfolded. An example could be CD1 molecules that are able to bind peptides in a peptide-binding groove that can be recognized by T cells (Russano et al. (2007). CD1-restricted recognition of exogenous and self-lipid antigens by duodenal gammadelta+ T lymphocytes. J. Immunol. 178(6): 3620-6)

Multimerization domains without MHC or MHC-like molecules, e.g. dextran, streptavidin, IgG, coiled-coil-domain liposomes.

Labels, e.g. FITC, PE, APC, pacific blue, cascade yellow, or any other label listed elsewhere herein.

Negative controls 1-4 can provide information about potentially undesired binding of the MHC multimer, through interaction of a surface of the MHC-peptide complex different from the peptide-binding groove and its surroundings. Negative control 5 and 6 can provide information about binding through interactions through the MHC I or MHC II proteins (in the absence of peptide). Negative control 7 can provide information about binding through surfaces of the MHC complex that is not unique to the MHC complex. Negative controls 8 and 9 provide information about potential undesired interactions between non-MHC-peptide complex components of the MHC multimer and cell constituents.

Minimization of Undesired Binding of the MHC Multimer

Identification of MHC-peptide specific T cells can give rise to background signals due to unwanted binding to cells that do not carry TCRs. This undesired binding can result from binding to cells or other material, by various components of the MHC multimer, e.g. the dextran in a MHC dextramer construct, the labelling molecule (e.g. FITC), or surface regions of the MHC-peptide complex that do not include the peptide and the peptide-binding cleft. MHC-peptide complexes bind to specific T cells through interaction with at least two receptors in the cell membrane of the T-cell. These two receptors are the T-cell receptor (TCR) and CD8 for MHC I-peptide complexes and TCR and CD4 receptor protein for MHC II-peptide complexes. Therefore, a particularly interesting example of undesired binding of a MHC multimer is its binding to the CD8 or CD4 molecules of T cells that do not carry a TCR specific for the actual MHC-peptide complex. The interaction of CD8 or CD4 molecules with the MHC is not very strong; however, because of the avidity gained from the binding of several MHC complexes of a MHC multimer, the interaction between the MHC multimer and several CD8 or CD4 receptors potentially can result in undesired but efficient binding of the MHC multimer to these T cells. In an analytical experiment this would give rise to an unwanted background signal; in a cell sorting experiment undesired cells might become isolated.

Other particular interesting examples of undesired binding is binding to lymphoid cells different from T cells, e.g. NK-cells, B-cells, monocytes, dendritic cells, and granulocytes like eosinophils, neutrophils and basophiles.

Apart from the MHC complex, other components in the MHC multimer can give rise to unspecific binding. Of special interest are the multimerization domain, multimerization domain molecules, and labelling molecules.

One way to overcome the problem with unwanted binding is to include negative controls in the experiment and subtract this signal from signals derived from the analyzed sample, as described elsewhere in the invention.

Alternatively, unwanted binding could be minimized or eliminated during the experiment. Methods to minimize or eliminate background signals include:

Mutations in areas of the MHC complex responsible for binding to unwanted cells can be introduced. Mutations here mean substitution, insertion, or deletion of natural or non-natural amino acids. Sub-domains in the MHC complex can be responsible for unwanted binding of the MHC multimer to cells without a TCR specific for the MHC-peptide complex contained in the MHC multimer. One example of special interest is a small region in the α3-domain of the α-chain of MHC I molecules that is responsible for binding to CD8 on all cytotoxic T cells. Mutations in this area can alter or completely abolish the interaction between CD8 on cytotoxic T cells and MHC multimer (Neveu et al. (2006) Int Immunol. 18, 1139-45). Similarly a sub domain in the β2 domain of the β-chain of MHC II molecules is responsible for binding CD4 molecules on all CD4 positive T cells. Mutations in this sub domain can alter or completely abolish the interaction between MHC 11 and CD4.

Another embodiment is to mutate other areas of MHC I/MHC II complexes that are involved in interactions with T cell surface receptors different from TCR, CD8 and CD4, or that bind surface receptors on B cells, NK cells, Eosiniophils, Neutrophils, Basophiles, Dendritic cells or monocytes.

Chemical alterations in areas of the MHC complex responsible for binding to unwanted cells can be employed in order to minimize unwanted binding of MHC multimer to irrelevant cells. Chemical alteration here means any chemical modification of one or more amino acids. Regions in MHC complexes that are of special interest are as mentioned above the α3 domain of the α-chain in MHC I molecules and β2 domains in the β-chain of MHC II molecules. Other regions in MHC I/MHC II molecules that can be chemically modified to decrease the extent of undesired binding are regions involved in interaction with T cell surface receptors different from TCR, CD8 and CD4, or that bind surface receptors on B cells, NK cells, Eosiniophils, Neutrophils, Basophiles, Dendritic cells or monocytes.

Another method to minimize undesired binding involves the addition of one or more components of a MHC multimer, predicted to be responsible for the unwanted binding. The added component is not labeled, or carries a label different from the label of the MHC multimer used for analysis. Of special interest is addition of MHC multimers that contain nonsense peptides, i.e. peptides that interact efficiently with the MHC protein, but that expectably do not support specific binding of the MHC multimer to the TCR in question. Another example of interest is addition of soluble MHC complexes not coupled to a multimerization domain, and with or without peptide bound in the peptide binding cleft. In another embodiment, individual components of the MHC complex can be added to the sample, e.g. I $\alpha$-chain or subunits of MHC I $\alpha$-chain either folded or unfolded, beta2microglobulin or subunits thereof either folded or unfolded, $\alpha/\beta$-chain of MHC II or subunits thereof either folded or unfolded. Any of the above mentioned individual components can also be attached to a multimerization domain identical or different from the one used in the MHC multimer employed in the analysis.

Of special interest is also addition of multimerization domain similar or identical to the multimerization domain used in the MHC multimer or individual components of the multimerization domain.

Reagents able to identify specific cell types either by selection or exclusion can be included in the analysis to help identify the population of T cells of interest, and in this way deselect the signal arising from binding of the MHC multimer to undesired cells.

Of special interest is the use of appropriate gating reagents in flow cytometry experiments. Thus, fluorescent antibodies directed against specific surface markers can be used for identification of specific subpopulations of cells, and in this way help to deselect signals resulting from MHC-multimers binding to undesired cells.

Gating reagents of special interest that helps identify the subset of T cells of interest when using MHC I multimers are reagents binding to CD3 and CD8 identifying all cytotoxic T cells. These reagents are preferably antibodies but can be any labeled molecule capable of binding CD3 or CD8. Gating reagents directed against CD3 and CD8 are preferably used together. As they stain overlapping cell populations they are preferably labeled with distinct fluorochromes. However, they can also be used individually in separate samples. In experiments with MHC II multimers reagents binding to CD3 and CD4 identifying T helper cells can be used. These reagents are preferably antibodies but can be any labeled molecule capable of binding CD3 or CD4. Gating reagents directed against CD3 and CD4 are preferable used together. As they stain overlapping cell populations they are preferably labeled with distinct fluorochromes. However, they can also be used individually in separate samples.

Other gating reagents of special interest in experiments with any MHC multimer, are reagents binding to the cell surface markers CD2, CD27, CD28, CD45RA, CD45RO, CD62L and CCR7. These surface markers are unique to T cells in various differentiation states. Co staining with either of these reagents or combinations thereof together with MHC multimers helps to select MHC multimer binding T cells expressing a correct TCR. These reagents can also be combined with reagents directed against CD3, CD4 and/or CD8.

Another flow cytometric method of special interest to remove signals from MHC multimer stained cells not expressing the specific TCR, is to introduce an exclusion gate. Antibodies or other reagents specific for surface markers unique to the unwanted cells are labeled with a fluorochrome and added to the test sample together with the MHC multimer. The number of antibodies or surface marker specific reagents are not limited to one but can be two, three, four, five, six, seven, eight, nine, ten or more individual reagents recognizing different surface markers, all of which are unique to the unwanted cells. During or after collection of data all events representing cells labeled with these antibodies are dumped in the same gate and removed from the dataset. This is possible because all the antibodies/reagents that bind to the wrong cells are labeled with the same fluorochrome.

Reagents of special interest that exclude irrelevant cells include reagents against CD45 expressed on red blood cells, CD19 expressed on B cells, CD56 expressed on NK cells, CD4 expressed on T helper cells and CD8 expressed on cytotoxic T cells, CD14 expressed on monocytes and CD15 expressed on granulocytes and monocytes.

Vaccine Treatment

For the purpose of making cancer vaccines or other types of vaccines it can be desirable to employ MHC multimers that comprise a polymer such as dextran, or that are cell-based (e.g. specialized dendritic cells such as described by Banchereau and Palucka, Nature Reviews, Immunology, 2005, vol. 5, p. 296-306).

Preventive vaccination leading to prophylaxis/sterile immunity by inducing memory in the immune system may be obtained by immunizing/vaccinating an individual or animal with MHC alone, or with MHC in combination with other molecules as mentioned elsewhere in the patent.

Vaccine antigens can be administered alone

Vaccine can be administered in combination with adjuvant(s).

Adjuvant can be mixed with vaccine component or administered alone, simultaneously or in any order.

Adjuvant can be administered by the same route as the other vaccine components

Vaccine administered more than once may change composition from $1^{st}$ administration to the $2^{nd}$, $3^{rd}$, etc.

Vaccine administered more than once can be administered by alternating routes

Vaccine components can be administered alone or in combinations by the same route or by alternating/mixed routes Vaccine can be administered by the following routes
Cutaneously
Subcutaneously (SC)
Intramuscular (IM)
Intravenous (IV)
Per-oral (PO)
Inter peritoneally
Pulmonally
Vaginally
Rectally Therapeutic vaccination i.e. vaccination "teaching" the immune system to fight an existing infection or disease, may be obtained by immunizing/vaccinating an individual or animal with MHC alone, or with MHC in combination with other molecules as mentioned elsewhere in the patent.

Vaccine antigens can be administered alone

Vaccine can be administered in combination with adjuvant(s).
- Adjuvant can be mixed with vaccine component or administered alone, simultaneously or in any order.
- Adjuvant can be administered by the same route as the other vaccine components Vaccine administered more than once may change composition from $1^{st}$ administration to the $2^{nd}$, $3^{rd}$, etc.

Vaccine administered more than once can be administered by alternating routes

Vaccine components can be administered alone or in combinations by the same route or by alternating/mixed routes Vaccine can be administered by the following routes
- Cutaneously
- Subcutaneously (SC)
- Intramuscular (IM)
- Intravenous (IV)
- Per-oral (PO)
- Inter peritoneally
- Pulmonally
- Vaginally
- Rectally Therapeutic Treatment Therapeutic treatment includes the use of MHC molecules alone or in any molecular combination mentioned elsewhere in the patent application for the purpose of treating a disease in any state. Treatment may be in the form of
- Per-orally intake
  - Pills
  - Capsules
- Injections
  - Systemic
  - Local
- Jet-infusion (micro-drops, micro-spheres, micro-beads) through skin
- Drinking solution, suspension or gel
- Inhalation
- Nose-drops
- Eye-drops
- Ear-drops
- Skin application as ointment, gel or creme
- Vaginal application as ointment, gel, crème or washing
- Gastro-Intestinal flushing
- Rectal washings or by use of suppositories Treatment can be performed as
- Single intake, injection, application, washing
- Multiple intake, injection, application, washing
  - On single day basis
  - Over prolonged time as days, month, years Treatment dose and regimen can be modified during the course Personalized Medicine Takes Advantage of the Large Diversity of Peptide Epitopes that May be Generated from a Given Antigen.

The immune system is very complex. Each individual has a very large repertoire of specific T cells (on the order of $10^6$-$10^9$ different T cell specificities), which again is only a small subset of the total T cell repertoire of a population of individuals. It is estimated that the Caucasian population represents a T cell diversity of $10^{10}$-$10^{12}$. MHC allele diversity combined with large variation among individuals' proteolytic metabolism further enhances the variation among different individuals' immune responses. As a result, each individual has its own characteristic immune response profile.

This is important when designing a MHC multimer-based immune monitoring reagent or immunotherapeutic agent. If an agent is sought that should be as generally applicable as possible, one should try to identify peptide epitopes and MHC alleles that are common for the majority of individuals of a population. As described elsewhere in this application, such peptide epitopes can be identified through computerized search algorithms developed for that same purpose, and may be further strengthened by experimental testing of a large set of individuals.

This approach will be advantageous in many cases, but because of the variability among immune responses of different individuals, is likely to be inefficient or inactive in certain individuals, because of these individuals' non-average profile. In these latter cases one may have to turn to personalized medicine. In the case of immune monitoring and immunotherapy, this may involve testing a large number of different epitopes from a given antigen, in order to find peptide epitopes that may provide MHC multimers with efficiency for a given individual.

Thus, personalized medicine takes advantage of the wealth of peptide epitopes that may be generated from a given antigen. A large number of the e.g. 8-, 9-, 10-, and 11-mer epitopes that may be generated from a given antigen to be included in a class 1 MHC multimer reagent, for use in immune monitoring or immunotherapy, are therefore of relevance in personalized medicine. Only in the case where one wants to generate a therapeutic agent or diagnostic reagent that is applicable to the majority of individuals of a population can the large majority of epitope sequences be said to be irrelevant, and only those identified by computerized search algorithms and experimental testing be said to be of value. For the odd individual with the odd immune response these disregarded peptide epitopes may be the epitopes that provide an efficient diagnostic reagent or cures that individual from a deadly disease.

Antigenic Peptides

The present invention relates to one or more MHC multimers and/or one or more MHC complexes comprising one or more antigenic peptides such as the antigenic peptides listed in table A, B, C, D, E, F, G, H, I, J, K, L, M, N, O, P, Q, R, S, T, U, V, X and Y.

The one or more antigenic peptides can in one embodiment comprise a fragment of one or more cancer antigens.

The one or more cancer antigens can be selected from Table A.

TABLE A

Protein designation and accession numbers for the four selected cancer antigens Bcl-2, BclX(L), Survivin and Mcl-1. The amino acid sequence of each protein is displayed.

| Protein and accession number | Cancer antigen |
|---|---|
| AAH27258.1<br>B-cell CLL/lymphoma 2,<br>Bcl-2 [Homo sapiens] | MAHAGRTGYDNREIVMKYIHYKLSQRGYEWDAGDVGAAPPGAAPAP<br>GIFSSQPGHTPHPAASRDPVARTSPLQTPAAPGAAAGPALSPVPPV<br>VHLTLRQAGDDFSRRYRRDFAEMSSQLHLTPFTARGRFATVVEELF<br>RDGVNWGRIVAFFEFGGVMCVESVNREMSPLVDNIALWMTEYLNRH<br>LHTWIQDNGGWDAFVELYGPSMRPLFDFSWLSLKTLLSLALVGACI<br>TLGAYLGHK |
| NP_612815.1<br>Bcl-X(L)<br>(BCL2-like 1 isoform 1)<br>[Homo sapiens] | MSQSNRELVVDFLSYKLSQKGYSWSQFSDVEENRTEAPEGTESEME<br>TPSAINGNPSWHLADSPAVNGATGHSSSLDAREVIPMAAVKQALRE<br>AGDEFELRYRRAFSDLTSQLHITPGTAYQSFEQVVNELFRDGVNWG<br>RIVAFFSFGGALCVESVDKEMQVLVSRIAAWMATYLNDHLEPWIQE<br>NGGWDTFVELYGNNAAAESRKGQERFNRWFLTGMTVAGVVLLGSLF<br>SRK |
| AAC51660.1<br>apoptosis inhibitor<br>survivin [Homo sapiens] | MGAPTLPPAWQPFLKDHRISTFKNWPFLEGCACTPERMAEAGFIHC<br>PTENEPDLAQCFFCFKELEGWEPDDDPIEEHKKHSSGCAFLSVKKQ<br>FEELTLGEFLKLDRERAKNKIAKETNNKKKEFEETAKKVRRAIEQL<br>AAMD |
| AAF64255.1<br>Mcl-1 [Homo sapiens] | MFGLKRNAVIGLNLYCGGAGLGAGSGGATRPGGRLLATEKEASARR<br>EIGGGEAGAVIGGSAGASPPSTLTPDSRRVARPPPIGAEVPDVTAT<br>PARLLFFAPTRRAAPLEEMEAPAADAIMSPEEELDGYEPEPLGKRP<br>AVLPLLELVGESGNNTSTDGSLPSTPPPAEEEEDDLYRQSLEIISR<br>YLREQATGAKDTKPMGRSGATSRKALETLRRVGDGVQRNHETAFQG<br>MLRKLDIKNEDDVKSLSRVMIHVFSDGVTNWGRIVTLISFGAFVAK<br>HLKTINQESCIEPLAESITDVLVRTKRDWLVKQRGWDGFVEFFHVE<br>DLEGGIRNVLLAFAGVAGVGAGLAYLIR |

SEQ ID NOS: 44889-44892

The one or more antigenic peptides can in one embodiment comprise one or more fragments from one or more cancer antigens capable of interacting with one or more MHC class 1 molecules.

The one or more antigenic peptides can in another embodiment comprise one or more fragments from one or more cancer antigens capable of interacting with one or more MHC class 2 molecules.

The one or more antigenic peptides can in one embodiment comprise one or more fragments from BclX(L).

The one or more antigenic peptides can in one embodiment comprise one or more fragments from Bcl-2.

The one or more antigenic peptides can in one embodiment comprise one or more fragments from Survivin.

The one or more antigenic peptides can in one embodiment comprise one or more fragments from Mcl-1.

Preferred fragments of BclX(L) capable of interacting with one or more MHC class 1 molecules are listed in table B.

TABLE B

Prediction of cancer antigen BclX(L) specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 8-mers | | | | | | |
| 57 | HLADSPAV | 0.691 | 28 | SB | Sequence | A0201 |
| 213 | FLTGMTVA | 0.687 | 29 | SB | Sequence | A0201 |
| 166 | AAWMATYL | 0.477 | 285 | WB | Sequence | A0201 |
| 160 | VLVSRIAA | 0.463 | 333 | WB | Sequence | A0201 |
| 119 | YQSFEQVV | 0.436 | 448 | WB | Sequence | A0201 |
| 147 | GALCVESV | 0.431 | 472 | WB | Sequence | A0201 |
| 223 | VLLGSLFS | 0.427 | 494 | WB | Sequence | A0201 |
| 213 | FLTGMTVA | 0.777 | 11 | SB | Sequence | A0202 |
| 57 | HLADSPAV | 0.771 | 11 | SB | Sequence | A0202 |
| 119 | YQSFEQVV | 0.590 | 84 | WB | Sequence | A0202 |
| 218 | TVAGVVLL | 0.565 | 110 | WB | Sequence | A0202 |
| 11 | FLSYKLSQ | 0.545 | 137 | WB | Sequence | A0202 |
| 82 | MAAVKQAL | 0.512 | 195 | WB | Sequence | A0202 |
| 73 | SLDAREVI | 0.475 | 294 | WB | Sequence | A0202 |
| 192 | ELYGNNAA | 0.444 | 410 | WB | Sequence | A0202 |
| 217 | MTVAGVVL | 0.440 | 425 | WB | Sequence | A0202 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 160 | VLVSRIAA | 0.434 | 454 | WB | Sequence | A0202 |
| 1 | SQSNRELV | 0.434 | 457 | WB | Sequence | A0202 |
| 213 | FLTGMTVA | 0.852 | 4 | SB | Sequence | A0203 |
| 57 | HLADSPAV | 0.831 | 6 | SB | Sequence | A0203 |
| 160 | VLVSRIAA | 0.642 | 48 | SB | Sequence | A0203 |
| 158 | MQVLVSRI | 0.602 | 74 | WB | Sequence | A0203 |
| 11 | FLSYKLSQ | 0.582 | 92 | WB | Sequence | A0203 |
| 133 | GVNWGRIV | 0.581 | 92 | WB | Sequence | A0203 |
| 216 | GMTVAGVV | 0.579 | 94 | WB | Sequence | A0203 |
| 119 | YQSFEQVV | 0.578 | 96 | WB | Sequence | A0203 |
| 164 | RIAAWMAT | 0.573 | 101 | WB | Sequence | A0203 |
| 78 | EVIPMAAV | 0.486 | 261 | WB | Sequence | A0203 |
| 1 | SQSNRELV | 0.481 | 274 | WB | Sequence | A0203 |
| 217 | MTVAGVVL | 0.467 | 318 | WB | Sequence | A0203 |
| 147 | GALCVESV | 0.464 | 328 | WB | Sequence | A0203 |
| 221 | GVVLLGSL | 0.443 | 412 | WB | Sequence | A0203 |
| 218 | TVAGVVLL | 0.440 | 429 | WB | Sequence | A0203 |
| 57 | HLADSPAV | 0.555 | 122 | WB | Sequence | A0204 |
| 153 | SVDKEMQV | 0.431 | 469 | WB | Sequence | A0204 |
| 57 | HLADSPAV | 0.780 | 10 | SB | Sequence | A0206 |
| 158 | MQVLVSRI | 0.733 | 18 | SB | Sequence | A0206 |
| 213 | FLTGMTVA | 0.682 | 31 | SB | Sequence | A0206 |
| 1 | SQSNRELV | 0.677 | 32 | SB | Sequence | A0206 |
| 119 | YQSFEQVV | 0.677 | 33 | SB | Sequence | A0206 |
| 138 | RIVAFFSF | 0.653 | 42 | SB | Sequence | A0206 |
| 164 | RIAAWMAT | 0.575 | 99 | WB | Sequence | A0206 |
| 147 | GALCVESV | 0.568 | 106 | WB | Sequence | A0206 |
| 166 | AAWMATYL | 0.567 | 108 | WB | Sequence | A0206 |
| 217 | MTVAGVVL | 0.563 | 112 | WB | Sequence | A0206 |
| 160 | VLVSRIAA | 0.517 | 185 | WB | Sequence | A0206 |
| 42 | SEMETPSA | 0.514 | 191 | WB | Sequence | A0206 |
| 78 | EVIPMAAV | 0.496 | 233 | WB | Sequence | A0206 |
| 153 | SVDKEMQV | 0.493 | 240 | WB | Sequence | A0206 |
| 57 | HLADSPAV | 0.955 | 1 | SB | Sequence | A0211 |
| 153 | SVDKEMQV | 0.898 | 3 | SB | Sequence | A0211 |
| 213 | FLTGMTVA | 0.893 | 3 | SB | Sequence | A0211 |
| 73 | SLDAREVI | 0.877 | 3 | SB | Sequence | A0211 |
| 192 | ELYGNNAA | 0.834 | 6 | SB | Sequence | A0211 |
| 218 | TVAGVVLL | 0.797 | 8 | SB | Sequence | A0211 |
| 172 | YLNDHLEP | 0.751 | 14 | SB | Sequence | A0211 |
| 78 | EVIPMAAV | 0.739 | 16 | SB | Sequence | A0211 |
| 216 | GMTVAGVV | 0.718 | 21 | SB | Sequence | A0211 |
| 160 | VLVSRIAA | 0.684 | 30 | SB | Sequence | A0211 |
| 223 | VLLGSLFS | 0.683 | 30 | SB | Sequence | A0211 |
| 133 | GVNWGRIV | 0.668 | 36 | SB | Sequence | A0211 |
| 212 | WFLTGMTV | 0.668 | 36 | SB | Sequence | A0211 |
| 144 | SFGGALCV | 0.591 | 83 | WB | Sequence | A0211 |
| 72 | SSLDAREV | 0.590 | 84 | WB | Sequence | A0211 |
| 106 | DLTSQLHI | 0.564 | 111 | WB | Sequence | A0211 |
| 119 | YQSFEQVV | 0.545 | 136 | WB | Sequence | A0211 |
| 81 | PMAAVKQA | 0.532 | 158 | WB | Sequence | A0211 |
| 11 | FLSYKLSQ | 0.511 | 198 | WB | Sequence | A0211 |
| 166 | AAWMATYL | 0.456 | 360 | WB | Sequence | A0211 |
| 1 | SQSNRELV | 0.439 | 431 | WB | Sequence | A0211 |
| 147 | GALCVESV | 0.439 | 434 | WB | Sequence | A0211 |
| 57 | HLADSPAV | 0.915 | 2 | SB | Sequence | A0212 |
| 192 | ELYGNNAA | 0.813 | 7 | SB | Sequence | A0212 |
| 213 | FLTGMTVA | 0.801 | 8 | SB | Sequence | A0212 |
| 153 | SVDKEMQV | 0.732 | 18 | SB | Sequence | A0212 |
| 73 | SLDAREVI | 0.714 | 22 | SB | Sequence | A0212 |
| 160 | VLVSRIAA | 0.662 | 38 | SB | Sequence | A0212 |
| 172 | YLNDHLEP | 0.662 | 38 | SB | Sequence | A0212 |
| 119 | YQSFEQVV | 0.586 | 88 | WB | Sequence | A0212 |
| 78 | EVIPMAAV | 0.585 | 88 | WB | Sequence | A0212 |
| 223 | VLLGSLFS | 0.582 | 92 | WB | Sequence | A0212 |
| 11 | FLSYKLSQ | 0.573 | 101 | WB | Sequence | A0212 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 212 | WFLTGMTV | 0.541 | 142 | WB | Sequence | A0212 |
| 216 | GMTVAGVV | 0.466 | 321 | WB | Sequence | A0212 |
| 57 | HLADSPAV | 0.892 | 3 | SB | Sequence | A0216 |
| 153 | SVDKEMQV | 0.817 | 7 | SB | Sequence | A0216 |
| 213 | FLTGMTVA | 0.761 | 13 | SB | Sequence | A0216 |
| 192 | ELYGNNAA | 0.715 | 21 | SB | Sequence | A0216 |
| 78 | EVIPMAAV | 0.666 | 37 | SB | Sequence | A0216 |
| 218 | TVAGVVLL | 0.657 | 41 | SB | Sequence | A0216 |
| 73 | SLDAREVI | 0.640 | 49 | SB | Sequence | A0216 |
| 144 | SFGGALCV | 0.630 | 54 | WB | Sequence | A0216 |
| 216 | GMTVAGVV | 0.613 | 65 | WB | Sequence | A0216 |
| 166 | AAWMATYL | 0.603 | 73 | WB | Sequence | A0216 |
| 160 | VLVSRIAA | 0.583 | 91 | WB | Sequence | A0216 |
| 212 | WFLTGMTV | 0.565 | 110 | WB | Sequence | A0216 |
| 11 | FLSYKLSQ | 0.488 | 255 | WB | Sequence | A0216 |
| 106 | DLTSQLHI | 0.487 | 258 | WB | Sequence | A0216 |
| 133 | GVNWGRIV | 0.470 | 308 | WB | Sequence | A0216 |
| 81 | PMAAVKQA | 0.469 | 311 | WB | Sequence | A0216 |
| 118 | AYQSFEQV | 0.461 | 342 | WB | Sequence | A0216 |
| 223 | VLLGSLFS | 0.442 | 417 | WB | Sequence | A0216 |
| 147 | GALCVESV | 0.438 | 436 | WB | Sequence | A0216 |
| 57 | HLADSPAV | 0.924 | 2 | SB | Sequence | A0219 |
| 213 | FLTGMTVA | 0.668 | 36 | SB | Sequence | A0219 |
| 153 | SVDKEMQV | 0.597 | 78 | WB | Sequence | A0219 |
| 73 | SLDAREVI | 0.576 | 98 | WB | Sequence | A0219 |
| 218 | TVAGVVLL | 0.517 | 185 | WB | Sequence | A0219 |
| 192 | ELYGNNAA | 0.486 | 259 | WB | Sequence | A0219 |
| 212 | WFLTGMTV | 0.458 | 352 | WB | Sequence | A0219 |
| 166 | AAWMATYL | 0.455 | 362 | WB | Sequence | A0219 |
| 106 | DLTSQLHI | 0.448 | 390 | WB | Sequence | A0219 |
| 223 | VLLGSLFS | 0.431 | 471 | WB | Sequence | A0219 |
| 12 | LSYKLSQK | 0.761 | 13 | SB | Sequence | A0301 |
| 8 | VVDFLSYK | 0.551 | 128 | WB | Sequence | A0301 |
| 224 | LLGSLFSR | 0.487 | 257 | WB | Sequence | A0301 |
| 8 | VVDFLSYK | 0.751 | 14 | SB | Sequence | A1101 |
| 12 | LSYKLSQK | 0.721 | 20 | SB | Sequence | A1101 |
| 79 | VIPMAAVK | 0.509 | 203 | WB | Sequence | A1101 |
| 124 | QVVNELFR | 0.472 | 302 | WB | Sequence | A1101 |
| 7 | LVVDFLSY | 0.457 | 355 | WB | Sequence | A1101 |
| 197 | NAAAESRK | 0.455 | 363 | WB | Sequence | A1101 |
| 135 | NWGRIVAF | 0.600 | 75 | WB | Sequence | A2301 |
| 138 | RIVAFFSF | 0.466 | 321 | WB | Sequence | A2301 |
| 222 | VVLLGSLF | 0.461 | 339 | WB | Sequence | A2301 |
| 135 | NWGRIVAF | 0.617 | 62 | WB | Sequence | A2402 |
| 118 | AYQSFEQV | 0.569 | 105 | WB | Sequence | A2403 |
| 78 | EVIPMAAV | 0.598 | 77 | WB | Sequence | A2601 |
| 7 | LVVDFLSY | 0.541 | 144 | WB | Sequence | A2601 |
| 78 | EVIPMAAV | 0.862 | 4 | SB | Sequence | A2602 |
| 7 | LVVDFLSY | 0.797 | 9 | SB | Sequence | A2602 |
| 112 | HITPGTAY | 0.755 | 14 | SB | Sequence | A2602 |
| 97 | ELRYRRAF | 0.589 | 85 | WB | Sequence | A2602 |
| 138 | RIVAFFSF | 0.529 | 164 | WB | Sequence | A2602 |
| 112 | HITPGTAY | 0.597 | 78 | WB | Sequence | A2902 |
| 7 | LVVDFLSY | 0.480 | 276 | WB | Sequence | A2902 |
| 204 | KGQERFNR | 0.743 | 16 | SB | Sequence | A3101 |
| 224 | LLGSLFSR | 0.697 | 26 | SB | Sequence | A3101 |
| 157 | EMQVLVSR | 0.583 | 90 | WB | Sequence | A3101 |
| 70 | HSSSLDAR | 0.577 | 97 | WB | Sequence | A3101 |
| 83 | AAVKQALR | 0.539 | 146 | WB | Sequence | A3101 |
| 95 | EFELRYRR | 0.509 | 201 | WB | Sequence | A3101 |
| 124 | QVVNELFR | 0.453 | 369 | WB | Sequence | A3101 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 12 | LSYKLSQK | 0.447 | 397 | WB | Sequence | A3101 |
| | | | | | | |
| 95 | EFELRYRR | 0.823 | 6 | SB | Sequence | A3301 |
| 157 | EMQVLVSR | 0.738 | 16 | SB | Sequence | A3301 |
| 94 | DEFELRYR | 0.650 | 43 | SB | Sequence | A3301 |
| 201 | ESRKGQER | 0.606 | 71 | WB | Sequence | A3301 |
| 224 | LLGSLFSR | 0.538 | 148 | WB | Sequence | A3301 |
| 70 | HSSSLDAR | 0.463 | 332 | WB | Sequence | A3301 |
| | | | | | | |
| 124 | QVVNELFR | 0.803 | 8 | SB | Sequence | A6801 |
| 70 | HSSSLDAR | 0.775 | 11 | SB | Sequence | A6801 |
| 197 | NAAAESRK | 0.681 | 31 | SB | Sequence | A6801 |
| 12 | LSYKLSQK | 0.647 | 45 | SB | Sequence | A6801 |
| 157 | EMQVLVSR | 0.599 | 76 | WB | Sequence | A6801 |
| 196 | NNAAAESR | 0.585 | 88 | WB | Sequence | A6801 |
| 83 | AAVKQALR | 0.535 | 153 | WB | Sequence | A6801 |
| 201 | ESRKGQER | 0.532 | 158 | WB | Sequence | A6801 |
| 165 | IAAWMATY | 0.532 | 158 | WB | Sequence | A6801 |
| 95 | EFELRYRR | 0.511 | 198 | WB | Sequence | A6801 |
| 117 | TAYQSFEQ | 0.507 | 208 | WB | Sequence | A6801 |
| 8 | VVDFLSYK | 0.481 | 273 | WB | Sequence | A6801 |
| 94 | DEFELRYR | 0.457 | 357 | WB | Sequence | A6801 |
| 26 | FSDVEENR | 0.442 | 418 | WB | Sequence | A6801 |
| 224 | LLGSLFSR | 0.430 | 476 | WB | Sequence | A6801 |
| | | | | | | |
| 78 | EVIPMAAV | 0.888 | 3 | SB | Sequence | A6802 |
| 218 | TVAGVVLL | 0.790 | 9 | SB | Sequence | A6802 |
| 215 | TGMTVAGV | 0.742 | 16 | SB | Sequence | A6802 |
| 217 | MTVAGVVL | 0.697 | 26 | SB | Sequence | A6802 |
| 82 | MAAVKQAL | 0.633 | 52 | WB | Sequence | A6802 |
| 57 | HLADSPAV | 0.549 | 131 | WB | Sequence | A6802 |
| 207 | ERFNRWFL | 0.481 | 273 | WB | Sequence | A6802 |
| 60 | DSPAVNGA | 0.473 | 300 | WB | Sequence | A6802 |
| 192 | ELYGNNAA | 0.447 | 395 | WB | Sequence | A6802 |
| 91 | EAGDEFEL | 0.436 | 444 | WB | Sequence | A6802 |
| | | | | | | |
| 78 | EVIPMAAV | 0.812 | 7 | SB | Sequence | A6901 |
| 57 | HLADSPAV | 0.740 | 16 | SB | Sequence | A6901 |
| 192 | ELYGNNAA | 0.570 | 104 | WB | Sequence | A6901 |
| 217 | MTVAGVVL | 0.544 | 138 | WB | Sequence | A6901 |
| 218 | TVAGVVLL | 0.507 | 206 | WB | Sequence | A6901 |
| 91 | EAGDEFEL | 0.489 | 252 | WB | Sequence | A6901 |
| 153 | SVDKEMQV | 0.437 | 441 | WB | Sequence | A6901 |
| 212 | WFLTGMTV | 0.436 | 445 | WB | Sequence | A6901 |
| | | | | | | |
| 61 | SPAVNGAT | 0.657 | 41 | SB | Sequence | B0702 |
| 82 | MAAVKQAL | 0.468 | 316 | WB | Sequence | B0702 |
| 166 | AAWMATYL | 0.430 | 477 | WB | Sequence | B0702 |
| | | | | | | |
| 97 | ELRYRRAF | 0.589 | 85 | WB | Sequence | B0801 |
| | | | | | | |
| 7 | LVVDFLSY | 0.511 | 198 | WB | Sequence | B1501 |
| 138 | RIVAFFSF | 0.493 | 240 | WB | Sequence | B1501 |
| 112 | HITPGTAY | 0.492 | 243 | WB | Sequence | B1501 |
| 165 | IAAWMATY | 0.473 | 300 | WB | Sequence | B1501 |
| 97 | ELRYRRAF | 0.439 | 430 | WB | Sequence | B1501 |
| 222 | VVLLGSLF | 0.433 | 461 | WB | Sequence | B1501 |
| | | | | | | |
| 206 | QERFNRWF | 0.528 | 165 | WB | Sequence | B1801 |
| 5 | RELVVDFL | 0.517 | 185 | WB | Sequence | B1801 |
| 122 | FEQVVNEL | 0.508 | 205 | WB | Sequence | B1801 |
| | | | | | | |
| 210 | NRWFLTGM | 0.510 | 200 | WB | Sequence | B2705 |
| | | | | | | |
| 165 | IAAWMATY | 0.806 | 8 | SB | Sequence | B3501 |
| 7 | LVVDFLSY | 0.629 | 55 | WB | Sequence | B3501 |
| 82 | MAAVKQAL | 0.591 | 83 | WB | Sequence | B3501 |
| 112 | HITPGTAY | 0.543 | 140 | WB | Sequence | B3501 |
| 75 | DAREVIPM | 0.516 | 187 | WB | Sequence | B3501 |
| 142 | FFSFGGAL | 0.499 | 226 | WB | Sequence | B3501 |
| 61 | SPAVNGAT | 0.478 | 283 | WB | Sequence | B3501 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 166 | AAWMATYL | 0.476 | 289 | WB | Sequence | B3501 |
| 217 | MTVAGVVL | 0.470 | 307 | WB | Sequence | B3501 |
| 5 | RELVVDFL | 0.624 | 58 | WB | Sequence | B4001 |
| 122 | FEQVVNEL | 0.618 | 62 | WB | Sequence | B4001 |
| 5 | RELVVDFL | 0.442 | 420 | WB | Sequence | B4002 |
| 156 | KEMQVLVS | 0.430 | 478 | WB | Sequence | B4403 |
| 77 | REVIPMAA | 0.434 | 456 | WB | Sequence | B4501 |
| 161 | LVSRIAAW | 0.626 | 57 | WB | Sequence | B5801 |
| 165 | IAAWMATY | 0.593 | 81 | WB | Sequence | B5801 |
| 16 | LSQKGYSW | 0.586 | 88 | WB | Sequence | B5801 |
| 19 | KGYSWSQF | 0.543 | 141 | WB | Sequence | B5801 |
| 138 | RIVAFFSF | 0.467 | 320 | WB | Sequence | B5801 |
| 49 | AINGNPSW | 0.447 | 394 | WB | Sequence | B5801 |

9.mers

| pos | peptide | logscore | affinity (nM) | Bind Level | Protein Name | Allele |
|---|---|---|---|---|---|---|
| 104 | FSDLTSQLH | 0.482 | 270 | WB | Sequence | A0101 |
| 143 | FSFGGALCV | 0.518 | 183 | WB | Sequence | A0201 |
| 217 | MTVAGVVLL | 0.478 | 282 | WB | Sequence | A0201 |
| 172 | YLNDHLEPW | 0.739 | 16 | SB | Sequence | A0202 |
| 217 | MTVAGVVLL | 0.604 | 72 | WB | Sequence | A0202 |
| 165 | IAAWMATYL | 0.568 | 107 | WB | Sequence | A0202 |
| 213 | FLTGMTVAG | 0.564 | 111 | WB | Sequence | A0202 |
| 11 | FLSYKLSQK | 0.520 | 179 | WB | Sequence | A0202 |
| 161 | LVSRIAAWM | 0.450 | 382 | WB | Sequence | A0202 |
| 8 | VVDFLSYKL | 0.449 | 387 | WB | Sequence | A0202 |
| 192 | ELYGNNAAA | 0.447 | 394 | WB | Sequence | A0202 |
| 81 | PMAAVKQAL | 0.437 | 441 | WB | Sequence | A0202 |
| 216 | GMTVAGVVL | 0.436 | 448 | WB | Sequence | A0202 |
| 214 | LTGMTVAGV | 0.691 | 28 | SB | Sequence | A0203 |
| 217 | MTVAGVVLL | 0.609 | 69 | WB | Sequence | A0203 |
| 165 | IAAWMATYL | 0.530 | 161 | WB | Sequence | A0203 |
| 84 | AVKQALREA | 0.518 | 183 | WB | Sequence | A0203 |
| 110 | QLHITPGTA | 0.507 | 206 | WB | Sequence | A0203 |
| 172 | YLNDHLEPW | 0.493 | 240 | WB | Sequence | A0203 |
| 117 | TAYQSFEQV | 0.473 | 300 | WB | Sequence | A0203 |
| 11 | FLSYKLSQK | 0.447 | 396 | WB | Sequence | A0203 |
| 214 | LTGMTVAGV | 0.504 | 213 | WB | Sequence | A0204 |
| 217 | MTVAGVVLL | 0.475 | 291 | WB | Sequence | A0204 |
| 109 | SQLHITPGT | 0.712 | 22 | SB | Sequence | A0206 |
| 217 | MTVAGVVLL | 0.675 | 33 | SB | Sequence | A0206 |
| 117 | TAYQSFEQV | 0.650 | 43 | SB | Sequence | A0206 |
| 1 | SQSNRELVV | 0.648 | 45 | SB | Sequence | A0206 |
| 143 | FSFGGALCV | 0.584 | 90 | WB | Sequence | A0206 |
| 77 | REVIPMAAV | 0.572 | 103 | WB | Sequence | A0206 |
| 165 | IAAWMATYL | 0.551 | 128 | WB | Sequence | A0206 |
| 158 | MQVLVSRIA | 0.544 | 138 | WB | Sequence | A0206 |
| 214 | LTGMTVAGV | 0.492 | 244 | WB | Sequence | A0206 |
| 172 | YLNDHLEPW | 0.464 | 331 | WB | Sequence | A0206 |
| 42 | SEMETPSAI | 0.440 | 426 | WB | Sequence | A0206 |
| 192 | ELYGNNAAA | 0.863 | 4 | SB | Sequence | A0211 |
| 143 | FSFGGALCV | 0.797 | 8 | SB | Sequence | A0211 |
| 81 | PMAAVKQAL | 0.794 | 9 | SB | Sequence | A0211 |
| 172 | YLNDHLEPW | 0.715 | 21 | SB | Sequence | A0211 |
| 153 | SVDKEMQVL | 0.703 | 24 | SB | Sequence | A0211 |
| 8 | VVDFLSYKL | 0.696 | 26 | SB | Sequence | A0211 |
| 217 | MTVAGVVLL | 0.634 | 52 | WB | Sequence | A0211 |
| 112 | HITPGTAYQ | 0.618 | 62 | WB | Sequence | A0211 |
| 117 | TAYQSFEQV | 0.617 | 63 | WB | Sequence | A0211 |
| 223 | VLLGSLFSR | 0.581 | 93 | WB | Sequence | A0211 |
| 213 | FLTGMTVAG | 0.581 | 93 | WB | Sequence | A0211 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 133 | GVNWGRIVA | 0.575 | 99 | WB | Sequence | A0211 |
| 216 | GMTVAGVVL | 0.553 | 126 | WB | Sequence | A0211 |
| 185 | GGWDTFVEL | 0.550 | 130 | WB | Sequence | A0211 |
| 103 | AFSDLTSQL | 0.472 | 302 | WB | Sequence | A0211 |
| 176 | HLEPWIQEN | 0.427 | 493 | WB | Sequence | A0211 |
| 192 | ELYGNNAAA | 0.845 | 5 | SB | Sequence | A0212 |
| 81 | PMAAVKQAL | 0.789 | 9 | SB | Sequence | A0212 |
| 143 | FSFGGALCV | 0.702 | 25 | SB | Sequence | A0212 |
| 172 | YLNDHLEPW | 0.673 | 34 | SB | Sequence | A0212 |
| 223 | VLLGSLFSR | 0.573 | 101 | WB | Sequence | A0212 |
| 8 | VVDFLSYKL | 0.561 | 115 | WB | Sequence | A0212 |
| 153 | SVDKEMQVL | 0.535 | 153 | WB | Sequence | A0212 |
| 213 | FLTGMTVAG | 0.521 | 178 | WB | Sequence | A0212 |
| 118 | AYQSFEQVV | 0.476 | 290 | WB | Sequence | A0212 |
| 192 | ELYGNNAAA | 0.741 | 16 | SB | Sequence | A0216 |
| 81 | PMAAVKQAL | 0.710 | 22 | SB | Sequence | A0216 |
| 143 | FSFGGALCV | 0.652 | 42 | SB | Sequence | A0216 |
| 117 | TAYQSFEQV | 0.593 | 81 | WB | Sequence | A0216 |
| 112 | HITPGTAYQ | 0.512 | 196 | WB | Sequence | A0216 |
| 216 | GMTVAGVVL | 0.430 | 479 | WB | Sequence | A0216 |
| 81 | PMAAVKQAL | 0.675 | 33 | SB | Sequence | A0219 |
| 143 | FSFGGALCV | 0.652 | 43 | SB | Sequence | A0219 |
| 192 | ELYGNNAAA | 0.541 | 142 | WB | Sequence | A0219 |
| 117 | TAYQSFEQV | 0.497 | 232 | WB | Sequence | A0219 |
| 172 | YLNDHLEPW | 0.459 | 348 | WB | Sequence | A0219 |
| 223 | VLLGSLFSR | 0.456 | 361 | WB | Sequence | A0219 |
| 214 | LTGMTVAGV | 0.450 | 384 | WB | Sequence | A0219 |
| 224 | LLGSLFSRK | 0.762 | 13 | SB | Sequence | A0301 |
| 11 | FLSYKLSQK | 0.710 | 23 | SB | Sequence | A0301 |
| 164 | RIAAWMATY | 0.698 | 26 | SB | Sequence | A0301 |
| 223 | VLLGSLFSR | 0.615 | 64 | WB | Sequence | A0301 |
| 7 | LVVDFLSYK | 0.497 | 231 | WB | Sequence | A0301 |
| 7 | LVVDFLSYK | 0.767 | 12 | SB | Sequence | A1101 |
| 224 | LLGSLFSRK | 0.612 | 66 | WB | Sequence | A1101 |
| 223 | VLLGSLFSR | 0.595 | 79 | WB | Sequence | A1101 |
| 164 | RIAAWMATY | 0.575 | 99 | WB | Sequence | A1101 |
| 148 | ALCVESVDK | 0.529 | 163 | WB | Sequence | A1101 |
| 78 | EVIPMAAVK | 0.509 | 201 | WB | Sequence | A1101 |
| 11 | FLSYKLSQK | 0.430 | 477 | WB | Sequence | A1101 |
| 99 | RYRRAFSDL | 0.690 | 28 | SB | Sequence | A2301 |
| 135 | NWGRIVAFF | 0.644 | 47 | SB | Sequence | A2301 |
| 137 | GRIVAFFSF | 0.459 | 346 | WB | Sequence | A2301 |
| 135 | NWGRIVAFF | 0.739 | 16 | SB | Sequence | A2402 |
| 99 | RYRRAFSDL | 0.550 | 129 | WB | Sequence | A2402 |
| 99 | RYRRAFSDL | 0.748 | 15 | SB | Sequence | A2403 |
| 121 | SFEQVVNEL | 0.557 | 120 | WB | Sequence | A2403 |
| 118 | AYQSFEQVV | 0.487 | 256 | WB | Sequence | A2403 |
| 6 | ELVVDFLSY | 0.532 | 158 | WB | Sequence | A2601 |
| 164 | RIAAWMATY | 0.495 | 235 | WB | Sequence | A2601 |
| 164 | RIAAWMATY | 0.923 | 2 | SB | Sequence | A2602 |
| 6 | ELVVDFLSY | 0.873 | 3 | SB | Sequence | A2602 |
| 161 | LVSRIAAWM | 0.677 | 32 | SB | Sequence | A2602 |
| 153 | SVDKEMQVL | 0.639 | 49 | SB | Sequence | A2602 |
| 78 | EVIPMAAVK | 0.496 | 234 | WB | Sequence | A2602 |
| 217 | MTVAGVVLL | 0.481 | 273 | WB | Sequence | A2602 |
| 111 | LHITPGTAY | 0.553 | 125 | WB | Sequence | A2902 |
| 6 | ELVVDFLSY | 0.539 | 146 | WB | Sequence | A2902 |
| 164 | RIAAWMATY | 0.463 | 334 | WB | Sequence | A3002 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 82 | MAAVKQALR | 0.766 | 12 | SB | Sequence | A3101 |
| 223 | VLLGSLFSR | 0.686 | 30 | SB | Sequence | A3101 |
| 7 | LVVDFLSYK | 0.573 | 101 | WB | Sequence | A3101 |
| 156 | KEMQVLVSR | 0.474 | 296 | WB | Sequence | A3101 |
| 94 | DEFELRYRR | 0.721 | 20 | SB | Sequence | A3301 |
| 82 | MAAVKQALR | 0.665 | 37 | SB | Sequence | A3301 |
| 97 | ELRYRRAFS | 0.614 | 65 | WB | Sequence | A3301 |
| 223 | VLLGSLFSR | 0.581 | 92 | WB | Sequence | A3301 |
| 91 | EAGDEFELR | 0.532 | 157 | WB | Sequence | A3301 |
| 25 | QFSDVEENR | 0.531 | 159 | WB | Sequence | A3301 |
| 78 | EVIPMAAVK | 0.848 | 5 | SB | Sequence | A6801 |
| 82 | MAAVKQALR | 0.813 | 7 | SB | Sequence | A6801 |
| 7 | LVVDFLSYK | 0.786 | 10 | SB | Sequence | A6801 |
| 91 | EAGDEFELR | 0.710 | 23 | SB | Sequence | A6801 |
| 123 | EQVVNELFR | 0.635 | 51 | WB | Sequence | A6801 |
| 11 | FLSYKLSQK | 0.558 | 119 | WB | Sequence | A6801 |
| 94 | DEFELRYRR | 0.544 | 139 | WB | Sequence | A6801 |
| 25 | QFSDVEENR | 0.540 | 145 | WB | Sequence | A6801 |
| 196 | NNAAAESRK | 0.474 | 295 | WB | Sequence | A6801 |
| 223 | VLLGSLFSR | 0.430 | 477 | WB | Sequence | A6801 |
| 217 | MTVAGVVLL | 0.796 | 9 | SB | Sequence | A6802 |
| 117 | TAYQSFEQV | 0.729 | 18 | SB | Sequence | A6802 |
| 215 | TGMTVAGVV | 0.654 | 42 | SB | Sequence | A6802 |
| 0 | MSQSNRELV | 0.587 | 86 | WB | Sequence | A6802 |
| 21 | YSWSQFSDV | 0.549 | 131 | WB | Sequence | A6802 |
| 143 | FSFGGALCV | 0.526 | 169 | WB | Sequence | A6802 |
| 152 | ESVDKEMQV | 0.525 | 171 | WB | Sequence | A6802 |
| 169 | MATYLNDHL | 0.520 | 180 | WB | Sequence | A6802 |
| 192 | ELYGNNAAA | 0.509 | 202 | WB | Sequence | A6802 |
| 140 | VAFFSFGGA | 0.500 | 222 | WB | Sequence | A6802 |
| 214 | LTGMTVAGV | 0.464 | 330 | WB | Sequence | A6802 |
| 165 | IAAWMATYL | 0.451 | 378 | WB | Sequence | A6802 |
| 217 | MTVAGVVLL | 0.705 | 24 | SB | Sequence | A6901 |
| 117 | TAYQSFEQV | 0.623 | 58 | WB | Sequence | A6901 |
| 192 | ELYGNNAAA | 0.604 | 72 | WB | Sequence | A6901 |
| 143 | FSFGGALCV | 0.589 | 85 | WB | Sequence | A6901 |
| 214 | LTGMTVAGV | 0.557 | 120 | WB | Sequence | A6901 |
| 21 | YSWSQFSDV | 0.489 | 252 | WB | Sequence | A6901 |
| 36 | APEGTESEM | 0.519 | 181 | WB | Sequence | B0702 |
| 61 | SPAVNGATG | 0.454 | 369 | WB | Sequence | B0702 |
| 114 | TPGTAYQSF | 0.450 | 382 | WB | Sequence | B0702 |
| 96 | FELRYRRAF | 0.497 | 229 | WB | Sequence | B0801 |
| 164 | RIAAWMATY | 0.586 | 87 | WB | Sequence | B1501 |
| 88 | ALREAGDEF | 0.520 | 180 | WB | Sequence | B1501 |
| 96 | FELRYRRAF | 0.752 | 14 | SB | Sequence | B1801 |
| 206 | QERFNRWFL | 0.592 | 82 | WB | Sequence | B1801 |
| 122 | FEQVVNELF | 0.523 | 174 | WB | Sequence | B1801 |
| 182 | QENGGWDTF | 0.476 | 290 | WB | Sequence | B1801 |
| 137 | GRIVAFFSF | 0.554 | 124 | WB | Sequence | B2705 |
| 101 | RRAFSDLTS | 0.434 | 459 | WB | Sequence | B2705 |
| 114 | TPGTAYQSF | 0.705 | 24 | SB | Sequence | B3501 |
| 165 | IAAWMATYL | 0.649 | 44 | SB | Sequence | B3501 |
| 36 | APEGTESEM | 0.540 | 144 | WB | Sequence | B3501 |
| 6 | ELVVDFLSY | 0.531 | 159 | WB | Sequence | B3501 |
| 111 | LHITPGTAY | 0.437 | 441 | WB | Sequence | B3501 |
| 53 | NPSWHLADS | 0.429 | 480 | WB | Sequence | B3501 |
| 164 | RIAAWMATY | 0.428 | 485 | WB | Sequence | B3501 |
| 90 | REAGDEFEL | 0.788 | 9 | SB | Sequence | B4001 |
| 206 | QERFNRWFL | 0.597 | 78 | WB | Sequence | B4001 |
| 182 | QENGGWDTF | 0.525 | 170 | WB | Sequence | B4001 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 122 | FEQVVNELF | 0.453 | 370 | WB | Sequence | B4001 |
| 96 | FELRYRRAF | 0.446 | 399 | WB | Sequence | B4001 |
| 42 | SEMETPSAI | 0.504 | 215 | WB | Sequence | B4002 |
| 96 | FELRYRRAF | 0.473 | 299 | WB | Sequence | B4002 |
| 182 | QENGGWDTF | 0.434 | 455 | WB | Sequence | B4402 |
| 42 | SEMETPSAI | 0.467 | 319 | WB | Sequence | B4403 |
| 5 | RELVVDFLS | 0.444 | 407 | WB | Sequence | B4403 |
| 77 | REVIPMAAV | 0.438 | 438 | WB | Sequence | B4501 |
| 165 | IAAWMATYL | 0.442 | 416 | WB | Sequence | B5301 |
| 80 | IPMAAVKQA | 0.716 | 21 | SB | Sequence | B5401 |
| 48 | SAINGNPSW | 0.641 | 48 | SB | Sequence | B5801 |
| 15 | KLSQKGYSW | 0.596 | 79 | WB | Sequence | B5801 |
| 165 | IAAWMATYL | 0.559 | 118 | WB | Sequence | B5801 |
| 172 | YLNDHLEPW | 0.506 | 208 | WB | Sequence | B5801 |
| | | | 10-mers | | | |
| 104 | FSDLTSQLHI | 0.427 | 492 | WB | Sequence | A0101 |
| 172 | YLNDHLEPWI | 0.866 | 4 | SB | Sequence | A0201 |
| 213 | FLTGMTVAGV | 0.841 | 5 | SB | Sequence | A0201 |
| 164 | RIAAWMATYL | 0.651 | 43 | SB | Sequence | A0201 |
| 168 | WMATYLNDHL | 0.573 | 101 | WB | Sequence | A0201 |
| 7 | LVVDFLSYKL | 0.524 | 173 | WB | Sequence | A0201 |
| 73 | SLDAREVIPM | 0.491 | 246 | WB | Sequence | A0201 |
| 160 | VLVSRIAAWM | 0.486 | 259 | WB | Sequence | A0201 |
| 153 | SVDKEMQVLV | 0.473 | 298 | WB | Sequence | A0201 |
| 216 | GMTVAGVVLL | 0.444 | 411 | WB | Sequence | A0201 |
| 213 | FLTGMTVAGV | 0.811 | 7 | SB | Sequence | A0202 |
| 168 | WMATYLNDHL | 0.772 | 11 | SB | Sequence | A0202 |
| 164 | RIAAWMATYL | 0.763 | 13 | SB | Sequence | A0202 |
| 7 | LVVDFLSYKL | 0.651 | 43 | SB | Sequence | A0202 |
| 102 | RAFSDLTSQL | 0.617 | 63 | WB | Sequence | A0202 |
| 73 | SLDAREVIPM | 0.616 | 63 | WB | Sequence | A0202 |
| 172 | YLNDHLEPWI | 0.587 | 87 | WB | Sequence | A0202 |
| 216 | GMTVAGVVLL | 0.496 | 233 | WB | Sequence | A0202 |
| 145 | FGGALCVESV | 0.480 | 276 | WB | Sequence | A0202 |
| 160 | VLVSRIAAWM | 0.430 | 476 | WB | Sequence | A0202 |
| 213 | FLTGMTVAGV | 0.936 | 2 | SB | Sequence | A0203 |
| 172 | YLNDHLEPWI | 0.891 | 3 | SB | Sequence | A0203 |
| 164 | RIAAWMATYL | 0.837 | 5 | SB | Sequence | A0203 |
| 168 | WMATYLNDHL | 0.647 | 45 | SB | Sequence | A0203 |
| 160 | VLVSRIAAWM | 0.613 | 66 | WB | Sequence | A0203 |
| 139 | IVAFFSFGGA | 0.596 | 79 | WB | Sequence | A0203 |
| 7 | LVVDFLSYKL | 0.581 | 92 | WB | Sequence | A0203 |
| 125 | VVNELFRDGV | 0.570 | 105 | WB | Sequence | A0203 |
| 216 | GMTVAGVVLL | 0.476 | 289 | WB | Sequence | A0203 |
| 102 | RAFSDLTSQL | 0.470 | 308 | WB | Sequence | A0203 |
| 214 | LTGMTVAGVV | 0.468 | 315 | WB | Sequence | A0203 |
| 116 | GTAYQSFEQV | 0.463 | 335 | WB | Sequence | A0203 |
| 213 | FLTGMTVAGV | 0.697 | 26 | SB | Sequence | A0204 |
| 172 | YLNDHLEPWI | 0.664 | 37 | SB | Sequence | A0204 |
| 73 | SLDAREVIPM | 0.477 | 287 | WB | Sequence | A0204 |
| 164 | RIAAWMATYL | 0.476 | 290 | WB | Sequence | A0204 |
| 7 | LVVDFLSYKL | 0.468 | 317 | WB | Sequence | A0204 |
| 49 | AINGNPSWHL | 0.452 | 374 | WB | Sequence | A0204 |
| 213 | FLTGMTVAGV | 0.869 | 4 | SB | Sequence | A0206 |
| 164 | RIAAWMATYL | 0.809 | 7 | SB | Sequence | A0206 |
| 172 | YLNDHLEPWI | 0.722 | 20 | SB | Sequence | A0206 |
| 158 | MQVLVSRIAA | 0.689 | 28 | SB | Sequence | A0206 |
| 7 | LVVDFLSYKL | 0.684 | 30 | SB | Sequence | A0206 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 168 | WMATYLNDHL | 0.680 | 31 | SB | Sequence | A0206 |
| 109 | SQLHITPGTA | 0.652 | 43 | SB | Sequence | A0206 |
| 116 | GTAYQSFEQV | 0.572 | 102 | WB | Sequence | A0206 |
| 153 | SVDKEMQVLV | 0.558 | 119 | WB | Sequence | A0206 |
| 102 | RAFSDLTSQL | 0.543 | 140 | WB | Sequence | A0206 |
| 156 | KEMQVLVSRI | 0.508 | 204 | WB | Sequence | A0206 |
| 181 | IQENGGWDTF | 0.508 | 205 | WB | Sequence | A0206 |
| 139 | IVAFFSFGGA | 0.495 | 235 | WB | Sequence | A0206 |
| 125 | VVNELFRDGV | 0.483 | 269 | WB | Sequence | A0206 |
| 117 | TAYQSFEQVV | 0.450 | 383 | WB | Sequence | A0206 |
| 213 | FLTGMTVAGV | 0.966 | 1 | SB | Sequence | A0211 |
| 172 | YLNDHLEPWI | 0.951 | 1 | SB | Sequence | A0211 |
| 153 | SVDKEMQVLV | 0.905 | 2 | SB | Sequence | A0211 |
| 73 | SLDAREVIPM | 0.826 | 6 | SB | Sequence | A0211 |
| 216 | GMTVAGVVLL | 0.737 | 17 | SB | Sequence | A0211 |
| 7 | LVVDFLSYKL | 0.730 | 18 | SB | Sequence | A0211 |
| 164 | RIAAWMATYL | 0.711 | 22 | SB | Sequence | A0211 |
| 125 | VVNELFRDGV | 0.687 | 29 | SB | Sequence | A0211 |
| 49 | AINGNPSWHL | 0.686 | 29 | SB | Sequence | A0211 |
| 168 | WMATYLNDHL | 0.685 | 30 | SB | Sequence | A0211 |
| 117 | TAYQSFEQVV | 0.633 | 52 | WB | Sequence | A0211 |
| 160 | VLVSRIAAWM | 0.632 | 53 | WB | Sequence | A0211 |
| 142 | FFSFGGALCV | 0.567 | 107 | WB | Sequence | A0211 |
| 223 | VLLGSLFSRK | 0.498 | 228 | WB | Sequence | A0211 |
| 102 | RAFSDLTSQL | 0.453 | 372 | WB | Sequence | A0211 |
| 116 | GTAYQSFEQV | 0.429 | 481 | WB | Sequence | A0211 |
| 213 | FLTGMTVAGV | 0.932 | 2 | SB | Sequence | A0212 |
| 172 | YLNDHLEPWI | 0.916 | 2 | SB | Sequence | A0212 |
| 153 | SVDKEMQVLV | 0.742 | 16 | SB | Sequence | A0212 |
| 168 | WMATYLNDHL | 0.697 | 26 | SB | Sequence | A0212 |
| 125 | VVNELFRDGV | 0.695 | 27 | SB | Sequence | A0212 |
| 7 | LVVDFLSYKL | 0.648 | 45 | SB | Sequence | A0212 |
| 160 | VLVSRIAAWM | 0.604 | 72 | WB | Sequence | A0212 |
| 73 | SLDAREVIPM | 0.594 | 80 | WB | Sequence | A0212 |
| 49 | AINGNPSWHL | 0.570 | 104 | WB | Sequence | A0212 |
| 164 | RIAAWMATYL | 0.550 | 129 | WB | Sequence | A0212 |
| 142 | FFSFGGALCV | 0.494 | 238 | WB | Sequence | A0212 |
| 223 | VLLGSLFSRK | 0.487 | 258 | WB | Sequence | A0212 |
| 117 | TAYQSFEQVV | 0.482 | 270 | WB | Sequence | A0212 |
| 192 | ELYGNNAAAE | 0.475 | 293 | WB | Sequence | A0212 |
| 216 | GMTVAGVVLL | 0.440 | 426 | WB | Sequence | A0212 |
| 213 | FLTGMTVAGV | 0.911 | 2 | SB | Sequence | A0216 |
| 172 | YLNDHLEPWI | 0.869 | 4 | SB | Sequence | A0216 |
| 153 | SVDKEMQVLV | 0.772 | 11 | SB | Sequence | A0216 |
| 168 | WMATYLNDHL | 0.696 | 26 | SB | Sequence | A0216 |
| 164 | RIAAWMATYL | 0.695 | 27 | SB | Sequence | A0216 |
| 49 | AINGNPSWHL | 0.680 | 31 | SB | Sequence | A0216 |
| 160 | VLVSRIAAWM | 0.657 | 41 | SB | Sequence | A0216 |
| 7 | LVVDFLSYKL | 0.643 | 47 | SB | Sequence | A0216 |
| 73 | SLDAREVIPM | 0.617 | 62 | WB | Sequence | A0216 |
| 216 | GMTVAGVVLL | 0.588 | 85 | WB | Sequence | A0216 |
| 117 | TAYQSFEQVV | 0.530 | 161 | WB | Sequence | A0216 |
| 142 | FFSFGGALCV | 0.487 | 256 | WB | Sequence | A0216 |
| 116 | GTAYQSFEQV | 0.444 | 408 | WB | Sequence | A0216 |
| 213 | FLTGMTVAGV | 0.927 | 2 | SB | Sequence | A0219 |
| 172 | YLNDHLEPWI | 0.884 | 3 | SB | Sequence | A0219 |
| 168 | WMATYLNDHL | 0.611 | 67 | WB | Sequence | A0219 |
| 49 | AINGNPSWHL | 0.543 | 140 | WB | Sequence | A0219 |
| 7 | LVVDFLSYKL | 0.539 | 146 | WB | Sequence | A0219 |
| 153 | SVDKEMQVLV | 0.533 | 156 | WB | Sequence | A0219 |
| 164 | RIAAWMATYL | 0.449 | 387 | WB | Sequence | A0219 |
| 73 | SLDAREVIPM | 0.445 | 404 | WB | Sequence | A0219 |
| 160 | VLVSRIAAWM | 0.441 | 421 | WB | Sequence | A0219 |
| 223 | VLLGSLFSRK | 0.767 | 12 | SB | Sequence | A0301 |
| 6 | ELVVDFLSYK | 0.504 | 213 | WB | Sequence | A0301 |
| 147 | GALCVESVDK | 0.488 | 253 | WB | Sequence | A0301 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 222 | VVLLGSLFSR | 0.457 | 356 | WB | Sequence | A0301 |
| 77 | REVIPMAAVK | 0.453 | 372 | WB | Sequence | A0301 |
| 223 | VLLGSLFSRK | 0.742 | 16 | SB | Sequence | A1101 |
| 222 | VVLLGSLFSR | 0.681 | 31 | SB | Sequence | A1101 |
| 147 | GALCVESVDK | 0.515 | 190 | WB | Sequence | A1101 |
| 24 | SQFSDVEENR | 0.470 | 310 | WB | Sequence | A1101 |
| 121 | SFEQVVNELF | 0.581 | 92 | WB | Sequence | A2301 |
| 171 | TYLNDHLEPW | 0.547 | 134 | WB | Sequence | A2301 |
| 121 | SFEQVVNELF | 0.528 | 165 | WB | Sequence | A2402 |
| 171 | TYLNDHLEPW | 0.520 | 180 | WB | Sequence | A2402 |
| 113 | ITPGTAYQSF | 0.460 | 343 | WB | Sequence | A2402 |
| 171 | TYLNDHLEPW | 0.739 | 16 | SB | Sequence | A2403 |
| 121 | SFEQVVNELF | 0.546 | 136 | WB | Sequence | A2403 |
| 113 | ITPGTAYQSF | 0.508 | 204 | WB | Sequence | A2403 |
| 35 | EAPEGTESEM | 0.448 | 390 | WB | Sequence | A2601 |
| 164 | RIAAWMATYL | 0.626 | 57 | WB | Sequence | A2602 |
| 113 | ITPGTAYQSF | 0.581 | 92 | WB | Sequence | A2602 |
| 160 | VLVSRIAAWM | 0.553 | 126 | WB | Sequence | A2602 |
| 35 | EAPEGTESEM | 0.507 | 207 | WB | Sequence | A2602 |
| 152 | ESVDKEMQVL | 0.490 | 249 | WB | Sequence | A2602 |
| 95 | EFELRYRRAF | 0.483 | 268 | WB | Sequence | A2602 |
| 110 | QLHITPGTAY | 0.506 | 209 | WB | Sequence | A2902 |
| 222 | VVLLGSLFSR | 0.683 | 30 | SB | Sequence | A3101 |
| 129 | LFRDGVNWGR | 0.667 | 36 | SB | Sequence | A3101 |
| 202 | SRKGQERFNR | 0.608 | 69 | WB | Sequence | A3101 |
| 81 | PMAAVKQALR | 0.521 | 177 | WB | Sequence | A3101 |
| 222 | VVLLGSLFSR | 0.572 | 103 | WB | Sequence | A3301 |
| 129 | LFRDGVNWGR | 0.553 | 126 | WB | Sequence | A3301 |
| 10 | DFLSYKLSQK | 0.470 | 308 | WB | Sequence | A3301 |
| 6 | ELVVDFLSYK | 0.702 | 25 | SB | Sequence | A6801 |
| 24 | SQFSDVEENR | 0.532 | 158 | WB | Sequence | A6801 |
| 222 | VVLLGSLFSR | 0.516 | 188 | WB | Sequence | A6801 |
| 194 | YGNNAAAESR | 0.493 | 240 | WB | Sequence | A6801 |
| 78 | EVIPMAAVKQ | 0.454 | 368 | WB | Sequence | A6801 |
| 169 | MATYLNDHLE | 0.448 | 394 | WB | Sequence | A6801 |
| 139 | IVAFFSFGGA | 0.742 | 16 | SB | Sequence | A6802 |
| 116 | GTAYQSFEQV | 0.673 | 34 | SB | Sequence | A6802 |
| 7 | LVVDFLSYKL | 0.659 | 39 | SB | Sequence | A6802 |
| 120 | QSFEQVVNEL | 0.618 | 62 | WB | Sequence | A6802 |
| 213 | FLTGMTVAGV | 0.577 | 96 | WB | Sequence | A6802 |
| 117 | TAYQSFEQVV | 0.561 | 115 | WB | Sequence | A6802 |
| 164 | RIAAWMATYL | 0.519 | 182 | WB | Sequence | A6802 |
| 65 | NGATGHSSSL | 0.496 | 234 | WB | Sequence | A6802 |
| 218 | TVAGVVLLGS | 0.491 | 246 | WB | Sequence | A6802 |
| 145 | FGGALCVESV | 0.474 | 294 | WB | Sequence | A6802 |
| 125 | VVNELFRDGV | 0.465 | 328 | WB | Sequence | A6802 |
| 161 | LVSRIAAWMA | 0.451 | 380 | WB | Sequence | A6802 |
| 215 | TGMTVAGVVL | 0.450 | 382 | WB | Sequence | A6802 |
| 153 | SVDKEMQVLV | 0.534 | 155 | WB | Sequence | A6901 |
| 213 | FLTGMTVAGV | 0.527 | 166 | WB | Sequence | A6901 |
| 117 | TAYQSFEQVV | 0.466 | 324 | WB | Sequence | A6901 |
| 7 | LVVDFLSYKL | 0.451 | 378 | WB | Sequence | A6901 |
| 164 | RIAAWMATYL | 0.443 | 412 | WB | Sequence | A6901 |
| 116 | GTAYQSFEQV | 0.427 | 493 | WB | Sequence | A6901 |
| 80 | IPMAAVKQAL | 0.704 | 24 | SB | Sequence | B0702 |
| 17 | SQKGYSWSQF | 0.572 | 102 | WB | Sequence | B1501 |
| 110 | QLHITPGTAY | 0.557 | 121 | WB | Sequence | B1501 |
| 133 | GVNWGRIVAF | 0.548 | 132 | WB | Sequence | B1501 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 181 | IQENGGWDTF | 0.522 | 175 | WB | Sequence | B1501 |
| 12 | LSYKLSQKGY | 0.455 | 364 | WB | Sequence | B1501 |
| 5 | RELVVDFLSY | 0.759 | 13 | SB | Sequence | B1801 |
| 163 | SRIAAWMATY | 0.588 | 86 | WB | Sequence | B2705 |
| 101 | RRAFSDLTSQ | 0.461 | 340 | WB | Sequence | B2705 |
| 80 | IPMAAVKQAL | 0.609 | 69 | WB | Sequence | B3501 |
| 178 | EPWIQENGGW | 0.604 | 72 | WB | Sequence | B3501 |
| 91 | EAGDEFELRY | 0.566 | 109 | WB | Sequence | B3501 |
| 35 | EAPEGTESEM | 0.563 | 112 | WB | Sequence | B3501 |
| 87 | QALREAGDEF | 0.508 | 206 | WB | Sequence | B3501 |
| 61 | SPAVNGATGH | 0.490 | 249 | WB | Sequence | B3501 |
| 46 | TPSAINGNPS | 0.483 | 269 | WB | Sequence | B3501 |
| 133 | GVNWGRIVAF | 0.455 | 362 | WB | Sequence | B3501 |
| 140 | VAFFSFGGAL | 0.454 | 367 | WB | Sequence | B3501 |
| 190 | FVELYGNNAA | 0.439 | 430 | WB | Sequence | B3501 |
| 200 | AESRKGQERF | 0.453 | 370 | WB | Sequence | B4501 |
| 178 | EPWIQENGGW | 0.603 | 73 | WB | Sequence | B5301 |
| 2 | QSNRELVVDF | 0.474 | 295 | WB | Sequence | B5801 |
| 159 | QVLVSRIAAW | 0.467 | 320 | WB | Sequence | B5801 |
| 47 | PSAINGNPSW | 0.437 | 444 | WB | Sequence | B5801 |
| | | | 11-mers | | | |
| 213 | FLTGMTVAGVV | 0.627 | 56 | WB | Sequence | A0201 |
| 73 | SLDAREVIPMA | 0.561 | 115 | WB | Sequence | A0201 |
| 160 | VLVSRIAAWMA | 0.547 | 135 | WB | Sequence | A0201 |
| 57 | HLADSPAVNGA | 0.539 | 147 | WB | Sequence | A0201 |
| 172 | YLNDHLEPWIQ | 0.480 | 278 | WB | Sequence | A0201 |
| 88 | ALREAGDEFEL | 0.470 | 309 | WB | Sequence | A0201 |
| 119 | YQSFEQVVNEL | 0.426 | 497 | WB | Sequence | A0201 |
| 57 | HLADSPAVNGA | 0.763 | 12 | SB | Sequence | A0202 |
| 213 | FLTGMTVAGVV | 0.754 | 14 | SB | Sequence | A0202 |
| 119 | YQSFEQVVNEL | 0.734 | 17 | SB | Sequence | A0202 |
| 88 | ALREAGDEFEL | 0.679 | 32 | SB | Sequence | A0202 |
| 172 | YLNDHLEPWIQ | 0.611 | 67 | WB | Sequence | A0202 |
| 139 | IVAFFSFGGAL | 0.558 | 119 | WB | Sequence | A0202 |
| 218 | TVAGVVLLGSL | 0.537 | 149 | WB | Sequence | A0202 |
| 160 | VLVSRIAAWMA | 0.525 | 170 | WB | Sequence | A0202 |
| 15 | KLSQKGYSWSQ | 0.450 | 382 | WB | Sequence | A0202 |
| 6 | ELVVDFLSYKL | 0.449 | 387 | WB | Sequence | A0202 |
| 73 | SLDAREVIPMA | 0.446 | 401 | WB | Sequence | A0202 |
| 213 | FLTGMTVAGVV | 0.864 | 4 | SB | Sequence | A0203 |
| 57 | HLADSPAVNGA | 0.844 | 5 | SB | Sequence | A0203 |
| 138 | RIVAFFSFGGA | 0.752 | 14 | SB | Sequence | A0203 |
| 160 | VLVSRIAAWMA | 0.649 | 44 | SB | Sequence | A0203 |
| 218 | TVAGVVLLGSL | 0.619 | 61 | WB | Sequence | A0203 |
| 88 | ALREAGDEFEL | 0.604 | 72 | WB | Sequence | A0203 |
| 119 | YQSFEQVVNEL | 0.567 | 108 | WB | Sequence | A0203 |
| 172 | YLNDHLEPWIQ | 0.565 | 110 | WB | Sequence | A0203 |
| 49 | AINGNPSWHLA | 0.562 | 114 | WB | Sequence | A0203 |
| 209 | FNRWFLTGMTV | 0.494 | 239 | WB | Sequence | A0203 |
| 139 | IVAFFSFGGAL | 0.487 | 257 | WB | Sequence | A0203 |
| 73 | SLDAREVIPMA | 0.480 | 276 | WB | Sequence | A0203 |
| 82 | MAAVKQALREA | 0.430 | 477 | WB | Sequence | A0203 |
| 124 | QVVNELFRDGV | 0.426 | 496 | WB | Sequence | A0203 |
| 213 | FLTGMTVAGVV | 0.584 | 90 | WB | Sequence | A0204 |
| 88 | ALREAGDEFEL | 0.526 | 168 | WB | Sequence | A0204 |
| 160 | VLVSRIAAWMA | 0.517 | 185 | WB | Sequence | A0204 |
| 172 | YLNDHLEPWIQ | 0.517 | 186 | WB | Sequence | A0204 |
| 73 | SLDAREVIPMA | 0.485 | 263 | WB | Sequence | A0204 |
| 213 | FLTGMTVAGVV | 0.746 | 15 | SB | Sequence | A0206 |
| 138 | RIVAFFSFGGA | 0.725 | 19 | SB | Sequence | A0206 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 181 | IQENGGWDTFV | 0.704 | 24 | SB | Sequence | A0206 |
| 119 | YQSFEQVVNEL | 0.671 | 35 | SB | Sequence | A0206 |
| 48 | SAINGNPSWHL | 0.664 | 38 | SB | Sequence | A0206 |
| 124 | QVVNELFRDGV | 0.619 | 62 | WB | Sequence | A0206 |
| 160 | VLVSRIAAWMA | 0.584 | 90 | WB | Sequence | A0206 |
| 86 | KQALREAGDEF | 0.547 | 134 | WB | Sequence | A0206 |
| 57 | HLADSPAVNGA | 0.509 | 201 | WB | Sequence | A0206 |
| 218 | TVAGVVLLGSL | 0.456 | 358 | WB | Sequence | A0206 |
| 88 | ALREAGDEFEL | 0.442 | 420 | WB | Sequence | A0206 |
| 109 | SQLHITPGTAY | 0.441 | 422 | WB | Sequence | A0206 |
| 213 | FLTGMTVAGVV | 0.943 | 1 | SB | Sequence | A0211 |
| 73 | SLDAREVIPMA | 0.876 | 3 | SB | Sequence | A0211 |
| 172 | YLNDHLEPWIQ | 0.852 | 4 | SB | Sequence | A0211 |
| 88 | ALREAGDEFEL | 0.799 | 8 | SB | Sequence | A0211 |
| 57 | HLADSPAVNGA | 0.787 | 10 | SB | Sequence | A0211 |
| 160 | VLVSRIAAWMA | 0.759 | 13 | SB | Sequence | A0211 |
| 15 | KLSQKGYSWSQ | 0.743 | 16 | SB | Sequence | A0211 |
| 6 | ELVVDFLSYKL | 0.682 | 31 | SB | Sequence | A0211 |
| 218 | TVAGVVLLGSL | 0.628 | 55 | WB | Sequence | A0211 |
| 49 | AINGNPSWHLA | 0.612 | 66 | WB | Sequence | A0211 |
| 212 | WFLTGMTVAGV | 0.577 | 97 | WB | Sequence | A0211 |
| 141 | AFFSFGGALCV | 0.571 | 103 | WB | Sequence | A0211 |
| 144 | SFGGALCVESV | 0.569 | 105 | WB | Sequence | A0211 |
| 79 | VIPMAAVKQAL | 0.568 | 107 | WB | Sequence | A0211 |
| 124 | QVVNELFRDGV | 0.535 | 152 | WB | Sequence | A0211 |
| 130 | FRDGVNWGRIV | 0.516 | 187 | WB | Sequence | A0211 |
| 48 | SAINGNPSWHL | 0.515 | 189 | WB | Sequence | A0211 |
| 192 | ELYGNNAAAES | 0.504 | 214 | WB | Sequence | A0211 |
| 150 | CVESVDKEMQV | 0.489 | 252 | WB | Sequence | A0211 |
| 116 | GTAYQSFEQVV | 0.452 | 376 | WB | Sequence | A0211 |
| 139 | IVAFFSFGGAL | 0.444 | 411 | WB | Sequence | A0211 |
| 213 | FLTGMTVAGVV | 0.824 | 6 | SB | Sequence | A0212 |
| 172 | YLNDHLEPWIQ | 0.812 | 7 | SB | Sequence | A0212 |
| 88 | ALREAGDEFEL | 0.779 | 10 | SB | Sequence | A0212 |
| 73 | SLDAREVIPMA | 0.745 | 15 | SB | Sequence | A0212 |
| 57 | HLADSPAVNGA | 0.714 | 22 | SB | Sequence | A0212 |
| 160 | VLVSRIAAWMA | 0.681 | 31 | SB | Sequence | A0212 |
| 79 | VIPMAAVKQAL | 0.604 | 72 | WB | Sequence | A0212 |
| 15 | KLSQKGYSWSQ | 0.568 | 107 | WB | Sequence | A0212 |
| 212 | WFLTGMTVAGV | 0.504 | 213 | WB | Sequence | A0212 |
| 6 | ELVVDFLSYKL | 0.451 | 380 | WB | Sequence | A0212 |
| 130 | FRDGVNWGRIV | 0.431 | 473 | WB | Sequence | A0212 |
| 213 | FLTGMTVAGVV | 0.862 | 4 | SB | Sequence | A0216 |
| 88 | ALREAGDEFEL | 0.821 | 6 | SB | Sequence | A0216 |
| 73 | SLDAREVIPMA | 0.744 | 16 | SB | Sequence | A0216 |
| 160 | VLVSRIAAWMA | 0.649 | 44 | SB | Sequence | A0216 |
| 150 | CVESVDKEMQV | 0.641 | 48 | SB | Sequence | A0216 |
| 57 | HLADSPAVNGA | 0.595 | 79 | WB | Sequence | A0216 |
| 144 | SFGGALCVESV | 0.591 | 83 | WB | Sequence | A0216 |
| 172 | YLNDHLEPWIQ | 0.581 | 92 | WB | Sequence | A0216 |
| 15 | KLSQKGYSWSQ | 0.561 | 115 | WB | Sequence | A0216 |
| 6 | ELVVDFLSYKL | 0.544 | 138 | WB | Sequence | A0216 |
| 218 | TVAGVVLLGSL | 0.534 | 154 | WB | Sequence | A0216 |
| 141 | AFFSFGGALCV | 0.526 | 168 | WB | Sequence | A0216 |
| 181 | IQENGGWDTFV | 0.497 | 231 | WB | Sequence | A0216 |
| 124 | QVVNELFRDGV | 0.490 | 249 | WB | Sequence | A0216 |
| 79 | VIPMAAVKQAL | 0.487 | 257 | WB | Sequence | A0216 |
| 192 | ELYGNNAAAES | 0.478 | 283 | WB | Sequence | A0216 |
| 48 | SAINGNPSWHL | 0.468 | 315 | WB | Sequence | A0216 |
| 212 | WFLTGMTVAGV | 0.437 | 441 | WB | Sequence | A0216 |
| 49 | AINGNPSWHLA | 0.436 | 447 | WB | Sequence | A0216 |
| 213 | FLTGMTVAGVV | 0.781 | 10 | SB | Sequence | A0219 |
| 57 | HLADSPAVNGA | 0.730 | 18 | SB | Sequence | A0219 |
| 172 | YLNDHLEPWIQ | 0.695 | 27 | SB | Sequence | A0219 |
| 73 | SLDAREVIPMA | 0.609 | 68 | WB | Sequence | A0219 |
| 88 | ALREAGDEFEL | 0.549 | 131 | WB | Sequence | A0219 |
| 212 | WFLTGMTVAGV | 0.524 | 172 | WB | Sequence | A0219 |
| 160 | VLVSRIAAWMA | 0.499 | 225 | WB | Sequence | A0219 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 222 | VVLLGSLFSRK | 0.688 | 29 | SB | Sequence | A0301 |
| 222 | VVLLGSLFSRK | 0.786 | 10 | SB | Sequence | A1101 |
| 221 | GVVLLGSLFSR | 0.596 | 78 | WB | Sequence | A1101 |
| 67 | ATGHSSSLDAR | 0.505 | 212 | WB | Sequence | A1101 |
| 5 | RELVVDFLSYK | 0.428 | 489 | WB | Sequence | A1101 |
| 135 | NWGRIVAFFSF | 0.695 | 26 | SB | Sequence | A2301 |
| 171 | TYLNDHLEPWI | 0.576 | 98 | WB | Sequence | A2301 |
| 167 | AWMATYLNDHL | 0.534 | 154 | WB | Sequence | A2301 |
| 13 | SYKLSQKGYSW | 0.531 | 159 | WB | Sequence | A2301 |
| 135 | NWGRIVAFFSF | 0.746 | 15 | SB | Sequence | A2402 |
| 171 | TYLNDHLEPWI | 0.746 | 15 | SB | Sequence | A2402 |
| 167 | AWMATYLNDHL | 0.520 | 180 | WB | Sequence | A2402 |
| 171 | TYLNDHLEPWI | 0.660 | 39 | SB | Sequence | A2403 |
| 167 | AWMATYLNDHL | 0.523 | 174 | WB | Sequence | A2403 |
| 13 | SYKLSQKGYSW | 0.523 | 174 | WB | Sequence | A2403 |
| 112 | HITPGTAYQSF | 0.431 | 473 | WB | Sequence | A2403 |
| 159 | QVLVSRIAAWM | 0.640 | 49 | SB | Sequence | A2602 |
| 112 | HITPGTAYQSF | 0.573 | 101 | WB | Sequence | A2602 |
| 180 | WIQENGGWDTF | 0.518 | 183 | WB | Sequence | A2602 |
| 11 | FLSYKLSQKGY | 0.516 | 188 | WB | Sequence | A2602 |
| 132 | DGVNWGRIVAF | 0.462 | 336 | WB | Sequence | A2602 |
| 218 | TVAGVVLLGSL | 0.443 | 415 | WB | Sequence | A2602 |
| 109 | SQLHITPGTAY | 0.516 | 188 | WB | Sequence | A2902 |
| 222 | VVLLGSLFSRK | 0.435 | 453 | WB | Sequence | A3001 |
| 99 | RYRRAFSDLTS | 0.428 | 486 | WB | Sequence | A3001 |
| 221 | GVVLLGSLFSR | 0.598 | 77 | WB | Sequence | A3101 |
| 121 | SFEQVVNELFR | 0.552 | 127 | WB | Sequence | A3101 |
| 201 | ESRKGQERFNR | 0.511 | 198 | WB | Sequence | A3101 |
| 67 | ATGHSSSLDAR | 0.475 | 292 | WB | Sequence | A3101 |
| 5 | RELVVDFLSYK | 0.442 | 417 | WB | Sequence | A3101 |
| 193 | LYGNNAAAESR | 0.435 | 449 | WB | Sequence | A3101 |
| 201 | ESRKGQERFNR | 0.690 | 28 | SB | Sequence | A3301 |
| 128 | ELFRDGVNWGR | 0.634 | 52 | WB | Sequence | A3301 |
| 91 | EAGDEFELRYR | 0.538 | 148 | WB | Sequence | A3301 |
| 121 | SFEQVVNELFR | 0.472 | 303 | WB | Sequence | A3301 |
| 221 | GVVLLGSLFSR | 0.447 | 396 | WB | Sequence | A3301 |
| 95 | EFELRYRRAFS | 0.435 | 449 | WB | Sequence | A3301 |
| 128 | ELFRDGVNWGR | 0.739 | 16 | SB | Sequence | A6801 |
| 23 | WSQFSDVEENR | 0.667 | 36 | SB | Sequence | A6801 |
| 201 | ESRKGQERFNR | 0.666 | 36 | SB | Sequence | A6801 |
| 91 | EAGDEFELRYR | 0.643 | 47 | SB | Sequence | A6801 |
| 221 | GVVLLGSLFSR | 0.638 | 49 | SB | Sequence | A6801 |
| 80 | IPMAAVKQALR | 0.566 | 109 | WB | Sequence | A6801 |
| 121 | SFEQVVNELFR | 0.536 | 151 | WB | Sequence | A6801 |
| 218 | TVAGVVLLGSL | 0.796 | 9 | SB | Sequence | A6802 |
| 124 | QVVNELFRDGV | 0.712 | 22 | SB | Sequence | A6802 |
| 139 | IVAFFSFGGAL | 0.684 | 30 | SB | Sequence | A6802 |
| 152 | ESVDKEMQVLV | 0.613 | 65 | WB | Sequence | A6802 |
| 215 | TGMTVAGVVLL | 0.561 | 116 | WB | Sequence | A6802 |
| 6 | ELVVDFLSYKL | 0.551 | 129 | WB | Sequence | A6802 |
| 138 | RIVAFFSFGGA | 0.548 | 132 | WB | Sequence | A6802 |
| 188 | DTFVELYGNNA | 0.530 | 161 | WB | Sequence | A6802 |
| 78 | EVIPMAAVKQA | 0.516 | 188 | WB | Sequence | A6802 |
| 116 | GTAYQSFEQVV | 0.514 | 191 | WB | Sequence | A6802 |
| 75 | DAREVIPMAAV | 0.509 | 203 | WB | Sequence | A6802 |
| 57 | HLADSPAVNGA | 0.508 | 206 | WB | Sequence | A6802 |
| 217 | MTVAGVVLLGS | 0.480 | 277 | WB | Sequence | A6802 |
| 45 | ETPSAINGNPS | 0.479 | 279 | WB | Sequence | A6802 |
| 213 | FLTGMTVAGVV | 0.470 | 308 | WB | Sequence | A6802 |
| 70 | HSSSLDAREVI | 0.447 | 397 | WB | Sequence | A6802 |

TABLE B-continued

Prediction of cancer antigen BclX(L) specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 48 | SAINGNPSWHL | 0.541 | 143 | WB | Sequence | A6901 |
| 75 | DAREVIPMAAV | 0.527 | 166 | WB | Sequence | A6901 |
| 152 | ESVDKEMQVLV | 0.511 | 199 | WB | Sequence | A6901 |
| 57 | HLADSPAVNGA | 0.485 | 263 | WB | Sequence | A6901 |
| 54 | PSWHLADSPAV | 0.469 | 312 | WB | Sequence | A6901 |
| 212 | WFLTGMTVAGV | 0.453 | 369 | WB | Sequence | A6901 |
| 78 | EVIPMAAVKQA | 0.442 | 417 | WB | Sequence | A6901 |
| 6 | ELVVDFLSYKL | 0.442 | 417 | WB | Sequence | A6901 |
| 218 | TVAGVVLLGSL | 0.430 | 475 | WB | Sequence | A6901 |
| 188 | DTFVELYGNNA | 0.427 | 494 | WB | Sequence | A6901 |
| 139 | IVAFFSFGGAL | 0.518 | 183 | WB | Sequence | B0702 |
| 53 | NPSWHLADSPA | 0.499 | 224 | WB | Sequence | B0702 |
| 61 | SPAVNGATGHS | 0.457 | 355 | WB | Sequence | B0702 |
| 109 | SQLHITPGTAY | 0.605 | 72 | WB | Sequence | B1501 |
| 86 | KQALREAGDEF | 0.567 | 108 | WB | Sequence | B1501 |
| 1 | SQSNRELVVDF | 0.540 | 144 | WB | Sequence | B1501 |
| 119 | YQSFEQVVNEL | 0.515 | 189 | WB | Sequence | B1501 |
| 158 | MQVLVSRIAAW | 0.512 | 196 | WB | Sequence | B1501 |
| 162 | VSRIAAWMATY | 0.477 | 285 | WB | Sequence | B1501 |
| 11 | FLSYKLSQKGY | 0.474 | 294 | WB | Sequence | B1501 |
| 180 | WIQENGGWDTF | 0.473 | 299 | WB | Sequence | B1501 |
| 120 | QSFEQVVNELF | 0.450 | 386 | WB | Sequence | B1501 |
| 112 | HITPGTAYQSF | 0.447 | 394 | WB | Sequence | B1501 |
| 133 | GVNWGRIVAFF | 0.433 | 463 | WB | Sequence | B1501 |
| 94 | DEFELRYRRAF | 0.829 | 6 | SB | Sequence | B1801 |
| 90 | REAGDEFELRY | 0.560 | 116 | WB | Sequence | B1801 |
| 109 | SQLHITPGTAY | 0.539 | 146 | WB | Sequence | B1801 |
| 151 | VESVDKEMQVL | 0.476 | 288 | WB | Sequence | B1801 |
| 177 | LEPWIQENGGW | 0.466 | 321 | WB | Sequence | B1801 |
| 209 | FNRWFLTGMTV | 0.444 | 409 | WB | Sequence | B1801 |
| 101 | RRAFSDLTSQL | 0.563 | 113 | WB | Sequence | B2705 |
| 163 | SRIAAWMATYL | 0.470 | 310 | WB | Sequence | B2705 |
| 53 | NPSWHLADSPA | 0.623 | 59 | WB | Sequence | B3501 |
| 46 | TPSAINGNPSW | 0.485 | 263 | WB | Sequence | B3501 |
| 180 | WIQENGGWDTF | 0.474 | 297 | WB | Sequence | B3501 |
| 132 | DGVNWGRIVAF | 0.442 | 419 | WB | Sequence | B3501 |
| 119 | YQSFEQVVNEL | 0.610 | 68 | WB | Sequence | B3901 |
| 151 | VESVDKEMQVL | 0.492 | 243 | WB | Sequence | B4001 |
| 40 | TESEMETPSAI | 0.446 | 402 | WB | Sequence | B4002 |
| 30 | EENRTEAPEGT | 0.498 | 228 | WB | Sequence | B4501 |
| 46 | TPSAINGNPSW | 0.772 | 11 | SB | Sequence | B5301 |
| 53 | NPSWHLADSPA | 0.430 | 474 | WB | Sequence | B5401 |
| 170 | ATYLNDHLEPW | 0.540 | 145 | WB | Sequence | B5701 |
| 170 | ATYLNDHLEPW | 0.537 | 150 | WB | Sequence | B5801 |
| 120 | QSFEQVVNELF | 0.495 | 235 | WB | Sequence | B5801 |

SEQ ID NOS.: 45801-46593

Preferred fragments of Bcl-2 capable of interacting with one or more MHC class 1 molecules are listed in table C below.

TABLE C

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 8-mer | | | | | | |
| 84 | ALSPVPPV | 0.783 | 10 | SB | Sequence | A0201 |
| 218 | TLLSLALV | 0.723 | 20 | SB | Sequence | A0201 |
| 173 | ALWMTEYL | 0.682 | 31 | SB | Sequence | A0201 |
| 154 | GVMCVESV | 0.630 | 54 | WB | Sequence | A0201 |
| 207 | PLFDFSWL | 0.488 | 253 | WB | Sequence | A0201 |
| 215 | SLKTLLSL | 0.449 | 387 | WB | Sequence | A0201 |
| 84 | ALSPVPPV | 0.710 | 23 | SB | Sequence | A0202 |
| 213 | WLSLKTLL | 0.709 | 23 | SB | Sequence | A0202 |
| 215 | SLKTLLSL | 0.661 | 39 | SB | Sequence | A0202 |
| 207 | PLFDFSWL | 0.653 | 42 | SB | Sequence | A0202 |
| 173 | ALWMTEYL | 0.631 | 54 | WB | Sequence | A0202 |
| 154 | GVMCVESV | 0.630 | 55 | WB | Sequence | A0202 |
| 218 | TLLSLALV | 0.610 | 68 | WB | Sequence | A0202 |
| 113 | EMSSQLHL | 0.570 | 105 | WB | Sequence | A0202 |
| 224 | LVGACITL | 0.534 | 154 | WB | Sequence | A0202 |
| 129 | FATVVEEL | 0.512 | 195 | WB | Sequence | A0202 |
| 167 | PLVDNIAL | 0.508 | 204 | WB | Sequence | A0202 |
| 179 | YLNRHLHT | 0.435 | 453 | WB | Sequence | A0202 |
| 209 | FDFSWLSL | 0.432 | 464 | WB | Sequence | A0202 |
| 84 | ALSPVPPV | 0.909 | 2 | SB | Sequence | A0203 |
| 215 | SLKTLLSL | 0.853 | 4 | SB | Sequence | A0203 |
| 154 | GVMCVESV | 0.754 | 14 | SB | Sequence | A0203 |
| 179 | YLNRHLHT | 0.682 | 31 | SB | Sequence | A0203 |
| 218 | TLLSLALV | 0.673 | 34 | SB | Sequence | A0203 |
| 213 | WLSLKTLL | 0.665 | 37 | SB | Sequence | A0203 |
| 140 | GVNWGRIV | 0.581 | 92 | WB | Sequence | A0203 |
| 123 | FTARGRFA | 0.523 | 174 | WB | Sequence | A0203 |
| 173 | ALWMTEYL | 0.497 | 229 | WB | Sequence | A0203 |
| 207 | PLFDFSWL | 0.478 | 284 | WB | Sequence | A0203 |
| 84 | ALSPVPPV | 0.763 | 13 | SB | Sequence | A0204 |
| 173 | ALWMTEYL | 0.541 | 144 | WB | Sequence | A0204 |
| 218 | TLLSLALV | 0.526 | 168 | WB | Sequence | A0204 |
| 154 | GVMCVESV | 0.478 | 283 | WB | Sequence | A0204 |
| 224 | LVGACITL | 0.451 | 381 | WB | Sequence | A0204 |
| 84 | ALSPVPPV | 0.764 | 12 | SB | Sequence | A0206 |
| 154 | GVMCVESV | 0.743 | 16 | SB | Sequence | A0206 |
| 116 | SQLHLTPF | 0.737 | 17 | SB | Sequence | A0206 |
| 218 | TLLSLALV | 0.714 | 21 | SB | Sequence | A0206 |
| 145 | RIVAFFEF | 0.623 | 58 | WB | Sequence | A0206 |
| 217 | KTLLSLAL | 0.574 | 100 | WB | Sequence | A0206 |
| 173 | ALWMTEYL | 0.538 | 148 | WB | Sequence | A0206 |
| 224 | LVGACITL | 0.463 | 334 | WB | Sequence | A0206 |
| 123 | FTARGRFA | 0.462 | 335 | WB | Sequence | A0206 |
| 213 | WLSLKTLL | 0.451 | 378 | WB | Sequence | A0206 |
| 129 | FATVVEEL | 0.450 | 383 | WB | Sequence | A0206 |
| 97 | RQAGDDFS | 0.436 | 445 | WB | Sequence | A0206 |
| 84 | ALSPVPPV | 0.956 | 1 | SB | Sequence | A0211 |
| 218 | TLLSLALV | 0.954 | 1 | SB | Sequence | A0211 |
| 173 | ALWMTEYL | 0.935 | 2 | SB | Sequence | A0211 |
| 207 | PLFDFSWL | 0.934 | 2 | SB | Sequence | A0211 |
| 167 | PLVDNIAL | 0.888 | 3 | SB | Sequence | A0211 |
| 215 | SLKTLLSL | 0.819 | 7 | SB | Sequence | A0211 |
| 213 | WLSLKTLL | 0.780 | 10 | SB | Sequence | A0211 |
| 179 | YLNRHLHT | 0.716 | 21 | SB | Sequence | A0211 |
| 113 | EMSSQLHL | 0.686 | 29 | SB | Sequence | A0211 |
| 140 | GVNWGRIV | 0.668 | 36 | SB | Sequence | A0211 |
| 154 | GVMCVESV | 0.578 | 95 | WB | Sequence | A0211 |
| 148 | AFFEFGGV | 0.534 | 154 | WB | Sequence | A0211 |
| 87 | PVPPVVHL | 0.512 | 197 | WB | Sequence | A0211 |
| 228 | CITLGAYL | 0.500 | 223 | WB | Sequence | A0211 |
| 224 | LVGACITL | 0.500 | 223 | WB | Sequence | A0211 |
| 223 | ALVGACIT | 0.479 | 281 | WB | Sequence | A0211 |
| 27 | YEWDAGDV | 0.472 | 303 | WB | Sequence | A0211 |
| 151 | EFGGVMCV | 0.452 | 377 | WB | Sequence | A0211 |
| 221 | SLALVGAC | 0.445 | 405 | WB | Sequence | A0211 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 84 | ALSPVPPV | 0.874 | 3 | SB | Sequence | A0212 |
| 173 | ALWMTEYL | 0.860 | 4 | SB | Sequence | A0212 |
| 218 | TLLSLALV | 0.857 | 4 | SB | Sequence | A0212 |
| 207 | PLFDFSWL | 0.836 | 5 | SB | Sequence | A0212 |
| 167 | PLVDNIAL | 0.787 | 9 | SB | Sequence | A0212 |
| 215 | SLKTLLSL | 0.756 | 13 | SB | Sequence | A0212 |
| 179 | YLNRHLHT | 0.720 | 20 | SB | Sequence | A0212 |
| 113 | EMSSQLHL | 0.594 | 80 | WB | Sequence | A0212 |
| 213 | WLSLKTLL | 0.564 | 112 | WB | Sequence | A0212 |
| 27 | YEWDAGDV | 0.477 | 288 | WB | Sequence | A0212 |
| 154 | GVMCVESV | 0.460 | 344 | WB | Sequence | A0212 |
| 84 | ALSPVPPV | 0.926 | 2 | SB | Sequence | A0216 |
| 173 | ALWMTEYL | 0.916 | 2 | SB | Sequence | A0216 |
| 218 | TLLSLALV | 0.902 | 2 | SB | Sequence | A0216 |
| 207 | PLFDFSWL | 0.889 | 3 | SB | Sequence | A0216 |
| 167 | PLVDNIAL | 0.767 | 12 | SB | Sequence | A0216 |
| 215 | SLKTLLSL | 0.723 | 20 | SB | Sequence | A0216 |
| 213 | WLSLKTLL | 0.718 | 21 | SB | Sequence | A0216 |
| 113 | EMSSQLHL | 0.665 | 37 | SB | Sequence | A0216 |
| 154 | GVMCVESV | 0.646 | 46 | SB | Sequence | A0216 |
| 179 | YLNRHLHT | 0.631 | 53 | WB | Sequence | A0216 |
| 223 | ALVGACIT | 0.591 | 83 | WB | Sequence | A0216 |
| 224 | LVGACITL | 0.531 | 159 | WB | Sequence | A0216 |
| 87 | PVPPVVHL | 0.526 | 168 | WB | Sequence | A0216 |
| 151 | EFGGVMCV | 0.524 | 173 | WB | Sequence | A0216 |
| 228 | CITLGAYL | 0.522 | 176 | WB | Sequence | A0216 |
| 140 | GVNWGRIV | 0.470 | 308 | WB | Sequence | A0216 |
| 84 | ALSPVPPV | 0.898 | 3 | SB | Sequence | A0219 |
| 173 | ALWMTEYL | 0.871 | 4 | SB | Sequence | A0219 |
| 218 | TLLSLALV | 0.847 | 5 | SB | Sequence | A0219 |
| 207 | PLFDFSWL | 0.785 | 10 | SB | Sequence | A0219 |
| 167 | PLVDNIAL | 0.713 | 22 | SB | Sequence | A0219 |
| 113 | EMSSQLHL | 0.613 | 65 | WB | Sequence | A0219 |
| 213 | WLSLKTLL | 0.599 | 76 | WB | Sequence | A0219 |
| 154 | GVMCVESV | 0.468 | 317 | WB | Sequence | A0219 |
| 215 | SLKTLLSL | 0.466 | 322 | WB | Sequence | A0219 |
| 27 | YEWDAGDV | 0.437 | 440 | WB | Sequence | A0219 |
| 179 | YLNRHLHT | 0.436 | 447 | WB | Sequence | A0219 |
| 14 | VMKYIHYK | 0.629 | 55 | WB | Sequence | A0301 |
| 13 | IVMKYIHY | 0.514 | 193 | WB | Sequence | A0301 |
| 119 | HLTPFTAR | 0.467 | 319 | WB | Sequence | A0301 |
| 199 | ELYGPSMR | 0.456 | 360 | WB | Sequence | A0301 |
| 14 | VMKYIHYK | 0.645 | 46 | SB | Sequence | A1101 |
| 131 | TVVEELFR | 0.616 | 63 | WB | Sequence | A1101 |
| 13 | IVMKYIHY | 0.577 | 97 | WB | Sequence | A1101 |
| 142 | NWGRIVAF | 0.600 | 75 | WB | Sequence | A2301 |
| 145 | RIVAFFEF | 0.518 | 184 | WB | Sequence | A2301 |
| 204 | SMRPLFDF | 0.469 | 312 | WB | Sequence | A2301 |
| 122 | PFTARGRF | 0.441 | 424 | WB | Sequence | A2301 |
| 142 | NWGRIVAF | 0.617 | 62 | WB | Sequence | A2402 |
| 212 | SWLSLKTL | 0.459 | 349 | WB | Sequence | A2402 |
| 204 | SMRPLFDF | 0.547 | 135 | WB | Sequence | A2403 |
| 145 | RIVAFFEF | 0.437 | 441 | WB | Sequence | A2403 |
| 13 | IVMKYIHY | 0.638 | 50 | WB | Sequence | A2602 |
| 113 | EMSSQLHL | 0.445 | 406 | WB | Sequence | A2602 |
| 145 | RIVAFFEF | 0.436 | 445 | WB | Sequence | A2602 |
| 12 | EIVMKYIH | 0.430 | 478 | WB | Sequence | A2602 |
| 130 | ATVVEELF | 0.428 | 489 | WB | Sequence | A2602 |
| 13 | IVMKYIHY | 0.603 | 73 | WB | Sequence | A2902 |
| 227 | ACITLGAY | 0.449 | 387 | WB | Sequence | A2902 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 14 | VMKYIHYK | 0.593 | 81 | WB | Sequence | A3001 |
| 60 | ASRDPVAR | 0.498 | 229 | WB | Sequence | A3001 |
| 126 | RGRFATVV | 0.480 | 276 | WB | Sequence | A3001 |
| 113 | EMSSQLHL | 0.446 | 401 | WB | Sequence | A3002 |
| 204 | SMRPLFDF | 0.444 | 410 | WB | Sequence | A3002 |
| 14 | VMKYIHYK | 0.842 | 5 | SB | Sequence | A3101 |
| 119 | HLTPFTAR | 0.709 | 23 | SB | Sequence | A3101 |
| 60 | ASRDPVAR | 0.692 | 28 | SB | Sequence | A3101 |
| 102 | DFSRRYRR | 0.622 | 59 | WB | Sequence | A3101 |
| 175 | WMTEYLNR | 0.564 | 112 | WB | Sequence | A3101 |
| 131 | TVVEELFR | 0.458 | 351 | WB | Sequence | A3101 |
| 102 | DFSRRYRR | 0.883 | 3 | SB | Sequence | A3301 |
| 119 | HLTPFTAR | 0.746 | 15 | SB | Sequence | A3301 |
| 210 | DFSWLSLK | 0.672 | 34 | SB | Sequence | A3301 |
| 101 | DDFSRRYR | 0.622 | 60 | WB | Sequence | A3301 |
| 199 | ELYGPSMR | 0.615 | 64 | WB | Sequence | A3301 |
| 131 | TVVEELFR | 0.546 | 136 | WB | Sequence | A3301 |
| 14 | VMKYIHYK | 0.510 | 199 | WB | Sequence | A3301 |
| 131 | TVVEELFR | 0.843 | 5 | SB | Sequence | A6801 |
| 199 | ELYGPSMR | 0.792 | 9 | SB | Sequence | A6801 |
| 119 | HLTPFTAR | 0.733 | 18 | SB | Sequence | A6801 |
| 210 | DFSWLSLK | 0.637 | 50 | WB | Sequence | A6801 |
| 121 | TPFTARGR | 0.625 | 58 | WB | Sequence | A6801 |
| 55 | TPHPAASR | 0.581 | 93 | WB | Sequence | A6801 |
| 101 | DDFSRRYR | 0.526 | 168 | WB | Sequence | A6801 |
| 14 | VMKYIHYK | 0.524 | 171 | WB | Sequence | A6801 |
| 98 | QAGDDFSR | 0.522 | 176 | WB | Sequence | A6801 |
| 175 | WMTEYLNR | 0.505 | 211 | WB | Sequence | A6801 |
| 156 | MCVESVNR | 0.502 | 219 | WB | Sequence | A6801 |
| 102 | DFSRRYRR | 0.491 | 247 | WB | Sequence | A6801 |
| 90 | PVVHLTLR | 0.456 | 358 | WB | Sequence | A6801 |
| 154 | GVMCVESV | 0.630 | 54 | WB | Sequence | A6802 |
| 165 | MSPLVDNI | 0.606 | 70 | WB | Sequence | A6802 |
| 123 | FTARGRFA | 0.594 | 80 | WB | Sequence | A6802 |
| 129 | FATVVEEL | 0.501 | 220 | WB | Sequence | A6802 |
| 72 | QTPAAPGA | 0.474 | 297 | WB | Sequence | A6802 |
| 218 | TLLSLALV | 0.607 | 70 | WB | Sequence | A6901 |
| 123 | FTARGRFA | 0.486 | 261 | WB | Sequence | A6901 |
| 113 | EMSSQLHL | 0.470 | 309 | WB | Sequence | A6901 |
| 84 | ALSPVPPV | 0.444 | 409 | WB | Sequence | A6901 |
| 202 | GPSMRPLF | 0.599 | 76 | WB | Sequence | B0702 |
| 73 | TPAAPGAA | 0.598 | 77 | WB | Sequence | B0702 |
| 69 | SPLQTPAA | 0.539 | 146 | WB | Sequence | B0702 |
| 89 | PPVVHLTL | 0.503 | 216 | WB | Sequence | B0702 |
| 206 | RPLFDFSW | 0.445 | 403 | WB | Sequence | B0702 |
| 116 | SQLHLTPF | 0.583 | 91 | WB | Sequence | B1501 |
| 204 | SMRPLFDF | 0.523 | 173 | WB | Sequence | B1501 |
| 13 | IVMKYIHY | 0.492 | 243 | WB | Sequence | B1501 |
| 145 | RIVAFFEF | 0.447 | 397 | WB | Sequence | B1501 |
| 198 | VELYGPSM | 0.595 | 80 | WB | Sequence | B1801 |
| 177 | TEYLNRHL | 0.498 | 228 | WB | Sequence | B1801 |
| 172 | IALWMTEY | 0.475 | 292 | WB | Sequence | B1801 |
| 116 | SQLHLTPF | 0.464 | 328 | WB | Sequence | B1801 |
| 150 | FEFGGVMC | 0.452 | 375 | WB | Sequence | B1801 |
| 172 | IALWMTEY | 0.767 | 12 | SB | Sequence | B3501 |
| 149 | FFEFGGVM | 0.548 | 132 | WB | Sequence | B3501 |
| 69 | SPLQTPAA | 0.503 | 215 | WB | Sequence | B3501 |
| 111 | FAEMSSQL | 0.488 | 253 | WB | Sequence | B3501 |
| 86 | SPVPPVVH | 0.443 | 413 | WB | Sequence | B3501 |
| 73 | TPAAPGAA | 0.435 | 452 | WB | Sequence | B3501 |
| 129 | FATVVEEL | 0.430 | 475 | WB | Sequence | B3501 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 177 | TEYLNRHL | 0.547 | 133 | WB | Sequence | B4001 |
| 11 | REIVMKYI | 0.513 | 194 | WB | Sequence | B4001 |
| 150 | FEFGGVMC | 0.466 | 324 | WB | Sequence | B4001 |
| 11 | REIVMKYI | 0.497 | 231 | WB | Sequence | B4002 |
| 112 | AEMSSQLH | 0.471 | 305 | WB | Sequence | B4501 |
| 134 | EELFRDGV | 0.465 | 326 | WB | Sequence | B4501 |
| 11 | REIVMKYI | 0.435 | 450 | WB | Sequence | B4501 |
| 222 | LALVGACI | 0.470 | 308 | WB | Sequence | B5101 |
| 89 | PPVVHLTL | 0.448 | 391 | WB | Sequence | B5101 |
| 206 | RPLFDFSW | 0.768 | 12 | SB | Sequence | B5301 |
| 202 | GPSMRPLF | 0.430 | 474 | WB | Sequence | B5301 |
| 73 | TPAAPGAA | 0.677 | 32 | SB | Sequence | B5401 |
| 69 | SPLQTPAA | 0.605 | 71 | WB | Sequence | B5401 |
| 37 | APPGAAPA | 0.557 | 120 | WB | Sequence | B5401 |
| 166 | SPLVDNIA | 0.470 | 309 | WB | Sequence | B5401 |
| 88 | VPPVVHLT | 0.450 | 382 | WB | Sequence | B5401 |
| 22 | LSQRGYEW | 0.648 | 45 | SB | Sequence | B5801 |
| 145 | RIVAFFEF | 0.512 | 196 | WB | Sequence | B5801 |
| 168 | LVDNIALW | 0.475 | 292 | WB | Sequence | B5801 |
| 172 | IALWMTEY | 0.460 | 345 | WB | Sequence | B5801 |
| | | | 9-mer | | | |
| 171 | NIALWMTEY | 0.497 | 230 | WB | Sequence | A0101 |
| 84 | ALSPVPPVV | 0.676 | 33 | SB | Sequence | A0201 |
| 223 | ALVGACITL | 0.631 | 54 | WB | Sequence | A0201 |
| 217 | KTLLSLALV | 0.613 | 65 | WB | Sequence | A0201 |
| 219 | LLSLALVGA | 0.542 | 141 | WB | Sequence | A0201 |
| 172 | IALWMTEYL | 0.487 | 258 | WB | Sequence | A0201 |
| 219 | LLSLALVGA | 0.824 | 6 | SB | Sequence | A0202 |
| 14 | VMKYIHYKL | 0.705 | 24 | SB | Sequence | A0202 |
| 223 | ALVGACITL | 0.654 | 42 | SB | Sequence | A0202 |
| 215 | SLKTLLSLA | 0.635 | 52 | WB | Sequence | A0202 |
| 160 | SVNREMSPL | 0.619 | 61 | WB | Sequence | A0202 |
| 80 | AAGPALSPV | 0.617 | 62 | WB | Sequence | A0202 |
| 84 | ALSPVPPVV | 0.593 | 81 | WB | Sequence | A0202 |
| 164 | EMSPLVDNI | 0.582 | 91 | WB | Sequence | A0202 |
| 221 | SLALVGACI | 0.579 | 94 | WB | Sequence | A0202 |
| 67 | RTSPLQTPA | 0.554 | 124 | WB | Sequence | A0202 |
| 204 | SMRPLFDFS | 0.495 | 234 | WB | Sequence | A0202 |
| 179 | YLNRHLHTW | 0.479 | 280 | WB | Sequence | A0202 |
| 172 | IALWMTEYL | 0.459 | 346 | WB | Sequence | A0202 |
| 217 | KTLLSLALV | 0.443 | 414 | WB | Sequence | A0202 |
| 113 | EMSSQLHLT | 0.432 | 464 | WB | Sequence | A0202 |
| 215 | SLKTLLSLA | 0.875 | 3 | SB | Sequence | A0203 |
| 84 | ALSPVPPVV | 0.842 | 5 | SB | Sequence | A0203 |
| 219 | LLSLALVGA | 0.839 | 5 | SB | Sequence | A0203 |
| 80 | AAGPALSPV | 0.770 | 11 | SB | Sequence | A0203 |
| 160 | SVNREMSPL | 0.699 | 26 | SB | Sequence | A0203 |
| 124 | TARGRFATV | 0.666 | 37 | SB | Sequence | A0203 |
| 14 | VMKYIHYKL | 0.642 | 48 | SB | Sequence | A0203 |
| 223 | ALVGACITL | 0.629 | 55 | WB | Sequence | A0203 |
| 221 | SLALVGACI | 0.605 | 71 | WB | Sequence | A0203 |
| 217 | KTLLSLALV | 0.584 | 90 | WB | Sequence | A0203 |
| 67 | RTSPLQTPA | 0.539 | 146 | WB | Sequence | A0203 |
| 147 | VAFFEFGGV | 0.520 | 180 | WB | Sequence | A0203 |
| 164 | EMSPLVDNI | 0.516 | 187 | WB | Sequence | A0203 |
| 117 | QLHLTPFTA | 0.490 | 249 | WB | Sequence | A0203 |
| 204 | SMRPLFDFS | 0.441 | 425 | WB | Sequence | A0203 |
| 179 | YLNRHLHTW | 0.432 | 468 | WB | Sequence | A0203 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 84 | ALSPVPPVV | 0.766 | 12 | SB | Sequence | A0204 |
| 223 | ALVGACITL | 0.571 | 103 | WB | Sequence | A0204 |
| 80 | AAGPALSPV | 0.454 | 366 | WB | Sequence | A0204 |
| 217 | KTLLSLALV | 0.742 | 16 | SB | Sequence | A0206 |
| 80 | AAGPALSPV | 0.729 | 18 | SB | Sequence | A0206 |
| 116 | SQLHLTPFT | 0.684 | 30 | SB | Sequence | A0206 |
| 71 | LQTPAAPGA | 0.676 | 33 | SB | Sequence | A0206 |
| 150 | FEFGGVMCV | 0.650 | 44 | SB | Sequence | A0206 |
| 223 | ALVGACITL | 0.635 | 52 | WB | Sequence | A0206 |
| 219 | LLSLALVGA | 0.624 | 58 | WB | Sequence | A0206 |
| 84 | ALSPVPPVV | 0.621 | 60 | WB | Sequence | A0206 |
| 123 | FTARGRFAT | 0.598 | 77 | WB | Sequence | A0206 |
| 188 | IQDNGGWDA | 0.594 | 80 | WB | Sequence | A0206 |
| 172 | IALWMTEYL | 0.589 | 85 | WB | Sequence | A0206 |
| 36 | AAPPGAAPA | 0.569 | 106 | WB | Sequence | A0206 |
| 124 | TARGRFATV | 0.543 | 140 | WB | Sequence | A0206 |
| 147 | VAFFEFGGV | 0.511 | 198 | WB | Sequence | A0206 |
| 67 | RTSPLQTPA | 0.462 | 336 | WB | Sequence | A0206 |
| 84 | ALSPVPPVV | 0.951 | 1 | SB | Sequence | A0211 |
| 223 | ALVGACITL | 0.929 | 2 | SB | Sequence | A0211 |
| 207 | PLFDFSWLS | 0.902 | 2 | SB | Sequence | A0211 |
| 150 | FEFGGVMCV | 0.812 | 7 | SB | Sequence | A0211 |
| 179 | YLNRHLHTW | 0.742 | 16 | SB | Sequence | A0211 |
| 221 | SLALVGACI | 0.715 | 21 | SB | Sequence | A0211 |
| 219 | LLSLALVGA | 0.627 | 56 | WB | Sequence | A0211 |
| 164 | EMSPLVDNI | 0.626 | 57 | WB | Sequence | A0211 |
| 117 | QLHLTPFTA | 0.626 | 57 | WB | Sequence | A0211 |
| 215 | SLKTLLSLA | 0.620 | 61 | WB | Sequence | A0211 |
| 168 | LVDNIALWM | 0.592 | 82 | WB | Sequence | A0211 |
| 217 | KTLLSLALV | 0.581 | 93 | WB | Sequence | A0211 |
| 140 | GVNWGRIVA | 0.575 | 99 | WB | Sequence | A0211 |
| 14 | VMKYIHYKL | 0.561 | 115 | WB | Sequence | A0211 |
| 80 | AAGPALSPV | 0.551 | 128 | WB | Sequence | A0211 |
| 113 | EMSSQLHLT | 0.531 | 159 | WB | Sequence | A0211 |
| 6 | TGYDNREIV | 0.513 | 194 | WB | Sequence | A0211 |
| 119 | HLTPFTARG | 0.505 | 211 | WB | Sequence | A0211 |
| 199 | ELYGPSMRP | 0.504 | 213 | WB | Sequence | A0211 |
| 192 | GGWDAFVEL | 0.503 | 216 | WB | Sequence | A0211 |
| 172 | IALWMTEYL | 0.462 | 337 | WB | Sequence | A0211 |
| 173 | ALWMTEYLN | 0.459 | 347 | WB | Sequence | A0211 |
| 36 | AAPPGAAPA | 0.432 | 467 | WB | Sequence | A0211 |
| 84 | ALSPVPPVV | 0.914 | 2 | SB | Sequence | A0212 |
| 223 | ALVGACITL | 0.760 | 13 | SB | Sequence | A0212 |
| 179 | YLNRHLHTW | 0.739 | 16 | SB | Sequence | A0212 |
| 150 | FEFGGVMCV | 0.735 | 17 | SB | Sequence | A0212 |
| 207 | PLFDFSWLS | 0.676 | 33 | SB | Sequence | A0212 |
| 14 | VMKYIHYKL | 0.596 | 79 | WB | Sequence | A0212 |
| 219 | LLSLALVGA | 0.587 | 87 | WB | Sequence | A0212 |
| 221 | SLALVGACI | 0.529 | 162 | WB | Sequence | A0212 |
| 164 | EMSPLVDNI | 0.520 | 180 | WB | Sequence | A0212 |
| 117 | QLHLTPFTA | 0.476 | 290 | WB | Sequence | A0212 |
| 123 | FTARGRFAT | 0.464 | 328 | WB | Sequence | A0212 |
| 84 | ALSPVPPVV | 0.915 | 2 | SB | Sequence | A0216 |
| 223 | ALVGACITL | 0.909 | 2 | SB | Sequence | A0216 |
| 80 | AAGPALSPV | 0.699 | 25 | SB | Sequence | A0216 |
| 150 | FEFGGVMCV | 0.640 | 49 | SB | Sequence | A0216 |
| 221 | SLALVGACI | 0.630 | 54 | WB | Sequence | A0216 |
| 14 | VMKYIHYKL | 0.570 | 104 | WB | Sequence | A0216 |
| 207 | PLFDFSWLS | 0.530 | 162 | WB | Sequence | A0216 |
| 117 | QLHLTPFTA | 0.490 | 250 | WB | Sequence | A0216 |
| 215 | SLKTLLSLA | 0.489 | 251 | WB | Sequence | A0216 |
| 179 | YLNRHLHTW | 0.461 | 340 | WB | Sequence | A0216 |
| 124 | TARGRFATV | 0.448 | 393 | WB | Sequence | A0216 |
| 84 | ALSPVPPVV | 0.899 | 2 | SB | Sequence | A0219 |
| 150 | FEFGGVMCV | 0.686 | 29 | SB | Sequence | A0219 |
| 223 | ALVGACITL | 0.683 | 30 | SB | Sequence | A0219 |
| 80 | AAGPALSPV | 0.557 | 120 | WB | Sequence | A0219 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 219 | LLSLALVGA | 0.542 | 142 | WB | Sequence | A0219 |
| 83 | PALSPVPPV | 0.498 | 229 | WB | Sequence | A0219 |
| 164 | EMSPLVDNI | 0.460 | 345 | WB | Sequence | A0219 |
| 113 | EMSSQLHLT | 0.437 | 443 | WB | Sequence | A0219 |
| 179 | YLNRHLHTW | 0.428 | 485 | WB | Sequence | A0219 |
| 13 | IVMKYIHYK | 0.758 | 13 | SB | Sequence | A0301 |
| 230 | TLGAYLGHK | 0.655 | 41 | SB | Sequence | A0301 |
| 209 | FDFSWLSLK | 0.457 | 357 | WB | Sequence | A0301 |
| 13 | IVMKYIHYK | 0.834 | 6 | SB | Sequence | A1101 |
| 230 | TLGAYLGHK | 0.708 | 23 | SB | Sequence | A1101 |
| 130 | ATVVEELFR | 0.574 | 100 | WB | Sequence | A1101 |
| 142 | NWGRIVAFF | 0.644 | 47 | SB | Sequence | A2301 |
| 203 | PSMRPLFDF | 0.530 | 161 | WB | Sequence | A2301 |
| 144 | GRIVAFFEF | 0.530 | 162 | WB | Sequence | A2301 |
| 13 | IVMKYIHYK | 0.499 | 226 | WB | Sequence | A2301 |
| 106 | RYRRDFAEM | 0.467 | 321 | WB | Sequence | A2301 |
| 128 | RFATVVEEL | 0.454 | 366 | WB | Sequence | A2301 |
| 142 | NWGRIVAFF | 0.739 | 16 | SB | Sequence | A2402 |
| 128 | RFATVVEEL | 0.568 | 107 | WB | Sequence | A2402 |
| 212 | SWLSLKTLL | 0.536 | 151 | WB | Sequence | A2402 |
| 106 | RYRRDFAEM | 0.669 | 35 | SB | Sequence | A2403 |
| 128 | RFATVVEEL | 0.626 | 57 | WB | Sequence | A2403 |
| 200 | LYGPSMRPL | 0.553 | 125 | WB | Sequence | A2403 |
| 12 | EIVMKYIHY | 0.628 | 55 | WB | Sequence | A2601 |
| 171 | NIALWMTEY | 0.622 | 60 | WB | Sequence | A2601 |
| 12 | EIVMKYIHY | 0.935 | 2 | SB | Sequence | A2602 |
| 171 | NIALWMTEY | 0.866 | 4 | SB | Sequence | A2602 |
| 160 | SVNREMSPL | 0.849 | 5 | SB | Sequence | A2602 |
| 179 | YLNRHLHTW | 0.538 | 148 | WB | Sequence | A2602 |
| 197 | FVELYGPSM | 0.520 | 180 | WB | Sequence | A2602 |
| 168 | LVDNIALWM | 0.432 | 464 | WB | Sequence | A2602 |
| 171 | NIALWMTEY | 0.586 | 88 | WB | Sequence | A2902 |
| 12 | EIVMKYIHY | 0.516 | 188 | WB | Sequence | A2902 |
| 13 | IVMKYIHYK | 0.758 | 13 | SB | Sequence | A3001 |
| 0 | MAHAGRTGY | 0.487 | 258 | WB | Sequence | A3001 |
| 230 | TLGAYLGHK | 0.475 | 293 | WB | Sequence | A3001 |
| 171 | NIALWMTEY | 0.427 | 491 | WB | Sequence | A3002 |
| 13 | IVMKYIHYK | 0.797 | 8 | SB | Sequence | A3101 |
| 17 | YIHYKLSQR | 0.715 | 21 | SB | Sequence | A3101 |
| 155 | VMCVESVNR | 0.631 | 54 | WB | Sequence | A3101 |
| 97 | RQAGDDFSR | 0.588 | 85 | WB | Sequence | A3101 |
| 14 | VMKYIHYKL | 0.497 | 230 | WB | Sequence | A3101 |
| 130 | ATVVEELFR | 0.471 | 307 | WB | Sequence | A3101 |
| 101 | DDFSRRYRR | 0.698 | 26 | SB | Sequence | A3301 |
| 17 | YIHYKLSQR | 0.649 | 44 | SB | Sequence | A3301 |
| 54 | HTPHPAASR | 0.476 | 290 | WB | Sequence | A3301 |
| 13 | IVMKYIHYK | 0.427 | 493 | WB | Sequence | A3301 |
| 13 | IVMKYIHYK | 0.790 | 9 | SB | Sequence | A6801 |
| 17 | YIHYKLSQR | 0.747 | 15 | SB | Sequence | A6801 |
| 54 | HTPHPAASR | 0.729 | 18 | SB | Sequence | A6801 |
| 120 | LTPFTARGR | 0.703 | 24 | SB | Sequence | A6801 |
| 130 | ATVVEELFR | 0.655 | 41 | SB | Sequence | A6801 |
| 101 | DDFSRRYRR | 0.571 | 103 | WB | Sequence | A6801 |
| 209 | FDFSWLSLK | 0.540 | 145 | WB | Sequence | A6801 |
| 98 | QAGDDFSRR | 0.529 | 163 | WB | Sequence | A6801 |
| 171 | NIALWMTEY | 0.477 | 288 | WB | Sequence | A6801 |
| 230 | TLGAYLGHK | 0.449 | 388 | WB | Sequence | A6801 |
| 0 | MAHAGRTGY | 0.447 | 398 | WB | Sequence | A6801 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 123 | FTARGRFAT | 0.692 | 27 | SB | Sequence | A6802 |
| 147 | VAFFEFGGV | 0.641 | 48 | SB | Sequence | A6802 |
| 57 | HPAASRDPV | 0.627 | 56 | WB | Sequence | A6802 |
| 72 | QTPAAPGAA | 0.604 | 72 | WB | Sequence | A6802 |
| 160 | SVNREMSPL | 0.570 | 104 | WB | Sequence | A6802 |
| 124 | TARGRFATV | 0.531 | 160 | WB | Sequence | A6802 |
| 6 | TGYDNREIV | 0.513 | 193 | WB | Sequence | A6802 |
| 164 | EMSPLVDNI | 0.512 | 196 | WB | Sequence | A6802 |
| 67 | RTSPLQTPA | 0.488 | 254 | WB | Sequence | A6802 |
| 225 | VGACITLGA | 0.472 | 303 | WB | Sequence | A6802 |
| 165 | MSPLVDNIA | 0.466 | 322 | WB | Sequence | A6802 |
| 150 | FEFGGVMCV | 0.449 | 388 | WB | Sequence | A6802 |
| 83 | PALSPVPPV | 0.726 | 19 | SB | Sequence | A6901 |
| 33 | DVGAAPPGA | 0.535 | 152 | WB | Sequence | A6901 |
| 57 | HPAASRDPV | 0.495 | 235 | WB | Sequence | A6901 |
| 164 | EMSPLVDNI | 0.485 | 262 | WB | Sequence | A6901 |
| 123 | FTARGRFAT | 0.483 | 267 | WB | Sequence | A6901 |
| 217 | KTLLSLALV | 0.460 | 344 | WB | Sequence | A6901 |
| 73 | TPAAPGAAA | 0.460 | 344 | WB | Sequence | A6901 |
| 172 | IALWMTEYL | 0.426 | 497 | WB | Sequence | A6901 |
| 57 | HPAASRDPV | 0.770 | 12 | SB | Sequence | B0702 |
| 63 | DPVARTSPL | 0.750 | 14 | SB | Sequence | B0702 |
| 166 | SPLVDNIAL | 0.674 | 33 | SB | Sequence | B0702 |
| 73 | TPAAPGAAA | 0.652 | 43 | SB | Sequence | B0702 |
| 206 | RPLFDFSWL | 0.627 | 56 | WB | Sequence | B0702 |
| 86 | SPVPPVVHL | 0.606 | 71 | WB | Sequence | B0702 |
| 76 | APGAAAGPA | 0.573 | 101 | WB | Sequence | B0702 |
| 88 | VPPVVHLTL | 0.542 | 142 | WB | Sequence | B0702 |
| 121 | TPFTARGRF | 0.505 | 210 | WB | Sequence | B0702 |
| 124 | TARGRFATV | 0.449 | 389 | WB | Sequence | B0702 |
| 0 | MAHAGRTGY | 0.532 | 158 | WB | Sequence | B1501 |
| 115 | SSQLHLTPF | 0.427 | 490 | WB | Sequence | B1501 |
| 150 | FEFGGVMCV | 0.633 | 53 | WB | Sequence | B1801 |
| 9 | DNREIVMKY | 0.541 | 143 | WB | Sequence | B1801 |
| 172 | IALWMTEYL | 0.505 | 211 | WB | Sequence | B1801 |
| 144 | GRIVAFFEF | 0.456 | 360 | WB | Sequence | B2705 |
| 105 | RRYRRDFAE | 0.456 | 361 | WB | Sequence | B2705 |
| 166 | SPLVDNIAL | 0.680 | 31 | SB | Sequence | B3501 |
| 0 | MAHAGRTGY | 0.658 | 40 | SB | Sequence | B3501 |
| 197 | FVELYGPSM | 0.628 | 55 | WB | Sequence | B3501 |
| 121 | TPFTARGRF | 0.610 | 67 | WB | Sequence | B3501 |
| 172 | IALWMTEYL | 0.584 | 90 | WB | Sequence | B3501 |
| 63 | DPVARTSPL | 0.584 | 90 | WB | Sequence | B3501 |
| 129 | FATVVEELF | 0.562 | 113 | WB | Sequence | B3501 |
| 73 | TPAAPGAAA | 0.551 | 128 | WB | Sequence | B3501 |
| 171 | NIALWMTEY | 0.523 | 174 | WB | Sequence | B3501 |
| 111 | FAEMSSQLH | 0.460 | 343 | WB | Sequence | B3501 |
| 112 | AEMSSQLHL | 0.740 | 16 | SB | Sequence | B4001 |
| 150 | FEFGGVMCV | 0.588 | 86 | WB | Sequence | B4001 |
| 112 | AEMSSQLHL | 0.554 | 124 | WB | Sequence | B4002 |
| 150 | FEFGGVMCV | 0.466 | 323 | WB | Sequence | B4002 |
| 112 | AEMSSQLHL | 0.454 | 368 | WB | Sequence | B4402 |
| 112 | AEMSSQLHL | 0.533 | 157 | WB | Sequence | B4403 |
| 112 | AEMSSQLHL | 0.587 | 87 | WB | Sequence | B4501 |
| 88 | VPPVVHLTL | 0.548 | 132 | WB | Sequence | B5101 |
| 206 | RPLFDFSWL | 0.470 | 307 | WB | Sequence | B5301 |
| 166 | SPLVDNIAL | 0.459 | 348 | WB | Sequence | B5301 |
| 172 | IALWMTEYL | 0.450 | 382 | WB | Sequence | B5301 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pospeptide | logscore | affinity (nM) | Bind Level | Protein Name | Allele |
|---|---|---|---|---|---|
| 73 TPAAPGAAA | 0.715 | 21 | SB | Sequence | B5401 |
| 57 HPAASRDPV | 0.684 | 30 | SB | Sequence | B5401 |
| 76 APGAAAGPA | 0.625 | 57 | WB | Sequence | B5401 |
| 51 QPGHTPHPA | 0.515 | 189 | WB | Sequence | B5401 |
| 179 YLNRHLHTW | 0.682 | 31 | SB | Sequence | B5801 |
| 21 KLSQRGYEW | 0.649 | 44 | SB | Sequence | B5801 |
| 129 FATVVEELF | 0.547 | 134 | WB | Sequence | B5801 |
| 40 GAAPAPGIF | 0.483 | 268 | WB | Sequence | B5801 |

10-mer

| pospeptide | logscore | affinity (nM) | Bind Level | Protein Name | Allele |
|---|---|---|---|---|---|
| 179 YLNRHLHTWI | 0.735 | 17 | SB | Sequence | A0201 |
| 13 IVMKYIHYKL | 0.638 | 50 | WB | Sequence | A0201 |
| 218 TLLSLALVGA | 0.571 | 103 | WB | Sequence | A0201 |
| 207 PLFDFSWLSL | 0.536 | 151 | WB | Sequence | A0201 |
| 213 WLSLKTLLSL | 0.530 | 161 | WB | Sequence | A0201 |
| 123 FTARGRFATV | 0.522 | 175 | WB | Sequence | A0201 |
| 171 NIALWMTEYL | 0.521 | 178 | WB | Sequence | A0201 |
| 175 WMTEYLNRHL | 0.486 | 260 | WB | Sequence | A0201 |
| 218 TLLSLALVGA | 0.731 | 18 | SB | Sequence | A0202 |
| 171 NIALWMTEYL | 0.727 | 19 | SB | Sequence | A0202 |
| 213 WLSLKTLLSL | 0.700 | 25 | SB | Sequence | A0202 |
| 215 SLKTLLSLAL | 0.646 | 46 | SB | Sequence | A0202 |
| 175 WMTEYLNRHL | 0.642 | 47 | SB | Sequence | A0202 |
| 207 PLFDFSWLSL | 0.637 | 50 | WB | Sequence | A0202 |
| 79 AAAGPALSPV | 0.588 | 86 | WB | Sequence | A0202 |
| 13 IVMKYIHYKL | 0.569 | 106 | WB | Sequence | A0202 |
| 123 FTARGRFATV | 0.568 | 106 | WB | Sequence | A0202 |
| 199 ELYGPSMRPL | 0.541 | 143 | WB | Sequence | A0202 |
| 179 YLNRHLHTWI | 0.540 | 145 | WB | Sequence | A0202 |
| 224 LVGACITLGA | 0.483 | 267 | WB | Sequence | A0202 |
| 146 IVAFFEFGGV | 0.439 | 431 | WB | Sequence | A0202 |
| 179 YLNRHLHTWI | 0.933 | 2 | SB | Sequence | A0203 |
| 123 FTARGRFATV | 0.821 | 6 | SB | Sequence | A0203 |
| 213 WLSLKTLLSL | 0.782 | 10 | SB | Sequence | A0203 |
| 215 SLKTLLSLAL | 0.773 | 11 | SB | Sequence | A0203 |
| 171 NIALWMTEYL | 0.682 | 31 | SB | Sequence | A0203 |
| 160 SVNREMSPLV | 0.680 | 31 | SB | Sequence | A0203 |
| 146 IVAFFEFGGV | 0.667 | 36 | SB | Sequence | A0203 |
| 79 AAAGPALSPV | 0.606 | 71 | WB | Sequence | A0203 |
| 175 WMTEYLNRHL | 0.569 | 106 | WB | Sequence | A0203 |
| 218 TLLSLALVGA | 0.545 | 137 | WB | Sequence | A0203 |
| 13 IVMKYIHYKL | 0.532 | 157 | WB | Sequence | A0203 |
| 224 LVGACITLGA | 0.532 | 158 | WB | Sequence | A0203 |
| 199 ELYGPSMRPL | 0.519 | 182 | WB | Sequence | A0203 |
| 50 SQPGHTPHPA | 0.447 | 398 | WB | Sequence | A0203 |
| 219 LLSLALVGAC | 0.444 | 410 | WB | Sequence | A0203 |
| 124 TARGRFATVV | 0.428 | 489 | WB | Sequence | A0203 |
| 179 YLNRHLHTWI | 0.655 | 41 | SB | Sequence | A0204 |
| 123 FTARGRFATV | 0.613 | 66 | WB | Sequence | A0204 |
| 13 IVMKYIHYKL | 0.509 | 203 | WB | Sequence | A0204 |
| 79 AAAGPALSPV | 0.474 | 296 | WB | Sequence | A0204 |
| 160 SVNREMSPLV | 0.450 | 384 | WB | Sequence | A0204 |
| 123 FTARGRFATV | 0.867 | 4 | SB | Sequence | A0206 |
| 116 SQLHLTPFTA | 0.776 | 11 | SB | Sequence | A0206 |
| 188 IQDNGGWDAF | 0.673 | 34 | SB | Sequence | A0206 |
| 213 WLSLKTLLSL | 0.667 | 36 | SB | Sequence | A0206 |
| 50 SQPGHTPHPA | 0.621 | 60 | WB | Sequence | A0206 |
| 179 YLNRHLHTWI | 0.619 | 61 | WB | Sequence | A0206 |
| 79 AAAGPALSPV | 0.602 | 74 | WB | Sequence | A0206 |
| 175 WMTEYLNRHL | 0.600 | 75 | WB | Sequence | A0206 |
| 160 SVNREMSPLV | 0.567 | 108 | WB | Sequence | A0206 |
| 171 NIALWMTEYL | 0.562 | 114 | WB | Sequence | A0206 |
| 218 TLLSLALVGA | 0.560 | 116 | WB | Sequence | A0206 |
| 146 IVAFFEFGGV | 0.553 | 125 | WB | Sequence | A0206 |
| 71 LQTPAAPGAA | 0.546 | 135 | WB | Sequence | A0206 |
| 13 IVMKYIHYKL | 0.525 | 171 | WB | Sequence | A0206 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 27 | YEWDAGDVGA | 0.511 | 199 | WB | Sequence | A0206 |
| 207 | PLFDFSWLSL | 0.486 | 260 | WB | Sequence | A0206 |
| 67 | RTSPLQTPAA | 0.477 | 286 | WB | Sequence | A0206 |
| 224 | LVGACITLGA | 0.471 | 304 | WB | Sequence | A0206 |
| 207 | PLFDFSWLSL | 0.935 | 2 | SB | Sequence | A0211 |
| 179 | YLNRHLHTWI | 0.925 | 2 | SB | Sequence | A0211 |
| 199 | ELYGPSMRPL | 0.888 | 3 | SB | Sequence | A0211 |
| 213 | WLSLKTLLSL | 0.835 | 5 | SB | Sequence | A0211 |
| 218 | TLLSLALVGA | 0.829 | 6 | SB | Sequence | A0211 |
| 123 | FTARGRFATV | 0.823 | 6 | SB | Sequence | A0211 |
| 167 | PLVDNIALWM | 0.802 | 8 | SB | Sequence | A0211 |
| 215 | SLKTLLSLAL | 0.799 | 8 | SB | Sequence | A0211 |
| 175 | WMTEYLNRHL | 0.796 | 9 | SB | Sequence | A0211 |
| 160 | SVNREMSPLV | 0.788 | 9 | SB | Sequence | A0211 |
| 87 | PVPPVVHLTL | 0.705 | 24 | SB | Sequence | A0211 |
| 79 | AAAGPALSPV | 0.635 | 51 | WB | Sequence | A0211 |
| 13 | IVMKYIHYKL | 0.601 | 74 | WB | Sequence | A0211 |
| 146 | IVAFFEFGGV | 0.568 | 107 | WB | Sequence | A0211 |
| 132 | VVEELFRDGV | 0.549 | 131 | WB | Sequence | A0211 |
| 171 | NIALWMTEYL | 0.547 | 133 | WB | Sequence | A0211 |
| 164 | EMSPLVDNIA | 0.488 | 254 | WB | Sequence | A0211 |
| 168 | LVDNIALWMT | 0.484 | 266 | WB | Sequence | A0211 |
| 149 | FFEFGGVMCV | 0.475 | 292 | WB | Sequence | A0211 |
| 221 | SLALVGACIT | 0.462 | 336 | WB | Sequence | A0211 |
| 187 | WIQDNGGWDA | 0.453 | 370 | WB | Sequence | A0211 |
| 179 | YLNRHLHTWI | 0.878 | 3 | SB | Sequence | A0212 |
| 207 | PLFDFSWLSL | 0.859 | 4 | SB | Sequence | A0212 |
| 123 | FTARGRFATV | 0.849 | 5 | SB | Sequence | A0212 |
| 215 | SLKTLLSLAL | 0.730 | 18 | SB | Sequence | A0212 |
| 199 | ELYGPSMRPL | 0.726 | 19 | SB | Sequence | A0212 |
| 175 | WMTEYLNRHL | 0.716 | 21 | SB | Sequence | A0212 |
| 213 | WLSLKTLLSL | 0.697 | 26 | SB | Sequence | A0212 |
| 218 | TLLSLALVGA | 0.692 | 27 | SB | Sequence | A0212 |
| 132 | VVEELFRDGV | 0.601 | 74 | WB | Sequence | A0212 |
| 167 | PLVDNIALWM | 0.560 | 116 | WB | Sequence | A0212 |
| 13 | IVMKYIHYKL | 0.533 | 156 | WB | Sequence | A0212 |
| 160 | SVNREMSPLV | 0.509 | 202 | WB | Sequence | A0212 |
| 187 | WIQDNGGWDA | 0.479 | 280 | WB | Sequence | A0212 |
| 146 | IVAFFEFGGV | 0.476 | 288 | WB | Sequence | A0212 |
| 87 | PVPPVVHLTL | 0.475 | 294 | WB | Sequence | A0212 |
| 27 | YEWDAGDVGA | 0.467 | 321 | WB | Sequence | A0212 |
| 179 | YLNRHLHTWI | 0.854 | 4 | SB | Sequence | A0216 |
| 207 | PLFDFSWLSL | 0.849 | 5 | SB | Sequence | A0216 |
| 123 | FTARGRFATV | 0.812 | 7 | SB | Sequence | A0216 |
| 199 | ELYGPSMRPL | 0.767 | 12 | SB | Sequence | A0216 |
| 213 | WLSLKTLLSL | 0.745 | 15 | SB | Sequence | A0216 |
| 167 | PLVDNIALWM | 0.702 | 25 | SB | Sequence | A0216 |
| 160 | SVNREMSPLV | 0.685 | 30 | SB | Sequence | A0216 |
| 13 | IVMKYIHYKL | 0.676 | 33 | SB | Sequence | A0216 |
| 175 | WMTEYLNRHL | 0.675 | 33 | SB | Sequence | A0216 |
| 79 | AAAGPALSPV | 0.661 | 39 | SB | Sequence | A0216 |
| 87 | PVPPVVHLTL | 0.638 | 50 | WB | Sequence | A0216 |
| 215 | SLKTLLSLAL | 0.634 | 52 | WB | Sequence | A0216 |
| 218 | TLLSLALVGA | 0.574 | 100 | WB | Sequence | A0216 |
| 171 | NIALWMTEYL | 0.557 | 120 | WB | Sequence | A0216 |
| 221 | SLALVGACIT | 0.472 | 301 | WB | Sequence | A0216 |
| 146 | IVAFFEFGGV | 0.429 | 483 | WB | Sequence | A0216 |
| 207 | PLFDFSWLSL | 0.805 | 8 | SB | Sequence | A0219 |
| 179 | YLNRHLHTWI | 0.789 | 9 | SB | Sequence | A0219 |
| 213 | WLSLKTLLSL | 0.766 | 12 | SB | Sequence | A0219 |
| 123 | FTARGRFATV | 0.703 | 24 | SB | Sequence | A0219 |
| 199 | ELYGPSMRPL | 0.585 | 88 | WB | Sequence | A0219 |
| 167 | PLVDNIALWM | 0.574 | 100 | WB | Sequence | A0219 |
| 79 | AAAGPALSPV | 0.563 | 112 | WB | Sequence | A0219 |
| 218 | TLLSLALVGA | 0.551 | 129 | WB | Sequence | A0219 |
| 175 | WMTEYLNRHL | 0.521 | 178 | WB | Sequence | A0219 |
| 83 | PALSPVPPVV | 0.486 | 259 | WB | Sequence | A0219 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pospeptide | logscore | affinity (nM) | Bind Level | Protein Name | Allele |
|---|---|---|---|---|---|
| 13 IVMKYIHYKL | 0.461 | 341 | WB | Sequence | A0219 |
| 171 NIALWMTEYL | 0.446 | 401 | WB | Sequence | A0219 |
| 229 ITLGAYLGHK | 0.760 | 13 | SB | Sequence | A0301 |
| 208 LFDFSWLSLK | 0.497 | 232 | WB | Sequence | A0301 |
| 12 EIVMKYIHYK | 0.475 | 292 | WB | Sequence | A0301 |
| 154 GVMCVESVNR | 0.444 | 411 | WB | Sequence | A0301 |
| 173 ALWMTEYLNR | 0.429 | 480 | WB | Sequence | A0301 |
| 229 ITLGAYLGHK | 0.752 | 14 | SB | Sequence | A1101 |
| 154 GVMCVESVNR | 0.637 | 50 | WB | Sequence | A1101 |
| 12 EIVMKYIHYK | 0.540 | 145 | WB | Sequence | A1101 |
| 173 ALWMTEYLNR | 0.455 | 363 | WB | Sequence | A1101 |
| 208 LFDFSWLSLK | 0.435 | 453 | WB | Sequence | A1101 |
| 178 EYLNRHLHTW | 0.686 | 29 | SB | Sequence | A2301 |
| 200 LYGPSMRPLF | 0.686 | 29 | SB | Sequence | A2301 |
| 128 RFATVVEELF | 0.620 | 60 | WB | Sequence | A2301 |
| 7 GYDNREIVMK | 0.595 | 80 | WB | Sequence | A2301 |
| 102 DFSRRYRRDF | 0.499 | 226 | WB | Sequence | A2301 |
| 13 IVMKYIHYKL | 0.451 | 381 | WB | Sequence | A2301 |
| 94 LTLRQAGDDF | 0.437 | 441 | WB | Sequence | A2301 |
| 128 RFATVVEELF | 0.764 | 12 | SB | Sequence | A2402 |
| 200 LYGPSMRPLF | 0.733 | 17 | SB | Sequence | A2402 |
| 178 EYLNRHLHTW | 0.715 | 21 | SB | Sequence | A2402 |
| 178 EYLNRHLHTW | 0.718 | 21 | SB | Sequence | A2403 |
| 128 RFATVVEELF | 0.657 | 41 | SB | Sequence | A2403 |
| 200 LYGPSMRPLF | 0.636 | 51 | WB | Sequence | A2403 |
| 170 DNIALWMTEY | 0.478 | 283 | WB | Sequence | A2601 |
| 159 ESVNREMSPL | 0.621 | 60 | WB | Sequence | A2602 |
| 199 ELYGPSMRPL | 0.595 | 79 | WB | Sequence | A2602 |
| 171 NIALWMTEYL | 0.549 | 131 | WB | Sequence | A2602 |
| 170 DNIALWMTEY | 0.487 | 258 | WB | Sequence | A2602 |
| 229 ITLGAYLGHK | 0.718 | 21 | SB | Sequence | A3001 |
| 16 KYIHYKLSQR | 0.837 | 5 | SB | Sequence | A3101 |
| 136 LFRDGVNWGR | 0.667 | 36 | SB | Sequence | A3101 |
| 154 GVMCVESVNR | 0.576 | 98 | WB | Sequence | A3101 |
| 119 HLTPFTARGR | 0.573 | 101 | WB | Sequence | A3101 |
| 173 ALWMTEYLNR | 0.509 | 203 | WB | Sequence | A3101 |
| 99 AGDDFSRRYR | 0.507 | 207 | WB | Sequence | A3101 |
| 129 FATVVEELFR | 0.493 | 241 | WB | Sequence | A3101 |
| 117 QLHLTPFTAR | 0.431 | 471 | WB | Sequence | A3101 |
| 136 LFRDGVNWGR | 0.553 | 126 | WB | Sequence | A3301 |
| 16 KYIHYKLSQR | 0.520 | 180 | WB | Sequence | A3301 |
| 129 FATVVEELFR | 0.516 | 188 | WB | Sequence | A3301 |
| 173 ALWMTEYLNR | 0.441 | 423 | WB | Sequence | A3301 |
| 129 FATVVEELFR | 0.829 | 6 | SB | Sequence | A6801 |
| 12 EIVMKYIHYK | 0.780 | 10 | SB | Sequence | A6801 |
| 119 HLTPFTARGR | 0.721 | 20 | SB | Sequence | A6801 |
| 197 FVELYGPSMR | 0.688 | 29 | SB | Sequence | A6801 |
| 154 GVMCVESVNR | 0.646 | 46 | SB | Sequence | A6801 |
| 229 ITLGAYLGHK | 0.568 | 106 | WB | Sequence | A6801 |
| 176 MTEYLNRHLH | 0.485 | 262 | WB | Sequence | A6801 |
| 117 QLHLTPFTAR | 0.466 | 322 | WB | Sequence | A6801 |
| 2 HAGRTGYDNR | 0.446 | 399 | WB | Sequence | A6801 |
| 123 FTARGRFATV | 0.861 | 4 | SB | Sequence | A6802 |
| 146 IVAFFEFGGV | 0.809 | 7 | SB | Sequence | A6802 |
| 171 NIALWMTEYL | 0.728 | 18 | SB | Sequence | A6802 |
| 13 IVMKYIHYKL | 0.680 | 31 | SB | Sequence | A6802 |
| 79 AAAGPALSPV | 0.644 | 47 | SB | Sequence | A6802 |
| 72 QTPAAPGAAA | 0.617 | 63 | WB | Sequence | A6802 |
| 165 MSPLVDNIAL | 0.591 | 83 | WB | Sequence | A6802 |
| 199 ELYGPSMRPL | 0.582 | 92 | WB | Sequence | A6802 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 159 | ESVNREMSPL | 0.550 | 129 | WB | Sequence | A6802 |
| 205 | MRPLFDFSWL | 0.522 | 175 | WB | Sequence | A6802 |
| 160 | SVNREMSPLV | 0.471 | 306 | WB | Sequence | A6802 |
| 124 | TARGRFATVV | 0.441 | 421 | WB | Sequence | A6802 |
| 123 | FTARGRFATV | 0.792 | 9 | SB | Sequence | A6901 |
| 199 | ELYGPSMRPL | 0.714 | 22 | SB | Sequence | A6901 |
| 83 | PALSPVPPVV | 0.580 | 94 | WB | Sequence | A6901 |
| 171 | NIALWMTEYL | 0.558 | 119 | WB | Sequence | A6901 |
| 160 | SVNREMSPLV | 0.537 | 149 | WB | Sequence | A6901 |
| 79 | AAAGPALSPV | 0.502 | 219 | WB | Sequence | A6901 |
| 33 | DVGAAPPGAA | 0.489 | 251 | WB | Sequence | A6901 |
| 146 | IVAFFEFGGV | 0.464 | 330 | WB | Sequence | A6901 |
| 13 | IVMKYIHYKL | 0.441 | 422 | WB | Sequence | A6901 |
| 76 | APGAAAGPAL | 0.708 | 23 | SB | Sequence | B0702 |
| 82 | GPALSPVPPV | 0.604 | 72 | WB | Sequence | B0702 |
| 57 | HPAASRDPVA | 0.536 | 152 | WB | Sequence | B0702 |
| 202 | GPSMRPLFDF | 0.468 | 317 | WB | Sequence | B0702 |
| 124 | TARGRFATVV | 0.465 | 327 | WB | Sequence | B0702 |
| 42 | APAPGIFSSQ | 0.451 | 378 | WB | Sequence | B0702 |
| 140 | GVNWGRIVAF | 0.548 | 132 | WB | Sequence | B1501 |
| 114 | MSSQLHLTPF | 0.504 | 214 | WB | Sequence | B1501 |
| 188 | IQDNGGWDAF | 0.490 | 249 | WB | Sequence | B1501 |
| 11 | REIVMKYIHY | 0.603 | 73 | WB | Sequence | B1801 |
| 105 | RRYRRDFAEM | 0.622 | 59 | WB | Sequence | B2705 |
| 127 | GRFATVVEEL | 0.493 | 241 | WB | Sequence | B2705 |
| 114 | MSSQLHLTPF | 0.582 | 91 | WB | Sequence | B3501 |
| 147 | VAFFEFGGVM | 0.561 | 115 | WB | Sequence | B3501 |
| 76 | APGAAAGPAL | 0.526 | 168 | WB | Sequence | B3501 |
| 222 | LALVGACITL | 0.473 | 297 | WB | Sequence | B3501 |
| 156 | MCVESVNREM | 0.473 | 299 | WB | Sequence | B3501 |
| 98 | QAGDDFSRRY | 0.461 | 340 | WB | Sequence | B3501 |
| 73 | TPAAPGAAAG | 0.459 | 346 | WB | Sequence | B3501 |
| 140 | GVNWGRIVAF | 0.455 | 362 | WB | Sequence | B3501 |
| 166 | SPLVDNIALW | 0.453 | 371 | WB | Sequence | B3501 |
| 11 | REIVMKYIHY | 0.502 | 218 | WB | Sequence | B4002 |
| 112 | AEMSSQLHLT | 0.472 | 303 | WB | Sequence | B4002 |
| 11 | REIVMKYIHY | 0.476 | 289 | WB | Sequence | B4402 |
| 11 | REIVMKYIHY | 0.481 | 273 | WB | Sequence | B4403 |
| 134 | EELFRDGVNW | 0.473 | 300 | WB | Sequence | B4403 |
| 112 | AEMSSQLHLT | 0.523 | 175 | WB | Sequence | B4501 |
| 11 | REIVMKYIHY | 0.438 | 437 | WB | Sequence | B4501 |
| 134 | EELFRDGVNW | 0.367 | 946 | | Sequence | B4501 |
| 222 | LALVGACITL | 0.480 | 277 | WB | Sequence | B5101 |
| 38 | PPGAAPAPGI | 0.427 | 490 | WB | Sequence | B5101 |
| 166 | SPLVDNIALW | 0.744 | 15 | SB | Sequence | B5301 |
| 57 | HPAASRDPVA | 0.665 | 37 | SB | Sequence | B5401 |
| 121 | TPFTARGRFA | 0.661 | 39 | SB | Sequence | B5401 |
| 51 | QPGHTPHPAA | 0.476 | 289 | WB | Sequence | B5401 |
| 82 | GPALSPVPPV | 0.461 | 340 | WB | Sequence | B5401 |
| 86 | SPVPPVVHLT | 0.434 | 456 | WB | Sequence | B5401 |
| 185 | HTWIQDNGGW | 0.427 | 491 | WB | Sequence | B5701 |
| 114 | MSSQLHLTPF | 0.611 | 67 | WB | Sequence | B5801 |
| 185 | HTWIQDNGGW | 0.580 | 94 | WB | Sequence | B5801 |
| 204 | SMRPLFDFSW | 0.474 | 294 | WB | Sequence | B5801 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| | | | 11-mer | | | |
| 223 | ALVGACITLGA | 0.632 | 53 | WB | Sequence | A0201 |
| 84 | ALSPVPPVVHL | 0.586 | 88 | WB | Sequence | A0201 |
| 215 | SLKTLLSLALV | 0.543 | 141 | WB | Sequence | A0201 |
| 188 | IQDNGGWDAFV | 0.504 | 215 | WB | Sequence | A0201 |
| 219 | LLSLALVGACI | 0.481 | 275 | WB | Sequence | A0201 |
| 221 | SLALVGACITL | 0.473 | 299 | WB | Sequence | A0201 |
| 145 | RIVAFFEFGGV | 0.453 | 373 | WB | Sequence | A0201 |
| 21 | KLSQRGYEWDA | 0.449 | 388 | WB | Sequence | A0201 |
| 204 | SMRPLFDFSWL | 0.772 | 11 | SB | Sequence | A0202 |
| 215 | SLKTLLSLALV | 0.763 | 12 | SB | Sequence | A0202 |
| 221 | SLALVGACITL | 0.710 | 23 | SB | Sequence | A0202 |
| 84 | ALSPVPPVVHL | 0.708 | 23 | SB | Sequence | A0202 |
| 219 | LLSLALVGACI | 0.692 | 28 | SB | Sequence | A0202 |
| 164 | EMSPLVDNIAL | 0.657 | 41 | SB | Sequence | A0202 |
| 223 | ALVGACITLGA | 0.630 | 54 | WB | Sequence | A0202 |
| 213 | WLSLKTLLSLA | 0.616 | 63 | WB | Sequence | A0202 |
| 123 | FTARGRFATVV | 0.602 | 74 | WB | Sequence | A0202 |
| 78 | GAAAGPALSPV | 0.597 | 78 | WB | Sequence | A0202 |
| 145 | RIVAFFEFGGV | 0.569 | 105 | WB | Sequence | A0202 |
| 179 | YLNRHLHTWIQ | 0.529 | 163 | WB | Sequence | A0202 |
| 21 | KLSQRGYEWDA | 0.499 | 226 | WB | Sequence | A0202 |
| 131 | TVVEELFRDGV | 0.478 | 284 | WB | Sequence | A0202 |
| 225 | VGACITLGAYL | 0.469 | 312 | WB | Sequence | A0202 |
| 215 | SLKTLLSLALV | 0.899 | 2 | SB | Sequence | A0203 |
| 204 | SMRPLFDFSWL | 0.853 | 4 | SB | Sequence | A0203 |
| 145 | RIVAFFEFGGV | 0.813 | 7 | SB | Sequence | A0203 |
| 78 | GAAAGPALSPV | 0.774 | 11 | SB | Sequence | A0203 |
| 213 | WLSLKTLLSLA | 0.765 | 12 | SB | Sequence | A0203 |
| 84 | ALSPVPPVVHL | 0.765 | 12 | SB | Sequence | A0203 |
| 223 | ALVGACITLGA | 0.751 | 14 | SB | Sequence | A0203 |
| 219 | LLSLALVGACI | 0.707 | 23 | SB | Sequence | A0203 |
| 123 | FTARGRFATVV | 0.672 | 34 | SB | Sequence | A0203 |
| 221 | SLALVGACITL | 0.617 | 63 | WB | Sequence | A0203 |
| 179 | YLNRHLHTWIQ | 0.565 | 110 | WB | Sequence | A0203 |
| 131 | TVVEELFRDGV | 0.507 | 206 | WB | Sequence | A0203 |
| 21 | KLSQRGYEWDA | 0.476 | 291 | WB | Sequence | A0203 |
| 84 | ALSPVPPVVHL | 0.633 | 53 | WB | Sequence | A0204 |
| 221 | SLALVGACITL | 0.593 | 82 | WB | Sequence | A0204 |
| 123 | FTARGRFATVV | 0.587 | 87 | WB | Sequence | A0204 |
| 78 | GAAAGPALSPV | 0.495 | 235 | WB | Sequence | A0204 |
| 21 | KLSQRGYEWDA | 0.488 | 255 | WB | Sequence | A0204 |
| 179 | YLNRHLHTWIQ | 0.461 | 340 | WB | Sequence | A0204 |
| 145 | RIVAFFEFGGV | 0.868 | 4 | SB | Sequence | A0206 |
| 188 | IQDNGGWDAFV | 0.822 | 6 | SB | Sequence | A0206 |
| 123 | FTARGRFATVV | 0.729 | 18 | SB | Sequence | A0206 |
| 131 | TVVEELFRDGV | 0.725 | 19 | SB | Sequence | A0206 |
| 223 | ALVGACITLGA | 0.670 | 35 | SB | Sequence | A0206 |
| 50 | SQPGHTPHPAA | 0.659 | 40 | SB | Sequence | A0206 |
| 71 | LQTPAAPGAAA | 0.657 | 40 | SB | Sequence | A0206 |
| 78 | GAAAGPALSPV | 0.598 | 77 | WB | Sequence | A0206 |
| 217 | KTLLSLALVGA | 0.537 | 149 | WB | Sequence | A0206 |
| 84 | ALSPVPPVVHL | 0.533 | 157 | WB | Sequence | A0206 |
| 204 | SMRPLFDFSWL | 0.494 | 239 | WB | Sequence | A0206 |
| 215 | SLKTLLSLALV | 0.477 | 286 | WB | Sequence | A0206 |
| 213 | WLSLKTLLSLA | 0.475 | 293 | WB | Sequence | A0206 |
| 27 | YEWDAGDVGAA | 0.474 | 295 | WB | Sequence | A0206 |
| 21 | KLSQRGYEWDA | 0.453 | 373 | WB | Sequence | A0206 |
| 84 | ALSPVPPVVHL | 0.906 | 2 | SB | Sequence | A0211 |
| 215 | SLKTLLSLALV | 0.896 | 3 | SB | Sequence | A0211 |
| 221 | SLALVGACITL | 0.892 | 3 | SB | Sequence | A0211 |
| 179 | YLNRHLHTWIQ | 0.853 | 4 | SB | Sequence | A0211 |
| 164 | EMSPLVDNIAL | 0.832 | 6 | SB | Sequence | A0211 |
| 204 | SMRPLFDFSWL | 0.813 | 7 | SB | Sequence | A0211 |
| 223 | ALVGACITLGA | 0.803 | 8 | SB | Sequence | A0211 |
| 123 | FTARGRFATVV | 0.782 | 10 | SB | Sequence | A0211 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 188 | IQDNGGWDAFV | 0.746 | 15 | SB | Sequence | A0211 |
| 148 | AFFEFGGVMCV | 0.730 | 18 | SB | Sequence | A0211 |
| 207 | PLFDFSWLSLK | 0.720 | 20 | SB | Sequence | A0211 |
| 131 | TVVEELFRDGV | 0.717 | 21 | SB | Sequence | A0211 |
| 167 | PLVDNIALWMT | 0.706 | 24 | SB | Sequence | A0211 |
| 21 | KLSQRGYEWDA | 0.702 | 25 | SB | Sequence | A0211 |
| 213 | WLSLKTLLSLA | 0.655 | 41 | SB | Sequence | A0211 |
| 145 | RIVAFFEFGGV | 0.634 | 52 | WB | Sequence | A0211 |
| 199 | ELYGPSMRPLF | 0.626 | 56 | WB | Sequence | A0211 |
| 219 | LLSLALVGACI | 0.581 | 92 | WB | Sequence | A0211 |
| 78 | GAAAGPALSPV | 0.533 | 156 | WB | Sequence | A0211 |
| 137 | FRDGVNWGRIV | 0.516 | 187 | WB | Sequence | A0211 |
| 218 | TLLSLALVGAC | 0.500 | 223 | WB | Sequence | A0211 |
| 119 | HLTPFTARGRF | 0.462 | 335 | WB | Sequence | A0211 |
| 175 | WMTEYLNRHLH | 0.458 | 352 | WB | Sequence | A0211 |
| 84 | ALSPVPPVVHL | 0.817 | 7 | SB | Sequence | A0212 |
| 179 | YLNRHLHTWIQ | 0.794 | 9 | SB | Sequence | A0212 |
| 123 | FTARGRFATVV | 0.784 | 10 | SB | Sequence | A0212 |
| 204 | SMRPLFDFSWL | 0.781 | 10 | SB | Sequence | A0212 |
| 215 | SLKTLLSLALV | 0.719 | 20 | SB | Sequence | A0212 |
| 221 | SLALVGACITL | 0.719 | 20 | SB | Sequence | A0212 |
| 164 | EMSPLVDNIAL | 0.714 | 22 | SB | Sequence | A0212 |
| 21 | KLSQRGYEWDA | 0.616 | 63 | WB | Sequence | A0212 |
| 223 | ALVGACITLGA | 0.604 | 72 | WB | Sequence | A0212 |
| 131 | TVVEELFRDGV | 0.602 | 74 | WB | Sequence | A0212 |
| 188 | IQDNGGWDAFV | 0.569 | 106 | WB | Sequence | A0212 |
| 148 | AFFEFGGVMCV | 0.548 | 133 | WB | Sequence | A0212 |
| 145 | RIVAFFEFGGV | 0.511 | 198 | WB | Sequence | A0212 |
| 219 | LLSLALVGACI | 0.504 | 213 | WB | Sequence | A0212 |
| 167 | PLVDNIALWMT | 0.483 | 269 | WB | Sequence | A0212 |
| 207 | PLFDFSWLSLK | 0.472 | 301 | WB | Sequence | A0212 |
| 137 | FRDGVNWGRIV | 0.431 | 473 | WB | Sequence | A0212 |
| 84 | ALSPVPPVVHL | 0.878 | 3 | SB | Sequence | A0216 |
| 221 | SLALVGACITL | 0.855 | 4 | SB | Sequence | A0216 |
| 215 | SLKTLLSLALV | 0.806 | 8 | SB | Sequence | A0216 |
| 204 | SMRPLFDFSWL | 0.753 | 14 | SB | Sequence | A0216 |
| 123 | FTARGRFATVV | 0.739 | 16 | SB | Sequence | A0216 |
| 223 | ALVGACITLGA | 0.697 | 26 | SB | Sequence | A0216 |
| 188 | IQDNGGWDAFV | 0.637 | 50 | WB | Sequence | A0216 |
| 164 | EMSPLVDNIAL | 0.625 | 57 | WB | Sequence | A0216 |
| 179 | YLNRHLHTWIQ | 0.613 | 65 | WB | Sequence | A0216 |
| 131 | TVVEELFRDGV | 0.586 | 88 | WB | Sequence | A0216 |
| 78 | GAAAGPALSPV | 0.571 | 103 | WB | Sequence | A0216 |
| 148 | AFFEFGGVMCV | 0.563 | 112 | WB | Sequence | A0216 |
| 167 | PLVDNIALWMT | 0.535 | 153 | WB | Sequence | A0216 |
| 145 | RIVAFFEFGGV | 0.503 | 216 | WB | Sequence | A0216 |
| 151 | EFGGVMCVESV | 0.502 | 217 | WB | Sequence | A0216 |
| 213 | WLSLKTLLSLA | 0.493 | 241 | WB | Sequence | A0216 |
| 21 | KLSQRGYEWDA | 0.490 | 248 | WB | Sequence | A0216 |
| 219 | LLSLALVGACI | 0.478 | 285 | WB | Sequence | A0216 |
| 207 | PLFDFSWLSLK | 0.436 | 445 | WB | Sequence | A0216 |
| 84 | ALSPVPPVVHL | 0.786 | 10 | SB | Sequence | A0219 |
| 188 | IQDNGGWDAFV | 0.605 | 71 | WB | Sequence | A0219 |
| 123 | FTARGRFATVV | 0.594 | 81 | WB | Sequence | A0219 |
| 164 | EMSPLVDNIAL | 0.584 | 89 | WB | Sequence | A0219 |
| 179 | YLNRHLHTWIQ | 0.574 | 100 | WB | Sequence | A0219 |
| 221 | SLALVGACITL | 0.561 | 115 | WB | Sequence | A0219 |
| 219 | LLSLALVGACI | 0.551 | 128 | WB | Sequence | A0219 |
| 167 | PLVDNIALWMT | 0.537 | 149 | WB | Sequence | A0219 |
| 78 | GAAAGPALSPV | 0.496 | 233 | WB | Sequence | A0219 |
| 215 | SLKTLLSLALV | 0.490 | 248 | WB | Sequence | A0219 |
| 204 | SMRPLFDFSWL | 0.486 | 259 | WB | Sequence | A0219 |
| 223 | ALVGACITLGA | 0.467 | 320 | WB | Sequence | A0219 |
| 207 | PLFDFSWLSLK | 0.604 | 72 | WB | Sequence | A0301 |
| 228 | CITLGAYLGHK | 0.462 | 339 | WB | Sequence | A0301 |
| 207 | PLFDFSWLSLK | 0.626 | 57 | WB | Sequence | A1101 |
| 116 | SQLHLTPFTAR | 0.586 | 88 | WB | Sequence | A1101 |

TABLE C-continued

Prediction of cancer antigen Bcl-2 specific MHC class1, 8-,
9-, 10-, 11-mer peptide binders for 42 MHC class 1 alleles
(see FIG. 11) using the www.cbs.dtu.dk/services/
NetMHC/ database. The MHC class 1 molecules for which
no binders were found are not listed.

| pos | peptide | logscore | affinity (nM) | Bind Level | Protein Name | Allele |
|---|---|---|---|---|---|---|
| 228 | CITLGAYLGHK | 0.580 | 94 | WB | Sequence | A1101 |
| 172 | IALWMTEYLNR | 0.524 | 172 | WB | Sequence | A1101 |
| 6 | TGYDNREIVMK | 0.437 | 439 | WB | Sequence | A1101 |
| 142 | NWGRIVAFFEF | 0.733 | 18 | SB | Sequence | A2301 |
| 178 | EYLNRHLHTWI | 0.592 | 82 | WB | Sequence | A2301 |
| 19 | HYKLSQRGYEW | 0.563 | 112 | WB | Sequence | A2301 |
| 174 | LWMTEYLNRHL | 0.457 | 355 | WB | Sequence | A2301 |
| 212 | SWLSLKTLLSL | 0.439 | 431 | WB | Sequence | A2301 |
| 178 | EYLNRHLHTWI | 0.794 | 9 | SB | Sequence | A2402 |
| 142 | NWGRIVAFFEF | 0.744 | 15 | SB | Sequence | A2402 |
| 212 | SWLSLKTLLSL | 0.514 | 192 | WB | Sequence | A2402 |
| 174 | LWMTEYLNRHL | 0.497 | 230 | WB | Sequence | A2402 |
| 178 | EYLNRHLHTWI | 0.599 | 76 | WB | Sequence | A2403 |
| 19 | HYKLSQRGYEW | 0.573 | 101 | WB | Sequence | A2403 |
| 142 | NWGRIVAFFEF | 0.486 | 260 | WB | Sequence | A2403 |
| 17 | YIHYKLSQRGY | 0.524 | 172 | WB | Sequence | A2601 |
| 113 | EMSSQLHLTPF | 0.866 | 4 | SB | Sequence | A2602 |
| 17 | YIHYKLSQRGY | 0.817 | 7 | SB | Sequence | A2602 |
| 12 | EIVMKYIHYKL | 0.760 | 13 | SB | Sequence | A2602 |
| 187 | WIQDNGGWDAF | 0.631 | 54 | WB | Sequence | A2602 |
| 199 | ELYGPSMRPLF | 0.568 | 106 | WB | Sequence | A2602 |
| 224 | LVGACITLGAY | 0.545 | 137 | WB | Sequence | A2602 |
| 139 | DGVNWGRIVAF | 0.462 | 336 | WB | Sequence | A2602 |
| 207 | PLFDFSWLSLK | 0.456 | 359 | WB | Sequence | A3001 |
| 11 | REIVMKYIHYK | 0.439 | 434 | WB | Sequence | A3001 |
| 113 | EMSSQLHLTPF | 0.533 | 156 | WB | Sequence | A3002 |
| 128 | RFATVVEELFR | 0.765 | 12 | SB | Sequence | A3101 |
| 116 | SQLHLTPFTAR | 0.741 | 16 | SB | Sequence | A3101 |
| 196 | AFVELYGPSMR | 0.640 | 48 | SB | Sequence | A3101 |
| 172 | IALWMTEYLNR | 0.614 | 64 | WB | Sequence | A3101 |
| 11 | REIVMKYIHYK | 0.571 | 104 | WB | Sequence | A3101 |
| 15 | MKYIHYKLSQR | 0.500 | 224 | WB | Sequence | A3101 |
| 98 | QAGDDFSRRYR | 0.483 | 269 | WB | Sequence | A3101 |
| 135 | ELFRDGVNWGR | 0.634 | 52 | WB | Sequence | A3301 |
| 128 | RFATVVEELFR | 0.492 | 244 | WB | Sequence | A3301 |
| 172 | IALWMTEYLNR | 0.481 | 273 | WB | Sequence | A3301 |
| 196 | AFVELYGPSMR | 0.467 | 318 | WB | Sequence | A3301 |
| 135 | ELFRDGVNWGR | 0.739 | 16 | SB | Sequence | A6801 |
| 228 | CITLGAYLGHK | 0.618 | 62 | WB | Sequence | A6801 |
| 172 | IALWMTEYLNR | 0.593 | 81 | WB | Sequence | A6801 |
| 57 | HPAASRDPVAR | 0.579 | 95 | WB | Sequence | A6801 |
| 15 | MKYIHYKLSQR | 0.540 | 145 | WB | Sequence | A6801 |
| 98 | QAGDDFSRRYR | 0.525 | 170 | WB | Sequence | A6801 |
| 6 | TGYDNREIVMK | 0.515 | 190 | WB | Sequence | A6801 |
| 128 | RFATVVEELFR | 0.507 | 207 | WB | Sequence | A6801 |
| 95 | TLRQAGDDFSR | 0.490 | 249 | WB | Sequence | A6801 |
| 207 | PLFDFSWLSLK | 0.470 | 308 | WB | Sequence | A6801 |
| 123 | FTARGRFATVV | 0.809 | 7 | SB | Sequence | A6802 |
| 131 | TVVEELFRDGV | 0.784 | 10 | SB | Sequence | A6802 |
| 145 | RIVAFFEFGGV | 0.727 | 19 | SB | Sequence | A6802 |
| 12 | EIVMKYIHYKL | 0.592 | 83 | WB | Sequence | A6802 |
| 78 | GAAAGPALSPV | 0.560 | 116 | WB | Sequence | A6802 |
| 164 | EMSPLVDNIAL | 0.520 | 179 | WB | Sequence | A6802 |
| 159 | ESVNREMSPLV | 0.488 | 254 | WB | Sequence | A6802 |
| 225 | VGACITLGAYL | 0.459 | 349 | WB | Sequence | A6802 |
| 55 | TPHPAASRDPV | 0.435 | 453 | WB | Sequence | A6802 |
| 123 | FTARGRFATVV | 0.710 | 23 | SB | Sequence | A6901 |
| 164 | EMSPLVDNIAL | 0.541 | 144 | WB | Sequence | A6901 |
| 131 | TVVEELFRDGV | 0.510 | 201 | WB | Sequence | A6901 |
| 159 | ESVNREMSPLV | 0.485 | 263 | WB | Sequence | A6901 |

TABLE C-continued

Prediction of cancer antigen Bcl-2 specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 206 | RPLFDFSWLSL | 0.747 | 15 | SB | Sequence | B0702 |
| 86 | SPVPPVVHLTL | 0.717 | 21 | SB | Sequence | B0702 |
| 55 | TPHPAASRDPV | 0.567 | 108 | WB | Sequence | B0702 |
| 82 | GPALSPVPPVV | 0.559 | 118 | WB | Sequence | B0702 |
| 166 | SPLVDNIALWM | 0.469 | 312 | WB | Sequence | B0702 |
| 126 | RGRFATVVEEL | 0.463 | 332 | WB | Sequence | B0702 |
| 121 | TPFTARGRFAT | 0.443 | 416 | WB | Sequence | B0702 |
| 97 | RQAGDDFSRRY | 0.600 | 75 | WB | Sequence | B1501 |
| 187 | WIQDNGGWDAF | 0.499 | 226 | WB | Sequence | B1501 |
| 224 | LVGACITLGAY | 0.491 | 245 | WB | Sequence | B1501 |
| 17 | YIHYKLSQRGY | 0.476 | 290 | WB | Sequence | B1501 |
| 113 | EMSSQLHLTPF | 0.433 | 461 | WB | Sequence | B1501 |
| 140 | GVNWGRIVAFF | 0.433 | 463 | WB | Sequence | B1501 |
| 177 | TEYLNRHLHTW | 0.585 | 89 | WB | Sequence | B1801 |
| 198 | VELYGPSMRPL | 0.558 | 119 | WB | Sequence | B1801 |
| 158 | VESVNREMSPL | 0.514 | 191 | WB | Sequence | B1801 |
| 133 | VEELFRDGVNW | 0.459 | 348 | WB | Sequence | B1801 |
| 127 | GRFATVVEELF | 0.512 | 196 | WB | Sequence | B2705 |
| 108 | RRDFAEMSSQL | 0.481 | 273 | WB | Sequence | B2705 |
| 97 | RQAGDDFSRRY | 0.445 | 405 | WB | Sequence | B2705 |
| 166 | SPLVDNIALWM | 0.573 | 101 | WB | Sequence | B3501 |
| 187 | WIQDNGGWDAF | 0.544 | 139 | WB | Sequence | B3501 |
| 195 | DAFVELYGPSM | 0.543 | 140 | WB | Sequence | B3501 |
| 113 | EMSSQLHLTPF | 0.543 | 140 | WB | Sequence | B3501 |
| 121 | TPFTARGRFAT | 0.503 | 217 | WB | Sequence | B3501 |
| 224 | LVGACITLGAY | 0.502 | 218 | WB | Sequence | B3501 |
| 146 | IVAFFEFGGVM | 0.500 | 222 | WB | Sequence | B3501 |
| 86 | SPVPPVVHLTL | 0.443 | 416 | WB | Sequence | B3501 |
| 139 | DGVNWGRIVAF | 0.442 | 419 | WB | Sequence | B3501 |
| 61 | SRDPVARTSPL | 0.500 | 223 | WB | Sequence | B3901 |
| 198 | VELYGPSMRPL | 0.547 | 134 | WB | Sequence | B4001 |
| 158 | VESVNREMSPL | 0.471 | 306 | WB | Sequence | B4001 |
| 177 | TEYLNRHLHTW | 0.520 | 180 | WB | Sequence | B4402 |
| 112 | AEMSSQLHLTP | 0.529 | 163 | WB | Sequence | B4501 |
| 37 | APPGAAPAPGI | 0.507 | 207 | WB | Sequence | B5101 |
| 82 | GPALSPVPPVV | 0.465 | 326 | WB | Sequence | B5101 |
| 86 | SPVPPVVHLTL | 0.433 | 461 | WB | Sequence | B5101 |
| 166 | SPLVDNIALWM | 0.453 | 373 | WB | Sequence | B5301 |
| 206 | RPLFDFSWLSL | 0.436 | 448 | WB | Sequence | B5301 |
| 121 | TPFTARGRFAT | 0.638 | 50 | WB | Sequence | B5401 |
| 69 | SPLQTPAAPGA | 0.557 | 121 | WB | Sequence | B5401 |
| 89 | PPVVHLTLRQA | 0.501 | 220 | WB | Sequence | B5401 |
| 55 | TPHPAASRDPV | 0.428 | 489 | WB | Sequence | B5401 |
| 165 | MSPLVDNIALW | 0.462 | 335 | WB | Sequence | B5701 |
| 203 | PSMRPLFDFSW | 0.635 | 51 | WB | Sequence | B5801 |

SEQ ID NOS: 44893-45800

Preferred fragments of BclX(L) capable of interacting with one or more MHC class 2 molecules are listed in table D.

TABLE D

Prediction of cancer antigen BclX(L) specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0101 | 212 RWFLTGMTVAGV-VLL | LTGMTVAGV | 0.8028 | 8 | SB | BclX(L) |
| DRB1_0101 | 209 RFNRWFLTGMT-VAGV | FLTGMTVAG | 0.7932 | 9 | SB | BclX(L) |
| DRB1_0101 | 210 FNRWFLTGMT-VAGVV | LTGMTVAGV | 0.7940 | 9 | SB | BclX(L) |
| DRB1_0101 | 211 NRWFLTGMT-VAGVVL | LTGMTVAGV | 0.7970 | 9 | SB | BclX(L) |
| DRB1_0101 | 213 WFLTGMTVAGVV-LLG | LTGMTVAGV | 0.7753 | 11 | SB | BclX(L) |
| DRB1_0101 | 76 DAREVIP-MAAVKQAL | VIPMAAVKQ | 0.7755 | 11 | SB | BclX(L) |
| DRB1_0101 | 77 AREVIP-MAAVKQALR | VIPMAAVKQ | 0.7788 | 11 | SB | BclX(L) |
| DRB1_0101 | 78 REVIP-MAAVKQALRE | VIPMAAVKQ | 0.7772 | 11 | SB | BclX(L) |
| DRB1_0101 | 75 LDAREVIP-MAAVKQA | VIPMAAVKQ | 0.7730 | 12 | SB | BclX(L) |
| DRB1_0101 | 157 KEMQVLVSRI-AAWMA | MQVLVSRIA | 0.7458 | 16 | SB | BclX(L) |
| DRB1_0101 | 108 LTSQLHITPG-TAYQS | LHITPGTAY | 0.7338 | 18 | SB | BclX(L) |
| DRB1_0101 | 109 TSQLHITPGTAY-QSF | ITPGTAYQS | 0.7313 | 18 | SB | BclX(L) |
| DRB1_0101 | 74 SLDAREVIP-MAAVKQ | AREVIPMAA | 0.7348 | 18 | SB | BclX(L) |
| DRB1_0101 | 110 SQLHITPGTAY-QSFE | ITPGTAYQS | 0.7287 | 19 | SB | BclX(L) |
| DRB1_0101 | 214 FLTGMTVAGVV-LLGS | LTGMTVAGV | 0.7282 | 19 | SB | BclX(L) |
| DRB1_0101 | 156 DKEMQVLVSRI-AAWM | MQVLVSRIA | 0.7226 | 20 | SB | BclX(L) |
| DRB1_0101 | 111 QLHITPGTAYQS-FEQ | ITPGTAYQS | 0.7202 | 21 | SB | BclX(L) |
| DRB1_0101 | 112 LHITPGTAYQS-FEQV | ITPGTAYQS | 0.7189 | 21 | SB | BclX(L) |
| DRB1_0101 | 154 SVDKEMQVLVS-RIAA | MQVLVSRIA | 0.7165 | 21 | SB | BclX(L) |
| DRB1_0101 | 79 EVIPMAAVKQAL-REA | IPMAAVKQA | 0.7208 | 21 | SB | BclX(L) |
| DRB1_0101 | 153 ESVDKEMQVLVS-RIA | VDKEMQVLV | 0.7145 | 22 | SB | BclX(L) |
| DRB1_0101 | 155 VDKEMQVLVSRI-AAW | MQVLVSRIA | 0.7141 | 22 | SB | BclX(L) |
| DRB1_0101 | 215 LTGMTVAGVV-LLGSL | LTGMTVAGV | 0.7090 | 23 | SB | BclX(L) |
| DRB1_0101 | 208 ERFNRWFLTGMT-VAG | FNRWFLTGM | 0.7077 | 24 | SB | BclX(L) |
| DRB1_0101 | 46 ETPSAING-NPSWHLA | INGNPSWHL | 0.7051 | 24 | SB | BclX(L) |
| DRB1_0101 | 47 TPSAING-NPSWHLAD | INGNPSWHL | 0.7051 | 24 | SB | BclX(L) |
| DRB1_0101 | 48 PSAING-NPSWHLADS | INGNPSWHL | 0.7076 | 24 | SB | BclX(L) |
| DRB1_0101 | 49 SAING-NPSWHLADSP | INGNPSWHL | 0.7072 | 24 | SB | BclX(L) |
| DRB1_0101 | 45 METPSAING-NPSWHL | PSAINGNPS | 0.7034 | 25 | SB | BclX(L) |
| DRB1_0101 | 158 EMQVLVSRIAAW-MAT | MQVLVSRIA | 0.6845 | 30 | SB | BclX(L) |
| DRB1_0101 | 80 VIPMAAVKQAL-REAG | VIPMAAVKQ | 0.6856 | 30 | SB | BclX(L) |
| DRB1_0101 | 159 MQVLVSRIAAW-MATY | MQVLVSRIA | 0.6834 | 31 | SB | BclX(L) |
| DRB1_0101 | 161 VLVSRIAAW-MATYLN | IAAWMATYL | 0.6838 | 31 | SB | BclX(L) |
| DRB1_0101 | 217 GMTVAGVVLLG-SLFS | MTVAGVVLL | 0.6800 | 32 | SB | BclX(L) |
| DRB1_0101 | 218 MTVAGVVLLG-SLFSR | VVLLGSLFS | 0.6800 | 32 | SB | BclX(L) |
| DRB1_0101 | 51 INGNPSWHLAD-SPAV | INGNPSWHL | 0.6778 | 33 | SB | BclX(L) |
| DRB1_0101 | 192 VELYGNNAAAES-RKG | YGNNAAAES | 0.6693 | 36 | SB | BclX(L) |
| DRB1_0101 | 219 TVAGVVLLGSLF-SRK | VVLLGSLFS | 0.6677 | 36 | SB | BclX(L) |
| DRB1_0101 | 160 QVLVSRIAAW-MATYL | VSRIAAWMA | 0.6652 | 37 | SB | BclX(L) |

TABLE D-continued

Prediction of cancer antigen BclX(L) specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0101 | 191 FVELYGN-NAAAESRK | YGNNAAAES | 0.6658 | 37 | SB | BclX(L) |
| DRB1_0101 | 193 ELYGNNAAAES-RKGQ | YGNNAAAES | 0.6661 | 37 | SB | BclX(L) |
| DRB1_0101 | 99 LRYRRAF-SDLTSQLH | YRRAFSDLT | 0.6657 | 37 | SB | BclX(L) |
| DRB1_0101 | 162 LVSRIAAW-MATYLND | IAAWMATYL | 0.6627 | 38 | SB | BclX(L) |
| DRB1_0101 | 190 TFVELYGN-NAAAESR | YGNNAAAES | 0.6628 | 38 | SB | BclX(L) |
| DRB1_0101 | 189 DTFVELYGN-NAAAES | FVELYGNNA | 0.6613 | 39 | SB | BclX(L) |
| DRB1_0101 | 54 NPSWHLAD-SPAVNGA | WHLADSPAV | 0.6617 | 39 | SB | BclX(L) |
| DRB1_0101 | 55 PSWHLADSPAVN-GAT | WHLADSPAV | 0.6611 | 39 | SB | BclX(L) |
| DRB1_0101 | 216 TGMTVAGVVLLG-SLF | MTVAGVVLL | 0.6543 | 42 | SB | BclX(L) |
| DRB1_0101 | 163 VSRIAAW-MATYLNDH | IAAWMATYL | 0.6531 | 43 | SB | BclX(L) |
| DRB1_0101 | 53 GNPSWHLAD-SPAVNG | WHLADSPAV | 0.6532 | 43 | SB | BclX(L) |
| DRB1_0101 | 59 LADSPAVNGAT-GHSS | LADSPAVNG | 0.6361 | 51 | WB | BclX(L) |
| DRB1_0101 | 98 ELRYRRAF-SDLTSQL | YRRAFSDLT | 0.6357 | 51 | WB | BclX(L) |
| DRB1_0101 | 164 SRIAAW-MATYLNDHL | IAAWMATYL | 0.6357 | 52 | WB | BclX(L) |
| DRB1_0101 | 97 FELRYRRAF-SDLTSQ | YRRAFSDLT | 0.6337 | 53 | WB | BclX(L) |
| DRB1_0101 | 96 EFELRYRRAF-SDLTS | YRRAFSDLT | 0.6321 | 54 | WB | BclX(L) |
| DRB1_0101 | 95 DEFELRYRRAF-SDLT | LRYRRAFSD | 0.6294 | 55 | WB | BclX(L) |
| DRB1_0101 | 140 IVAFFSFGGAL-CVES | FSFGGALCV | 0.6203 | 61 | WB | BclX(L) |
| DRB1_0101 | 56 SWHLADSPAVN-GATG | LADSPAVNG | 0.6196 | 61 | WB | BclX(L) |
| DRB1_0101 | 61 DSPAVNGAT-GHSSSL | VNGATGHSS | 0.6197 | 61 | WB | BclX(L) |
| DRB1_0101 | 62 SPAVNGAT-GHSSSLD | VNGATGHSS | 0.6205 | 61 | WB | BclX(L) |
| DRB1_0101 | 141 VAFFSFGGAL-CVESV | FSFGGALCV | 0.6191 | 62 | WB | BclX(L) |
| DRB1_0101 | 60 ADSPAVNGAT-GHSSS | VNGATGHSS | 0.6174 | 63 | WB | BclX(L) |
| DRB1_0101 | 142 AFFSFGGAL-CVESVD | FSFGGALCV | 0.6153 | 64 | WB | BclX(L) |
| DRB1_0101 | 57 WHLADSPAVN-GATGH | LADSPAVNG | 0.6162 | 64 | WB | BclX(L) |
| DRB1_0101 | 113 HITPGTAYQS-FEQVV | ITPGTAYQS | 0.6121 | 66 | WB | BclX(L) |
| DRB1_0101 | 114 ITPGTAYQS-FEQVVN | ITPGTAYQS | 0.6131 | 66 | WB | BclX(L) |
| DRB1_0101 | 50 AINGNPSWHLAD-SPA | INGNPSWHL | 0.6133 | 66 | WB | BclX(L) |
| DRB1_0101 | 63 PAVNGAT-GHSSSLDA | VNGATGHSS | 0.6078 | 70 | WB | BclX(L) |
| DRB1_0101 | 100 RYRRAF-SDLTSQLHI | YRRAFSDLT | 0.6026 | 74 | WB | BclX(L) |
| DRB1_0101 | 101 YRRAFSDLTSQL-HIT | YRRAFSDLT | 0.6021 | 74 | WB | BclX(L) |
| DRB1_0101 | 52 NGNPSWHLAD-SPAVN | WHLADSPAV | 0.6004 | 75 | WB | BclX(L) |
| DRB1_0101 | 138 GRIVAFFSFG-GALCV | IVAFFSFGG | 0.5864 | 88 | WB | BclX(L) |
| DRB1_0101 | 194 LYGNNAAAESRK-GQE | YGNNAAAES | 0.5808 | 93 | WB | BclX(L) |
| DRB1_0101 | 165 RIAAWMATYLND-HLE | AAWMATYLN | 0.5762 | 98 | WB | BclX(L) |
| DRB1_0101 | 195 YGNNAAAESRK-GQER | YGNNAAAES | 0.5731 | 101 | WB | BclX(L) |
| DRB1_0101 | 139 RIVAFFSFGGAL-CVE | FSFGGALCV | 0.5729 | 102 | WB | BclX(L) |
| DRB1_0101 | 131 FRDGVN-WGRIVAFFS | VNWGRIVAF | 0.5627 | 114 | WB | BclX(L) |
| DRB1_0101 | 143 FFSFGGALCVES-VDK | FSFGGALCV | 0.5613 | 115 | WB | BclX(L) |

TABLE D-continued

Prediction of cancer antigen BclX(L) specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0101 | 144 FSFGGALCVES-VDKE | FSFGGALCV | 0.5583 | 119 | WB | BclX(L) |
| DRB1_0101 | 132 RDGVN-WGRIVAFFSF | VNWGRIVAF | 0.5561 | 122 | WB | BclX(L) |
| DRB1_0101 | 133 DGVN-WGRIVAFFSFG | VNWGRIVAF | 0.5558 | 122 | WB | BclX(L) |
| DRB1_0101 | 81 IPMAAVKQAL-REAGD | IPMAAVKQA | 0.5527 | 126 | WB | BclX(L) |
| DRB1_0101 | 102 RRAFSDLTSQL-HITP | FSDLTSQLH | 0.5334 | 156 | WB | BclX(L) |
| DRB1_0101 | 103 RAFSDLTSQL-HITPG | FSDLTSQLH | 0.5314 | 159 | WB | BclX(L) |
| DRB1_0101 | 58 HLADSPAVNGAT-GHS | LADSPAVNG | 0.5293 | 163 | WB | BclX(L) |
| DRB1_0101 | 134 GVN-WGRIVAFFSFGG | VNWGRIVAF | 0.5282 | 165 | WB | BclX(L) |
| DRB1_0101 | 166 IAAWMATYLNDH-LEP | IAAWMATYL | 0.5271 | 167 | WB | BclX(L) |
| DRB1_0101 | 64 AVNGAT-GHSSSLDAR | VNGATGHSS | 0.5266 | 168 | WB | BclX(L) |
| DRB1_0101 | 135 VNWGRIVAFFSF-GGA | VNWGRIVAF | 0.5248 | 171 | WB | BclX(L) |
| DRB1_0101 | 7 ELVVDFL-SYKLSQKG | VVDFLSYKL | 0.5243 | 172 | WB | BclX(L) |
| DRB1_0101 | 129 ELFRDGVN-WGRIVAF | FRDGVNWGR | 0.5154 | 189 | WB | BclX(L) |
| DRB1_0101 | 65 VNGAT-GHSSSLDARE | VNGATGHSS | 0.5156 | 189 | WB | BclX(L) |
| DRB1_0101 | 130 LFRDGVN-WGRIVAFF | VNWGRIVAF | 0.5023 | 218 | WB | BclX(L) |
| DRB1_0101 | 8 LVVDFL-SYKLSQKGY | LSYKLSQKG | 0.4921 | 244 | WB | BclX(L) |
| DRB1_0101 | 9 VVDFLSYKLSQK-GYS | LSYKLSQKG | 0.4892 | 251 | WB | BclX(L) |
| DRB1_0101 | 207 QERFNRWFLTG-MTVA | FNRWFLTGM | 0.4845 | 264 | WB | BclX(L) |
| DRB1_0101 | 42 ESEMETPSAING-NPS | METPSAING | 0.4626 | 335 | WB | BclX(L) |
| DRB1_0101 | 40 GTESEMETP-SAINGN | METPSAING | 0.4622 | 337 | WB | BclX(L) |
| DRB1_0101 | 107 DLTSQLHITPG-TAYQ | LHITPGTAY | 0.4593 | 347 | WB | BclX(L) |
| DRB1_0101 | 39 EGTESEMETPSA-ING | ESEMETPSA | 0.4591 | 348 | WB | BclX(L) |
| DRB1_0101 | 43 SEMETPSAING-NPSW | METPSAING | 0.4590 | 348 | WB | BclX(L) |
| DRB1_0101 | 106 SDLTSQLHITPG-TAY | SQLHITPGT | 0.4569 | 356 | WB | BclX(L) |
| DRB1_0101 | 10 VDFLSYKLSQK-GYSW | LSYKLSQKG | 0.4565 | 358 | WB | BclX(L) |
| DRB1_0101 | 41 TESEMETP-SAINGNP | METPSAING | 0.4564 | 358 | WB | BclX(L) |
| DRB1_0101 | 167 AAWMATYLND-HLEPW | AAWMATYLN | 0.4556 | 361 | WB | BclX(L) |
| DRB1_0101 | 11 DFLSYKLSQK-GYSWS | LSYKLSQKG | 0.4515 | 378 | WB | BclX(L) |
| DRB1_0101 | 104 AFSDLTSQLHIT-PGT | FSDLTSQLH | 0.4453 | 404 | WB | BclX(L) |
| DRB1_0101 | 105 FSDLTSQLHIT-PGTA | FSDLTSQLH | 0.4451 | 405 | WB | BclX(L) |
| DRB1_0101 | 137 WGRIVAFFSFG-GALC | IVAFFSFGG | 0.4311 | 471 | WB | BclX(L) |
| DRB1_0101 | 206 GQERFNRWFLTG-MTV | FNRWFLTGM | 0.4277 | 489 | WB | BclX(L) |
| DRB1_0401 | 99 LRYRRAF-SDLTSQLH | YRRAFSDLT | 0.5618 | 115 | WB | BclX(L) |
| DRB1_0401 | 97 FELRYRRAF-SDLTSQ | YRRAFSDLT | 0.5300 | 162 | WB | BclX(L) |
| DRB1_0401 | 96 EFELRYRRAF-SDLTS | YRRAFSDLT | 0.5284 | 164 | WB | BclX(L) |
| DRB1_0401 | 95 DEFELRYRRAF-SDLT | DEFELRYRR | 0.5275 | 166 | WB | BclX(L) |
| DRB1_0401 | 98 ELRYRRAF-SDLTSQL | YRRAFSDLT | 0.5259 | 169 | WB | BclX(L) |
| DRB1_0401 | 185 NGGWDTFVELYG-NNA | WDTFVELYG | 0.5189 | 182 | WB | BclX(L) |

TABLE D-continued

Prediction of cancer antigen BclX(L) specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0401 | 186 GGWDTFVELYGN-NAA | FVELYGNNA | 0.5180 | 184 | WB | BclX(L) |
| DRB1_0401 | 188 WDTFVELYGN-NAAAE | FVELYGNNA | 0.5159 | 188 | WB | BclX(L) |
| DRB1_0401 | 187 GWDTFVELYGN-NAAA | FVELYGNNA | 0.5157 | 189 | WB | BclX(L) |
| DRB1_0401 | 189 DTFVELYGN-NAAAES | FVELYGNNA | 0.5154 | 189 | WB | BclX(L) |
| DRB1_0401 | 100 RYRRAF-SDLTSQLHI | YRRAFSDLT | 0.4844 | 265 | WB | BclX(L) |
| DRB1_0401 | 101 YRRAFSDLTSQL-HIT | YRRAFSDLT | 0.4813 | 274 | WB | BclX(L) |
| DRB1_0401 | 153 ESVDKEMQVLVS-RIA | KEMQVLVSR | 0.4561 | 360 | WB | BclX(L) |
| DRB1_0401 | 155 VDKEMQVLVSRI-AAW | MQVLVSRIA | 0.4519 | 376 | WB | BclX(L) |
| DRB1_0401 | 208 ERFNRWFLTGMT-VAG | WFLTGMTVA | 0.4512 | 379 | WB | BclX(L) |
| DRB1_0401 | 154 SVDKEMQVLVS-RIAA | MQVLVSRIA | 0.4495 | 386 | WB | BclX(L) |
| DRB1_0401 | 209 RFNRWFLTGMT-VAGV | FLTGMTVAG | 0.4467 | 398 | WB | BclX(L) |
| DRB1_0401 | 210 FNRWFLTGMT-VAGVV | FLTGMTVAG | 0.4427 | 416 | WB | BclX(L) |
| DRB1_0401 | 157 KEMQVLVSRI-AAWMA | MQVLVSRIA | 0.4419 | 419 | WB | BclX(L) |
| DRB1_0401 | 156 DKEMQVLVSRI-AAWM | MQVLVSRIA | 0.4413 | 422 | WB | BclX(L) |
| DRB1_0401 | 211 NRWFLTGMT-VAGVVL | FLTGMTVAG | 0.4327 | 463 | WB | BclX(L) |
| DRB1_0404 | 167 AAWMATYLND-HLEPW | WMATYLNDH | 0.5484 | 132 | WB | BclX(L) |
| DRB1_0404 | 164 SRIAAW-MATYLNDHL | WMATYLNDH | 0.5424 | 141 | WB | BclX(L) |
| DRB1_0404 | 165 RIAAWMATYLND-HLE | WMATYLNDH | 0.5417 | 142 | WB | BclX(L) |
| DRB1_0404 | 166 IAAWMATYLNDH-LEP | WMATYLNDH | 0.5330 | 156 | WB | BclX(L) |
| DRB1_0404 | 163 VSRIAAW-MATYLNDH | AAWMATYLN | 0.5217 | 177 | WB | BclX(L) |
| DRB1_0404 | 219 TVAGVVLLGSLF-SRK | VVLLGSLFS | 0.5094 | 202 | WB | BclX(L) |
| DRB1_0404 | 209 RFNRWFLTGMT-VAGV | FLTGMTVAG | 0.4902 | 249 | WB | BclX(L) |
| DRB1_0404 | 210 FNRWFLTGMT-VAGVV | FLTGMTVAG | 0.4853 | 262 | WB | BclX(L) |
| DRB1_0404 | 211 NRWFLTGMT-VAGVVL | FLTGMTVAG | 0.4826 | 270 | WB | BclX(L) |
| DRB1_0404 | 208 ERFNRWFLTGMT-VAG | WFLTGMTVA | 0.4761 | 290 | WB | BclX(L) |
| DRB1_0404 | 168 AWMATYLND-HLEPWI | WMATYLNDH | 0.4694 | 311 | WB | BclX(L) |
| DRB1_0404 | 212 RWFLTGMTVAGV-VLL | FLTGMTVAG | 0.4547 | 365 | WB | BclX(L) |
| DRB1_0404 | 189 DTFVELYGN-NAAAES | FVELYGNNA | 0.4505 | 382 | WB | BclX(L) |
| DRB1_0404 | 187 GWDTFVELYGN-NAAA | FVELYGNNA | 0.4498 | 385 | WB | BclX(L) |
| DRB1_0404 | 169 WMATYLNDHLEP-WIQ | WMATYLNDH | 0.4478 | 393 | WB | BclX(L) |
| DRB1_0404 | 188 WDTFVELYGN-NAAAE | FVELYGNNA | 0.4462 | 400 | WB | BclX(L) |
| DRB1_0404 | 186 GGWDTFVELYGN-NAA | FVELYGNNA | 0.4437 | 411 | WB | BclX(L) |
| DRB1_0404 | 185 NGGWDTFVELYG-NNA | GWDTFVELY | 0.4388 | 434 | WB | BclX(L) |
| DRB1_0405 | 118 TAYQSFEQV-VNELFR | YQSFEQVVN | 0.5794 | 95 | WB | BclX(L) |
| DRB1_0405 | 117 GTAYQSFEQV-VNELF | YQSFEQVVN | 0.5772 | 97 | WB | BclX(L) |
| DRB1_0405 | 115 TPGTAYQSFEQV-VNE | YQSFEQVVN | 0.5541 | 124 | WB | BclX(L) |
| DRB1_0405 | 116 PGTAYQSFEQV-VNEL | YQSFEQVVN | 0.5538 | 125 | WB | BclX(L) |
| DRB1_0405 | 114 ITPGTAYQS-FEQVVN | AYQSFEQVV | 0.5505 | 129 | WB | BclX(L) |

TABLE D-continued

Prediction of cancer antigen BclX(L) specific MHC class 2, 15-mer
peptide binders for 14 MHC class 2 alleles (see FIG. 11) using the
www.cbs.dtu.dk/services/NetMHCII/ database. The MHC class 2
molecules for which no binders were found are not listed.

| Allele | pospeptide | core | 1-log50k(aff) | affinity (nM) | Bind Level | Identity |
|---|---|---|---|---|---|---|
| DRB1_0405 | 163 VSRIAAW-MATYLNDH | AAWMATYLN | 0.5510 | 129 | WB | BclX(L) |
| DRB1_0405 | 162 LVSRIAAW-MATYLND | AAWMATYLN | 0.5473 | 134 | WB | BclX(L) |
| DRB1_0405 | 161 VLVSRIAAW-MATYLN | IAAWMATYL | 0.5442 | 139 | WB | BclX(L) |
| DRB1_0405 | 164 SRIAAW-MATYLNDHL | AAWMATYLN | 0.5402 | 145 | WB | BclX(L) |
| DRB1_0405 | 99 LRYRRAF-SDLTSQLH | YRRAFSDLT | 0.5100 | 201 | WB | BclX(L) |
| DRB1_0405 | 97 FELRYRRAF-SDLTSQ | YRRAFSDLT | 0.5085 | 204 | WB | BclX(L) |
| DRB1_0405 | 96 EFELRYRRAF-SDLTS | YRRAFSDLT | 0.5069 | 208 | WB | BclX(L) |
| DRB1_0405 | 165 RIAAWMATYLND-HLE | AAWMATYLN | 0.5055 | 211 | WB | BclX(L) |
| DRB1_0405 | 119 AYQSFEQVVNEL-FRD | YQSFEQVVN | 0.4974 | 230 | WB | BclX(L) |
| DRB1_0405 | 120 YQSFEQVVNEL-FRDG | YQSFEQVVN | 0.4968 | 231 | WB | BclX(L) |
| DRB1_0405 | 98 ELRYRRAF-SDLTSQL | YRRAFSDLT | 0.4923 | 243 | WB | BclX(L) |
| DRB1_0405 | 18 SQKGYSWSQFSD-VEE | GYSWSQFSD | 0.4575 | 354 | WB | BclX(L) |
| DRB1_0405 | 95 DEFELRYRRAF-SDLT | LRYRRAFSD | 0.4574 | 355 | WB | BclX(L) |
| DRB1_0405 | 19 QKGYSWSQFSD-VEEN | WSQFSDVEE | 0.4562 | 359 | WB | BclX(L) |
| DRB1_0405 | 100 RYRRAF-SDLTSQLHI | YRRAFSDLT | 0.4475 | 395 | WB | BclX(L) |
| DRB1_0405 | 20 KGYSWSQFSD-VEENR | WSQFSDVEE | 0.4430 | 414 | WB | BclX(L) |
| DRB1_0405 | 166 IAAWMATYLNDH-LEP | AAWMATYLN | 0.4423 | 418 | WB | BclX(L) |
| DRB1_0405 | 21 GYSWSQFSD-VEENRT | WSQFSDVEE | 0.4353 | 450 | WB | BclX(L) |
| DRB1_0701 | 157 KEMQVLVSRI-AAWMA | VLVSRIAAW | 0.5228 | 175 | WB | BclX(L) |
| DRB1_0701 | 159 MQVLVSRIAAW-MATY | VLVSRIAAW | 0.5194 | 181 | WB | BclX(L) |
| DRB1_0701 | 158 EMQVLVSRIAAW-MAT | VLVSRIAAW | 0.5191 | 182 | WB | BclX(L) |
| DRB1_0701 | 156 DKEMQVLVSRI-AAWM | VLVSRIAAW | 0.4971 | 231 | WB | BclX(L) |
| DRB1_0701 | 160 QVLVSRIAAW-MATYL | VLVSRIAAW | 0.4833 | 268 | WB | BclX(L) |
| DRB1_0701 | 46 ETPSAING-NPSWHLA | INGNPSWHL | 0.4783 | 283 | WB | BclX(L) |
| DRB1_0701 | 45 METPSAING-NPSWHL | AINGNPSWH | 0.4779 | 284 | WB | BclX(L) |
| DRB1_0701 | 155 VDKEMQVLVSRI-AAW | MQVLVSRIA | 0.4772 | 286 | WB | BclX(L) |
| DRB1_0701 | 47 TPSAING-NPSWHLAD | INGNPSWHL | 0.4774 | 286 | WB | BclX(L) |
| DRB1_0701 | 48 PSAING-NPSWHLADS | INGNPSWHL | 0.4764 | 289 | WB | BclX(L) |
| DRB1_0701 | 161 VLVSRIAAW-MATYLN | VLVSRIAAW | 0.4745 | 295 | WB | BclX(L) |
| DRB1_0701 | 49 SAING-NPSWHLADSP | INGNPSWHL | 0.4718 | 303 | WB | BclX(L) |
| DRB1_0701 | 99 LRYRRAF-SDLTSQLH | YRRAFSDLT | 0.4627 | 335 | WB | BclX(L) |
| DRB1_0701 | 100 RYRRAF-SDLTSQLHI | FSDLTSQLH | 0.4416 | 420 | WB | BclX(L) |
| DRB1_0701 | 101 YRRAFSDLTSQL-HIT | FSDLTSQLH | 0.4344 | 455 | WB | BclX(L) |
| DRB1_0701 | 51 INGNPSWHLAD-SPAV | INGNPSWHL | 0.4291 | 481 | WB | BclX(L) |
| DRB1_0901 | 55 PSWHLADSPAVN-GAT | WHLADSPAV | 0.5482 | 133 | WB | BclX(L) |
| DRB1_0901 | 54 NPSWHLAD-SPAVNGA | WHLADSPAV | 0.5414 | 143 | WB | BclX(L) |
| DRB1_0901 | 53 GNPSWHLAD-SPAVNG | WHLADSPAV | 0.5408 | 144 | WB | BclX(L) |
| DRB1_0901 | 51 INGNPSWHLAD-SPAV | SWHLADSPA | 0.5289 | 164 | WB | BclX(L) |

TABLE D-continued

Prediction of cancer antigen BclX(L) specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0901 | 52 NGNPSWHLADSPAVN | WHLADSPAV | 0.5284 | 164 | WB | BclX(L) |
| DRB1_0901 | 56 SWHLADSPAVNGATG | WHLADSPAV | 0.4678 | 317 | WB | BclX(L) |
| DRB1_0901 | 57 WHLADSPAVNGATGH | WHLADSPAV | 0.4636 | 331 | WB | BclX(L) |
| DRB1_0901 | 212 RWFLTGMTVAGVVLL | FLTGMTVAG | 0.4483 | 391 | WB | BclX(L) |
| DRB1_0901 | 213 WFLTGMTVAGVVLLG | MTVAGVVLL | 0.4445 | 408 | WB | BclX(L) |
| DRB1_0901 | 214 FLTGMTVAGVVLLGS | MTVAGVVLL | 0.4327 | 463 | WB | BclX(L) |
| DRB1_1101 | 157 KEMQVLVSRIAAWMA | MQVLVSRIA | 0.4319 | 467 | WB | BclX(L) |
| DRB1_1101 | 131 FRDGVNWGRIVAFFS | GVNWGRIVA | 0.4310 | 472 | WB | BclX(L) |
| DRB1_1101 | 156 DKEMQVLVSRIAAWM | MQVLVSRIA | 0.4308 | 473 | WB | BclX(L) |
| DRB1_1101 | 155 VDKEMQVLVSRIAAW | MQVLVSRIA | 0.4292 | 481 | WB | BclX(L) |
| DRB1_1101 | 132 RDGVNWGRIVAFFSF | GVNWGRIVA | 0.4283 | 486 | WB | BclX(L) |
| DRB1_1101 | 154 SVDKEMQVLVSRIAA | MQVLVSRIA | 0.4267 | 494 | WB | BclX(L) |
| DRB1_1302 | 218 MTVAGVVLLGSLFSR | VVLLGSLFS | 0.4945 | 237 | WB | BclX(L) |
| DRB1_1302 | 216 TGMTVAGVVLLGSLF | MTVAGVVLL | 0.4855 | 262 | WB | BclX(L) |
| DRB1_1302 | 214 FLTGMTVAGVVLLGS | MTVAGVVLL | 0.4842 | 265 | WB | BclX(L) |
| DRB1_1302 | 217 GMTVAGVVLLGSLFS | MTVAGVVLL | 0.4840 | 266 | WB | BclX(L) |
| DRB1_1302 | 212 RWFLTGMTVAGVVLL | FLTGMTVAG | 0.4832 | 268 | WB | BclX(L) |
| DRB1_1302 | 215 LTGMTVAGVVLLGSL | MTVAGVVLL | 0.4775 | 285 | WB | BclX(L) |
| DRB1_1302 | 213 WFLTGMTVAGVVLLG | MTVAGVVLL | 0.4716 | 304 | WB | BclX(L) |
| DRB1_1302 | 189 DTFVELYGNNAAAES | VELYGNNAA | 0.4688 | 313 | WB | BclX(L) |
| DRB1_1302 | 190 TFVELYGNNAAAESR | YGNNAAAES | 0.4615 | 339 | WB | BclX(L) |
| DRB1_1302 | 191 FVELYGNNAAAESRK | YGNNAAAES | 0.4526 | 373 | WB | BclX(L) |
| DRB1_1302 | 192 VELYGNNAAAESRKG | YGNNAAAES | 0.4415 | 421 | WB | BclX(L) |
| DRB1_1302 | 219 TVAGVVLLGSLFSRK | VVLLGSLFS | 0.4384 | 436 | WB | BclX(L) |
| DRB1_1302 | 193 ELYGNNAAAESRKGQ | YGNNAAAES | 0.4275 | 490 | WB | BclX(L) |
| DRB1_1501 | 219 TVAGVVLLGSLFSRK | VLLGSLFSR | 0.6681 | 36 | SB | BclX(L) |
| DRB1_1501 | 218 MTVAGVVLLGSLFSR | VVLLGSLFS | 0.6441 | 47 | SB | BclX(L) |
| DRB1_1501 | 6 RELVVDFLSYKLSQK | LVVDFLSYK | 0.5208 | 179 | WB | BclX(L) |
| DRB1_1501 | 7 ELVVDFLSYKLSQKG | FLSYKLSQK | 0.5009 | 221 | WB | BclX(L) |
| DRB1_1501 | 157 KEMQVLVSRIAAWMA | MQVLVSRIA | 0.4968 | 231 | WB | BclX(L) |
| DRB1_1501 | 156 DKEMQVLVSRIAAWM | MQVLVSRIA | 0.4965 | 232 | WB | BclX(L) |
| DRB1_1501 | 209 RFNRWFLTGMTVAGV | FNRWFLTGM | 0.4870 | 257 | WB | BclX(L) |
| DRB1_1501 | 164 SRIAAWMATYLNDHL | WMATYLNDH | 0.4849 | 263 | WB | BclX(L) |
| DRB1_1501 | 210 FNRWFLTGMTVAGVV | LTGMTVAGV | 0.4836 | 267 | WB | BclX(L) |
| DRB1_1501 | 8 LVVDFLSYKLSQKGY | FLSYKLSQK | 0.4778 | 284 | WB | BclX(L) |
| DRB1_1501 | 5 NRELVVDFLSYKLSQ | LVVDFLSYK | 0.4777 | 285 | WB | BclX(L) |
| DRB1_1501 | 135 VNWGRIVAFFSFGGA | IVAFFSFGG | 0.4756 | 291 | WB | BclX(L) |

TABLE D-continued

Prediction of cancer antigen BclX(L) specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_1501 | 4 SNRELVVDFL-SYKLS | LVVDFLSYK | 0.4755 | 291 | WB | BclX(L) |
| DRB1_1501 | 159 MQVLVSRIAAW-MATY | LVSRIAAWM | 0.4693 | 312 | WB | BclX(L) |
| DRB1_1501 | 163 VSRIAAW-MATYLNDH | IAAWMATYL | 0.4691 | 312 | WB | BclX(L) |
| DRB1_1501 | 158 EMQVLVSRIAAW-MAT | VLVSRIAAW | 0.4683 | 315 | WB | BclX(L) |
| DRB1_1501 | 165 RIAAWMATYLND-HLE | WMATYLNDH | 0.4685 | 315 | WB | BclX(L) |
| DRB1_1501 | 128 NELFRDGVN-WGRIVA | LFRDGVNWG | 0.4675 | 318 | WB | BclX(L) |
| DRB1_1501 | 125 QVVNELFRDGVN-WGR | LFRDGVNWG | 0.4668 | 320 | WB | BclX(L) |
| DRB1_1501 | 126 VVNELFRDGVN-WGRI | LFRDGVNWG | 0.4668 | 320 | WB | BclX(L) |
| DRB1_1501 | 166 IAAWMATYLNDH-LEP | WMATYLNDH | 0.4649 | 327 | WB | BclX(L) |
| DRB1_1501 | 137 WGRIVAFFSFG-GALC | IVAFFSFGG | 0.4643 | 329 | WB | BclX(L) |
| DRB1_1501 | 136 NWGRIVAFFSFG-GAL | IVAFFSFGG | 0.4638 | 331 | WB | BclX(L) |
| DRB1_1501 | 207 QERFNRWFLTG-MTVA | FNRWFLTGM | 0.4608 | 342 | WB | BclX(L) |
| DRB1_1501 | 208 ERFNRWFLTGMT-VAG | FNRWFLTGM | 0.4602 | 344 | WB | BclX(L) |
| DRB1_1501 | 138 GRIVAFFSFG-GALCV | IVAFFSFGG | 0.4587 | 350 | WB | BclX(L) |
| DRB1_1501 | 9 VVDFLSYKLSQK-GYS | FLSYKLSQK | 0.4584 | 351 | WB | BclX(L) |
| DRB1_1501 | 155 VDKEMQVLVSRI-AAW | MQVLVSRIA | 0.4570 | 356 | WB | BclX(L) |
| DRB1_1501 | 167 AAWMATYLND-HLEPW | WMATYLNDH | 0.4551 | 364 | WB | BclX(L) |
| DRB1_1501 | 3 QSNRELVVDFL-SYKL | LVVDFLSYK | 0.4543 | 367 | WB | BclX(L) |
| DRB1_1501 | 127 VNELFRDGVN-WGRIV | LFRDGVNWG | 0.4431 | 414 | WB | BclX(L) |
| DRB1_1501 | 134 GVN-WGRIVAFFSFGG | VNWGRIVAF | 0.4391 | 432 | WB | BclX(L) |
| DRB1_1501 | 129 ELFRDGVN-WGRIVAF | LFRDGVNWG | 0.4390 | 433 | WB | BclX(L) |
| DRB1_1501 | 217 GMTVAGVVLLG-SLFS | VAGVVLLGS | 0.4377 | 439 | WB | BclX(L) |
| DRB1_1501 | 124 EQVVNEL-FRDGVNWG | VVNELFRDG | 0.4373 | 441 | WB | BclX(L) |
| DRB1_1501 | 139 RIVAFFSFGGAL-CVE | IVAFFSFGG | 0.4300 | 477 | WB | BclX(L) |
| DRB1_1501 | 211 NRWFLTGMT-VAGVVL | LTGMTVAGV | 0.4264 | 496 | WB | BclX(L) |
| DRB4_0101 | 99 LRYRRAF-SDLTSQLH | YRRAFSDLT | 0.4654 | 325 | WB | BclX(L) |
| DRB4_0101 | 100 RYRRAF-SDLTSQLHI | FSDLTSQLH | 0.4328 | 463 | WB | BclX(L) |

SEQ ID NOS: 47134-47645

Preferred fragments of Bcl-2 capable of interacting with one or more MHC class 2 molecules are listed in table E.

TABLE E

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0101 | 211 DFSWLSLK-TLLSLAL | WLSLKTLLS | 0.8912 | 3 | SB | Bcl-2 |
| DRB1_0101 | 212 FSWLSLK-TLLSLALV | LKTLLSLAL | 0.8917 | 3 | SB | Bcl-2 |

TABLE E-continued

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | affinity 1-log50k(aff) | (nM) | Bind Level | Identity |
|---|---|---|---|---|---|---|
| DRB1_0101 | 214 WLSLKTLLSLA-LVGA | LKTLLSLAL | 0.8933 | 3 | SB | Bcl-2 |
| DRB1_0101 | 215 LSLKTLLSLALV-GAC | LKTLLSLAL | 0.8867 | 3 | SB | Bcl-2 |
| DRB1_0101 | 213 SWLSLKTLLSLA-LVG | LKTLLSLAL | 0.8776 | 4 | SB | Bcl-2 |
| DRB1_0101 | 216 SLKTLLSLALV-GACI | LKTLLSLAL | 0.8024 | 8 | SB | Bcl-2 |
| DRB1_0101 | 217 LKTLLSLALV-GACIT | LKTLLSLAL | 0.8038 | 8 | SB | Bcl-2 |
| DRB1_0101 | 68 RTSPLQTPAAP-GAAA | LQTPAAPGA | 0.7623 | 13 | SB | Bcl-2 |
| DRB1_0101 | 69 TSPLQTPAAP-GAAAG | LQTPAAPGA | 0.7650 | 13 | SB | Bcl-2 |
| DRB1_0101 | 70 SPLQTPAAP-GAAAGP | LQTPAAPGA | 0.7631 | 13 | SB | Bcl-2 |
| DRB1_0101 | 66 VARTSPLQT-PAAPGA | TSPLQTPAA | 0.7565 | 14 | SB | Bcl-2 |
| DRB1_0101 | 67 ARTSPLQTPAAP-GAA | LQTPAAPGA | 0.7584 | 14 | SB | Bcl-2 |
| DRB1_0101 | 209 LFDFSWLSLK-TLLSL | WLSLKTLLS | 0.7419 | 16 | SB | Bcl-2 |
| DRB1_0101 | 208 PLFDFSWLSLK-TLLS | FSWLSLKTL | 0.7389 | 17 | SB | Bcl-2 |
| DRB1_0101 | 210 FDFSWLSLK-TLLSLA | WLSLKTLLS | 0.7403 | 17 | SB | Bcl-2 |
| DRB1_0101 | 219 TLLSLALVGAC-ITLG | LLSLALVGA | 0.7270 | 19 | SB | Bcl-2 |
| DRB1_0101 | 220 LLSLALVGAC-ITLGA | LVGACITLG | 0.7299 | 19 | SB | Bcl-2 |
| DRB1_0101 | 223 LALVGACITL-GAYLG | LVGACITLG | 0.7079 | 24 | SB | Bcl-2 |
| DRB1_0101 | 221 LSLALVGACITL-GAY | LVGACITLG | 0.7021 | 25 | SB | Bcl-2 |
| DRB1_0101 | 222 SLALVGACITL-GAYL | LVGACITLG | 0.7016 | 25 | SB | Bcl-2 |
| DRB1_0101 | 106 RRYRRD-FAEMSSQLH | YRRDFAEMS | 0.6774 | 33 | SB | Bcl-2 |
| DRB1_0101 | 72 LQTPAAP-GAAAGPAL | LQTPAAPGA | 0.6778 | 33 | SB | Bcl-2 |
| DRB1_0101 | 71 PLQTPAAP-GAAAGPA | LQTPAAPGA | 0.6750 | 34 | SB | Bcl-2 |
| DRB1_0101 | 108 YRRDFAEMSSQL-HLT | FAEMSSQLH | 0.6686 | 36 | SB | Bcl-2 |
| DRB1_0101 | 107 RYRRD-FAEMSSQLHL | FAEMSSQLH | 0.6670 | 37 | SB | Bcl-2 |
| DRB1_0101 | 218 KTLLSLALVGAC-ITL | LLSLALVGA | 0.6642 | 38 | SB | Bcl-2 |
| DRB1_0101 | 109 RRDFAEMSSQL-HLTP | FAEMSSQLH | 0.6615 | 39 | SB | Bcl-2 |
| DRB1_0101 | 110 RDFAEMSSQL-HLTPF | FAEMSSQLH | 0.6572 | 41 | SB | Bcl-2 |
| DRB1_0101 | 31 DAGDVGAAPP-GAAPA | VGAAPPGAA | 0.6561 | 41 | SB | Bcl-2 |
| DRB1_0101 | 32 AGDVGAAPPGAA-PAP | VGAAPPGAA | 0.6565 | 41 | SB | Bcl-2 |
| DRB1_0101 | 29 EWDAGDVGAAPP-GAA | DVGAAPPGA | 0.6512 | 44 | SB | Bcl-2 |
| DRB1_0101 | 30 WDAGDVGAAPP-GAAP | VGAAPPGAA | 0.6504 | 44 | SB | Bcl-2 |
| DRB1_0101 | 33 GDVGAAPPGAA-PAPG | VGAAPPGAA | 0.6438 | 47 | SB | Bcl-2 |
| DRB1_0101 | 207 RPLFDFSWLSLK-TLL | FSWLSLKTL | 0.6332 | 53 | WB | Bcl-2 |
| DRB1_0101 | 224 ALVGACITLGAY-LGH | LVGACITLG | 0.6316 | 54 | WB | Bcl-2 |
| DRB1_0101 | 206 MRPLFDF-SWLSLKTL | DFSWLSLKT | 0.6303 | 55 | WB | Bcl-2 |
| DRB1_0101 | 225 LVGACITLGAYL-GHK | LVGACITLG | 0.6212 | 60 | WB | Bcl-2 |
| DRB1_0101 | 13 EIVMKYI-HYKLSQRG | MKYIHYKLS | 0.6124 | 66 | WB | Bcl-2 |
| DRB1_0101 | 14 IVMKYI-HYKLSQRGY | IHYKLSQRG | 0.6114 | 67 | WB | Bcl-2 |
| DRB1_0101 | 15 VMKYIHYKLSQR-GYE | IHYKLSQRG | 0.6087 | 69 | WB | Bcl-2 |
| DRB1_0101 | 16 MKYIHYKLSQR-GYEW | IHYKLSQRG | 0.6059 | 71 | WB | Bcl-2 |

TABLE E-continued

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | affinity 1-log50k(aff) | (nM) | Bind Level | Identity |
|---|---|---|---|---|---|---|
| DRB1_0101 | 17 KYIHYKLSQR-GYEWD | IHYKLSQRG | 0.6042 | 72 | WB | Bcl-2 |
| DRB1_0101 | 164 REMSPLVDNIAL-WMT | LVDNIALWM | 0.5967 | 79 | WB | Bcl-2 |
| DRB1_0101 | 165 EMSPLVDNIALW-MTE | VDNIALWMT | 0.5914 | 83 | WB | Bcl-2 |
| DRB1_0101 | 167 SPLVDNIALW-MTEYL | VDNIALWMT | 0.5912 | 83 | WB | Bcl-2 |
| DRB1_0101 | 166 MSPLVDNIALW-MTEY | VDNIALWMT | 0.5908 | 84 | WB | Bcl-2 |
| DRB1_0101 | 63 RDPVARTSPLQT-PAA | VARTSPLQT | 0.5908 | 84 | WB | Bcl-2 |
| DRB1_0101 | 64 DPVARTSPLQT-PAAP | VARTSPLQT | 0.5876 | 87 | WB | Bcl-2 |
| DRB1_0101 | 168 PLVDNIALW-MTEYLN | VDNIALWMT | 0.5794 | 95 | WB | Bcl-2 |
| DRB1_0101 | 196 DAFVELYGPSMR-PLF | FVELYGPSM | 0.5684 | 107 | WB | Bcl-2 |
| DRB1_0101 | 34 DVGAAPPGAA-PAPGI | VGAAPPGAA | 0.5672 | 108 | WB | Bcl-2 |
| DRB1_0101 | 62 SRDP-VARTSPLQTPA | VARTSPLQT | 0.5669 | 108 | WB | Bcl-2 |
| DRB1_0101 | 195 WDAFVELYGPSM-RPL | FVELYGPSM | 0.5666 | 109 | WB | Bcl-2 |
| DRB1_0101 | 61 ASRDP-VARTSPLQTP | VARTSPLQT | 0.5637 | 112 | WB | Bcl-2 |
| DRB1_0101 | 86 LSPVPPVVHLTL-RQA | LSPVPPVVH | 0.5639 | 112 | WB | Bcl-2 |
| DRB1_0101 | 111 DFAEMSSQLHLT-PFT | FAEMSSQLH | 0.5615 | 115 | WB | Bcl-2 |
| DRB1_0101 | 89 VPPVVHLTL-RQAGDD | VVHLTLRQA | 0.5593 | 118 | WB | Bcl-2 |
| DRB1_0101 | 87 SPVPPVVHLTL-RQAG | VVHLTLRQA | 0.5579 | 119 | WB | Bcl-2 |
| DRB1_0101 | 88 PVPPVVHLTL-RQAGD | VVHLTLRQA | 0.5581 | 119 | WB | Bcl-2 |
| DRB1_0101 | 112 FAEMSSQLHLTP-FTA | FAEMSSQLH | 0.5577 | 120 | WB | Bcl-2 |
| DRB1_0101 | 35 VGAAPPGAAPAP-GIF | VGAAPPGAA | 0.5569 | 121 | WB | Bcl-2 |
| DRB1_0101 | 90 PPVVHLTL-RQAGDDF | VVHLTLRQA | 0.5563 | 122 | WB | Bcl-2 |
| DRB1_0101 | 80 AAAGPALSPVP-PVVH | AAAGPALSP | 0.5545 | 124 | WB | Bcl-2 |
| DRB1_0101 | 160 ESVNREMSPLVD-NIA | VNREMSPLV | 0.5523 | 127 | WB | Bcl-2 |
| DRB1_0101 | 60 AASRDP-VARTSPLQT | SRDPVARTS | 0.5524 | 127 | WB | Bcl-2 |
| DRB1_0101 | 117 SQLHLTPFTAR-GRFA | LTPFTARGR | 0.5480 | 133 | WB | Bcl-2 |
| DRB1_0101 | 115 MSSQLHLTPF-TARGR | LHLTPFTAR | 0.5456 | 137 | WB | Bcl-2 |
| DRB1_0101 | 116 SSQLHLTPFTAR-GRF | LTPFTARGR | 0.5418 | 142 | WB | Bcl-2 |
| DRB1_0101 | 81 AAGPALSPVPPV-VHL | LSPVPPVVH | 0.5390 | 147 | WB | Bcl-2 |
| DRB1_0101 | 118 QLHLTPFTARGR-FAT | LTPFTARGR | 0.5379 | 148 | WB | Bcl-2 |
| DRB1_0101 | 197 AFVELYGPSMR-PLFD | LYGPSMRPL | 0.5381 | 148 | WB | Bcl-2 |
| DRB1_0101 | 156 VMCVESVNREM-SPLV | VMCVESVNR | 0.5366 | 151 | WB | Bcl-2 |
| DRB1_0101 | 158 CVESVNREM-SPLVDN | VNREMSPLV | 0.5360 | 151 | WB | Bcl-2 |
| DRB1_0101 | 159 VESVNREM-SPLVDNI | VNREMSPLV | 0.5364 | 151 | WB | Bcl-2 |
| DRB1_0101 | 198 FVELYGPSMR-PLFDF | LYGPSMRPL | 0.5345 | 154 | WB | Bcl-2 |
| DRB1_0101 | 157 MCVESVNREM-SPLVD | VNREMSPLV | 0.5315 | 159 | WB | Bcl-2 |
| DRB1_0101 | 119 LHLTPFTARGR-FATV | LTPFTARGR | 0.5307 | 160 | WB | Bcl-2 |
| DRB1_0101 | 82 AGPALSPVPPV-VHLT | LSPVPPVVH | 0.5312 | 160 | WB | Bcl-2 |
| DRB1_0101 | 83 GPALSPVPPV-VHLTL | LSPVPPVVH | 0.5307 | 160 | WB | Bcl-2 |
| DRB1_0101 | 148 VAFFEFGGVM-CVESV | FEFGGVMCV | 0.5291 | 163 | WB | Bcl-2 |

TABLE E-continued

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0101 | 149 AFFEFGGVMCVESVN | FEFGGVMCV | 0.5288 | 164 | WB | Bcl-2 |
| DRB1_0101 | 46 PGIFSSQPGHTPHPA | FSSQPGHTP | 0.5270 | 167 | WB | Bcl-2 |
| DRB1_0101 | 170 VDNIALWMTEYLNRH | VDNIALWMT | 0.5265 | 168 | WB | Bcl-2 |
| DRB1_0101 | 43 APAPGIFSSQPGHTP | IFSSQPGHT | 0.5223 | 176 | WB | Bcl-2 |
| DRB1_0101 | 84 PALSPVPPVVHLTLR | LSPVPPVVH | 0.5195 | 181 | WB | Bcl-2 |
| DRB1_0101 | 147 IVAFFEFGGVMCVES | FEFGGVMCV | 0.5190 | 182 | WB | Bcl-2 |
| DRB1_0101 | 65 PVARTSPLQTPAAPG | VARTSPLQT | 0.5190 | 182 | WB | Bcl-2 |
| DRB1_0101 | 45 APGIFSSQPGHTPHP | FSSQPGHTP | 0.5186 | 183 | WB | Bcl-2 |
| DRB1_0101 | 120 HLTPFTARGRFATVV | LTPFTARGR | 0.5178 | 184 | WB | Bcl-2 |
| DRB1_0101 | 121 LTPFTARGRFATVVE | ARGRFATVV | 0.5182 | 184 | WB | Bcl-2 |
| DRB1_0101 | 136 ELFRDGVNWGRIVAF | FRDGVNWGR | 0.5154 | 189 | WB | Bcl-2 |
| DRB1_0101 | 44 PAPGIFSSQPGHTPH | FSSQPGHTP | 0.5142 | 192 | WB | Bcl-2 |
| DRB1_0101 | 138 FRDGVNWGRIVAFFE | VNWGRIVAF | 0.5122 | 196 | WB | Bcl-2 |
| DRB1_0101 | 169 LVDNIALWMTEYLNR | VDNIALWMT | 0.5062 | 209 | WB | Bcl-2 |
| DRB1_0101 | 18 YIHYKLSQRGYEWDA | IHYKLSQRG | 0.5057 | 210 | WB | Bcl-2 |
| DRB1_0101 | 137 LFRDGVNWGRIVAFF | VNWGRIVAF | 0.5023 | 218 | WB | Bcl-2 |
| DRB1_0101 | 19 IHYKLSQRGYEWDAG | IHYKLSQRG | 0.5022 | 218 | WB | Bcl-2 |
| DRB1_0101 | 47 GIFSSQPGHTPHPAA | FSSQPGHTP | 0.5023 | 218 | WB | Bcl-2 |
| DRB1_0101 | 76 AAPGAAAGPALSPVP | AAAGPALSP | 0.5005 | 222 | WB | Bcl-2 |
| DRB1_0101 | 139 RDGVNWGRIVAFFEF | VNWGRIVAF | 0.4998 | 224 | WB | Bcl-2 |
| DRB1_0101 | 74 TPAAPGAAAGPALSP | GAAAGPALS | 0.4991 | 226 | WB | Bcl-2 |
| DRB1_0101 | 194 GWDAFVELYGPSMRP | FVELYGPSM | 0.4987 | 227 | WB | Bcl-2 |
| DRB1_0101 | 75 PAAPGAAAGPALSPV | AAAGPALSP | 0.4981 | 228 | WB | Bcl-2 |
| DRB1_0101 | 77 APGAAAGPALSPVPP | AAAGPALSP | 0.4980 | 229 | WB | Bcl-2 |
| DRB1_0101 | 140 DGVNWGRIVAFFEFG | VNWGRIVAF | 0.4959 | 234 | WB | Bcl-2 |
| DRB1_0101 | 105 SRRYRRDFAEMSSQL | YRRDFAEMS | 0.4945 | 237 | WB | Bcl-2 |
| DRB1_0101 | 91 PVVHLTLRQAGDDFS | VVHLTLRQA | 0.4935 | 240 | WB | Bcl-2 |
| DRB1_0101 | 199 VELYGPSMRPLFDFS | LYGPSMRPL | 0.4895 | 251 | WB | Bcl-2 |
| DRB1_0101 | 92 VVHLTLRQAGDDFSR | VVHLTLRQA | 0.4870 | 257 | WB | Bcl-2 |
| DRB1_0101 | 104 FSRRYRRDFAEMSSQ | YRRDFAEMS | 0.4851 | 263 | WB | Bcl-2 |
| DRB1_0101 | 103 DFSRRYRRDFAEMSS | YRRDFAEMS | 0.4834 | 268 | WB | Bcl-2 |
| DRB1_0101 | 102 DDFSRRYRRDFAEMS | RYRRDFAEM | 0.4800 | 278 | WB | Bcl-2 |
| DRB1_0101 | 145 GRIVAFFEFGGVMCV | FFEFGGVMC | 0.4796 | 279 | WB | Bcl-2 |
| DRB1_0101 | 146 RIVAFFEFGGVMCVE | FEFGGVMCV | 0.4791 | 280 | WB | Bcl-2 |
| DRB1_0101 | 78 PGAAAGPALSPVPPV | AAAGPALSP | 0.4771 | 286 | WB | Bcl-2 |
| DRB1_0101 | 161 SVNREMSPLVDNIAL | VNREMSPLV | 0.4763 | 289 | WB | Bcl-2 |
| DRB1_0101 | 150 FFEFGGVMCVESVNR | FEFGGVMCV | 0.4737 | 297 | WB | Bcl-2 |
| DRB1_0101 | 162 VNREMSPLVDNIALW | VNREMSPLV | 0.4734 | 298 | WB | Bcl-2 |
| DRB1_0101 | 151 FEFGGVMCVESVNRE | FEFGGVMCV | 0.4731 | 299 | WB | Bcl-2 |

TABLE E-continued

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | affinity 1-log50k(aff) | (nM) | Bind Level | Identity |
|---|---|---|---|---|---|---|
| DRB1_0101 | 114 EMSSQLHLTPF-TARG | LHLTPFTAR | 0.4711 | 306 | WB | Bcl-2 |
| DRB1_0101 | 122 TPFTARGRFATV-VEE | ARGRFATVV | 0.4638 | 331 | WB | Bcl-2 |
| DRB1_0101 | 73 QTPAAPGAAAG-PALS | APGAAAGPA | 0.4635 | 332 | WB | Bcl-2 |
| DRB1_0101 | 49 FSSQPGHTPH-PAASR | FSSQPGHTP | 0.4615 | 339 | WB | Bcl-2 |
| DRB1_0101 | 48 IFSSQPGHTPH-PAAS | FSSQPGHTP | 0.4531 | 371 | WB | Bcl-2 |
| DRB1_0101 | 36 GAAPPGAAPAP-GIFS | PGAAPAPGI | 0.4518 | 376 | WB | Bcl-2 |
| DRB1_0101 | 123 PFTARGRFATV-VEEL | ARGRFATVV | 0.4516 | 377 | WB | Bcl-2 |
| DRB1_0101 | 124 FTARGRFATV-VEELF | ARGRFATVV | 0.4490 | 388 | WB | Bcl-2 |
| DRB1_0101 | 174 ALWMTEYLN-RHLHTW | WMTEYLNRH | 0.4444 | 408 | WB | Bcl-2 |
| DRB1_0101 | 85 ALSPVPPV-VHLTLRQ | LSPVPPVVH | 0.4436 | 411 | WB | Bcl-2 |
| DRB1_0101 | 113 AEMSSQLHLTPF-TAR | SQLHLTPFT | 0.4430 | 414 | WB | Bcl-2 |
| DRB1_0101 | 171 DNIALWMTEYLN-RHL | WMTEYLNRH | 0.4414 | 421 | WB | Bcl-2 |
| DRB1_0101 | 193 GGWDAFVE-LYGPSMR | FVELYGPSM | 0.4396 | 430 | WB | Bcl-2 |
| DRB1_0101 | 200 ELYGPSMRPLFD-FSW | LYGPSMRPL | 0.4395 | 430 | WB | Bcl-2 |
| DRB1_0101 | 37 AAPPGAAPAP-GIFSS | AAPAPGIFS | 0.4393 | 431 | WB | Bcl-2 |
| DRB1_0101 | 79 GAAAGPALSPVP-PVV | AAAGPALSP | 0.4394 | 431 | WB | Bcl-2 |
| DRB1_0101 | 172 NIALWMTEYLN-RHLH | WMTEYLNRH | 0.4279 | 488 | WB | Bcl-2 |
| DRB1_0101 | 28 YEWDAGDVGAAP-PGA | WDAGDVGAA | 0.4274 | 490 | WB | Bcl-2 |
| DRB1_0101 | 42 AAPAPGIF-SSQPGHT | AAPAPGIFS | 0.4268 | 494 | WB | Bcl-2 |
| DRB1_0101 | 163 NREMSPLVD-NIALWM | MSPLVDNIA | 0.4266 | 495 | WB | Bcl-2 |
| DRB1_0401 | 208 PLFDFSWLSLK-TLLS | DFSWLSLKT | 0.5448 | 138 | WB | Bcl-2 |
| DRB1_0401 | 211 DFSWLSLK-TLLSLAL | WLSLKTLLS | 0.5436 | 139 | WB | Bcl-2 |
| DRB1_0401 | 212 FSWLSLK-TLLSLALV | WLSLKTLLS | 0.5395 | 146 | WB | Bcl-2 |
| DRB1_0401 | 209 LFDFSWLSLK-TLLSL | WLSLKTLLS | 0.5358 | 152 | WB | Bcl-2 |
| DRB1_0401 | 210 FDFSWLSLK-TLLSLA | WLSLKTLLS | 0.5305 | 161 | WB | Bcl-2 |
| DRB1_0401 | 156 VMCVESVNREM-SPLV | MCVESVNRE | 0.4924 | 243 | WB | Bcl-2 |
| DRB1_0401 | 158 CVESVNREM-SPLVDN | VNREMSPLV | 0.4915 | 245 | WB | Bcl-2 |
| DRB1_0401 | 157 MCVESVNREM-SPLVD | VNREMSPLV | 0.4907 | 247 | WB | Bcl-2 |
| DRB1_0401 | 160 ESVNREMSPLVD-NIA | VNREMSPLV | 0.4909 | 247 | WB | Bcl-2 |
| DRB1_0401 | 159 VESVNREM-SPLVDNI | VNREMSPLV | 0.4870 | 257 | WB | Bcl-2 |
| DRB1_0401 | 214 WLSLKTLLSLA-LVGA | WLSLKTLLS | 0.4662 | 322 | WB | Bcl-2 |
| DRB1_0401 | 213 SWLSLKTLLSLA-LVG | WLSLKTLLS | 0.4661 | 323 | WB | Bcl-2 |
| DRB1_0401 | 106 RRYRRD-FAEMSSQLH | YRRDFAEMS | 0.4563 | 359 | WB | Bcl-2 |
| DRB1_0401 | 170 VDNIALWMTEYL-NRH | NIALWMTEY | 0.4319 | 467 | WB | Bcl-2 |
| DRB1_0404 | 174 ALWMTEYLN-RHLHTW | WMTEYLNRH | 0.5813 | 93 | WB | Bcl-2 |
| DRB1_0404 | 170 VDNIALWMTEYL-NRH | IALWMTEYL | 0.5418 | 142 | WB | Bcl-2 |
| DRB1_0404 | 171 DNIALWMTEYLN-RHL | WMTEYLNRH | 0.5422 | 142 | WB | Bcl-2 |
| DRB1_0404 | 172 NIALWMTEYLN-RHLH | WMTEYLNRH | 0.5371 | 150 | WB | Bcl-2 |

TABLE E-continued

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0404 | 173 IALWMTEYLNRHLHT | WMTEYLNRH | 0.5341 | 155 | WB | Bcl-2 |
| DRB1_0404 | 175 LWMTEYLNRHLHTWI | WMTEYLNRH | 0.5171 | 186 | WB | Bcl-2 |
| DRB1_0404 | 115 MSSQLHLTPFTARGR | HLTPFTARG | 0.5121 | 196 | WB | Bcl-2 |
| DRB1_0404 | 114 EMSSQLHLTPFTARG | LHLTPFTAR | 0.5118 | 197 | WB | Bcl-2 |
| DRB1_0404 | 176 WMTEYLNRHLHTWIQ | WMTEYLNRH | 0.5110 | 199 | WB | Bcl-2 |
| DRB1_0404 | 116 SSQLHLTPFTARGRF | HLTPFTARG | 0.5043 | 213 | WB | Bcl-2 |
| DRB1_0404 | 117 SQLHLTPFTARGRFA | HLTPFTARG | 0.5004 | 223 | WB | Bcl-2 |
| DRB1_0404 | 118 QLHLTPFTARGRFAT | HLTPFTARG | 0.4918 | 244 | WB | Bcl-2 |
| DRB1_0404 | 45 APGIFSSQPGHTPHP | FSSQPGHTP | 0.4688 | 313 | WB | Bcl-2 |
| DRB1_0404 | 46 PGIFSSQPGHTPHPA | FSSQPGHTP | 0.4665 | 321 | WB | Bcl-2 |
| DRB1_0404 | 47 GIFSSQPGHTPHPAA | SQPGHTPHP | 0.4485 | 390 | WB | Bcl-2 |
| DRB1_0404 | 109 RRDFAEMSSQLHLTP | FAEMSSQLH | 0.4422 | 418 | WB | Bcl-2 |
| DRB1_0404 | 210 FDFSWLSLKTLLSLA | WLSLKTLLS | 0.4405 | 426 | WB | Bcl-2 |
| DRB1_0404 | 110 RDFAEMSSQLHLTPF | FAEMSSQLH | 0.4393 | 431 | WB | Bcl-2 |
| DRB1_0404 | 211 DFSWLSLKTLLSLAL | WLSLKTLLS | 0.4316 | 469 | WB | Bcl-2 |
| DRB1_0404 | 212 FSWLSLKTLLSLALV | WLSLKTLLS | 0.4313 | 470 | WB | Bcl-2 |
| DRB1_0405 | 208 PLFDFSWLSLKTLLS | FSWLSLKTL | 0.6517 | 43 | SB | Bcl-2 |
| DRB1_0405 | 209 LFDFSWLSLKTLLSL | WLSLKTLLS | 0.6415 | 48 | SB | Bcl-2 |
| DRB1_0405 | 210 FDFSWLSLKTLLSLA | WLSLKTLLS | 0.6398 | 49 | SB | Bcl-2 |
| DRB1_0405 | 211 DFSWLSLKTLLSLAL | WLSLKTLLS | 0.6392 | 50 | WB | Bcl-2 |
| DRB1_0405 | 212 FSWLSLKTLLSLALV | WLSLKTLLS | 0.6381 | 50 | WB | Bcl-2 |
| DRB1_0405 | 213 SWLSLKTLLSLALVG | WLSLKTLLS | 0.5584 | 119 | WB | Bcl-2 |
| DRB1_0405 | 214 WLSLKTLLSLALVGA | WLSLKTLLS | 0.5575 | 120 | WB | Bcl-2 |
| DRB1_0405 | 160 ESVNREMSPLVDNIA | NREMSPLVD | 0.5021 | 219 | WB | Bcl-2 |
| DRB1_0405 | 158 CVESVNREMSPLVDN | NREMSPLVD | 0.4974 | 230 | WB | Bcl-2 |
| DRB1_0405 | 159 VESVNREMSPLVDNI | NREMSPLVD | 0.4930 | 241 | WB | Bcl-2 |
| DRB1_0405 | 170 VDNIALWMTEYLNRH | IALWMTEYL | 0.4903 | 248 | WB | Bcl-2 |
| DRB1_0405 | 168 PLVDNIALWMTEYLN | IALWMTEYL | 0.4841 | 266 | WB | Bcl-2 |
| DRB1_0405 | 171 DNIALWMTEYLNRHL | IALWMTEYL | 0.4841 | 266 | WB | Bcl-2 |
| DRB1_0405 | 169 LVDNIALWMTEYLNR | IALWMTEYL | 0.4812 | 274 | WB | Bcl-2 |
| DRB1_0405 | 157 MCVESVNREMSPLVD | VNREMSPLV | 0.4756 | 291 | WB | Bcl-2 |
| DRB1_0405 | 167 SPLVDNIALWMTEYL | NIALWMTEY | 0.4744 | 295 | WB | Bcl-2 |
| DRB1_0405 | 161 SVNREMSPLVDNIAL | NREMSPLVD | 0.4718 | 303 | WB | Bcl-2 |
| DRB1_0405 | 106 RRYRRDFAEMSSQLH | YRRDFAEMS | 0.4486 | 390 | WB | Bcl-2 |
| DRB1_0405 | 162 VNREMSPLVDNIALW | NREMSPLVD | 0.4294 | 480 | WB | Bcl-2 |
| DRB1_0701 | 83 GPALSPVPPVVHLTL | LSPVPPVVH | 0.5316 | 159 | WB | Bcl-2 |
| DRB1_0701 | 82 AGPALSPVPPVVHLT | LSPVPPVVH | 0.5286 | 164 | WB | Bcl-2 |
| DRB1_0701 | 81 AAGPALSPVPPVVHL | LSPVPPVVH | 0.5256 | 169 | WB | Bcl-2 |

TABLE E-continued

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_0701 | 84 PALSPVPPV-VHLTLR | LSPVPPVH | 0.5210 | 178 | WB | Bcl-2 |
| DRB1_0701 | 80 AAAGPALSPVP-PVVH | ALSPVPVV | 0.5179 | 184 | WB | Bcl-2 |
| DRB1_0701 | 85 ALSPVPPV-VHLTLRQ | LSPVPPVH | 0.4370 | 442 | WB | Bcl-2 |
| DRB1_0701 | 86 LSPVPPVVHLTL-RQA | LSPVPPVH | 0.4291 | 482 | WB | Bcl-2 |
| DRB1_0901 | 196 DAFVELYGPSMR-PLF | VELYGPSMR | 0.4599 | 345 | WB | Bcl-2 |
| DRB1_0901 | 197 AFVELYGPSMR-PLFD | YGPSMRPLF | 0.4582 | 352 | WB | Bcl-2 |
| DRB1_0901 | 198 FVELYGPSMR-PLFDF | YGPSMRPLF | 0.4429 | 415 | WB | Bcl-2 |
| DRB1_0901 | 199 VELYGPSMR-PLFDFS | YGPSMRPLF | 0.4428 | 415 | WB | Bcl-2 |
| DRB1_1302 | 212 FSWLSLK-TLLSLALV | WLSLKTLLS | 0.5351 | 153 | WB | Bcl-2 |
| DRB1_1302 | 211 DFSWLSLK-TLLSLAL | WLSLKTLLS | 0.5323 | 158 | WB | Bcl-2 |
| DRB1_1302 | 209 LFDFSWLSLK-TLLSL | WLSLKTLLS | 0.4963 | 233 | WB | Bcl-2 |
| DRB1_1302 | 210 FDFSWLSLK-TLLSLA | WLSLKTLLS | 0.4951 | 236 | WB | Bcl-2 |
| DRB1_1302 | 208 PLFDFSWLSLK-TLLS | FSWLSLKTL | 0.4783 | 283 | WB | Bcl-2 |
| DRB1_1302 | 213 SWLSLKTLLSLA-LVG | WLSLKTLLS | 0.4770 | 287 | WB | Bcl-2 |
| DRB1_1302 | 214 WLSLKTLLSLA-LVGA | WLSLKTLLS | 0.4769 | 287 | WB | Bcl-2 |
| DRB1_1302 | 196 DAFVELYGPSMR-PLF | VELYGPSMR | 0.4640 | 330 | WB | Bcl-2 |
| DRB1_1302 | 197 AFVELYGPSMR-PLFD | VELYGPSMR | 0.4607 | 342 | WB | Bcl-2 |
| DRB1_1302 | 167 SPLVDNIALW-MTEYL | VDNIALWMT | 0.4494 | 387 | WB | Bcl-2 |
| DRB1_1302 | 168 PLVDNIALW-MTEYLN | VDNIALWMT | 0.4385 | 435 | WB | Bcl-2 |
| DRB1_1501 | 13 EIVMKYI-HYKLSQRG | YIHYKLSQR | 0.6338 | 53 | WB | Bcl-2 |
| DRB1_1501 | 14 IVMKYI-HYKLSQRGY | YIHYKLSQR | 0.6318 | 54 | WB | Bcl-2 |
| DRB1_1501 | 15 VMKYIHYKLSQR-GYE | YIHYKLSQR | 0.6170 | 63 | WB | Bcl-2 |
| DRB1_1501 | 16 MKYIHYKLSQR-GYEW | YIHYKLSQR | 0.6121 | 66 | WB | Bcl-2 |
| DRB1_1501 | 12 REIVMKYI-HYKLSQR | IVMKYIHYK | 0.6057 | 71 | WB | Bcl-2 |
| DRB1_1501 | 17 KYIHYKLSQR-GYEWD | YIHYKLSQR | 0.5372 | 150 | WB | Bcl-2 |
| DRB1_1501 | 115 MSSQLHLTPF-TARGR | LHLTPFTAR | 0.5174 | 185 | WB | Bcl-2 |
| DRB1_1501 | 116 SSQLHLTPFTAR-GRF | LHLTPFTAR | 0.5162 | 188 | WB | Bcl-2 |
| DRB1_1501 | 18 YIHYKLSQR-GYEWDA | YIHYKLSQR | 0.5136 | 193 | WB | Bcl-2 |
| DRB1_1501 | 117 SQLHLTPFTAR-GRFA | LHLTPFTAR | 0.5054 | 211 | WB | Bcl-2 |
| DRB1_1501 | 119 LHLTPFTARGR-FATV | LTPFTARGR | 0.4756 | 291 | WB | Bcl-2 |
| DRB1_1501 | 135 EELFRDGVN-WGRIVA | LFRDGVNWG | 0.4694 | 311 | WB | Bcl-2 |
| DRB1_1501 | 212 FSWLSLK-TLLSLALV | WLSLKTLLS | 0.4694 | 312 | WB | Bcl-2 |
| DRB1_1501 | 211 DFSWLSLK-TLLSLAL | WLSLKTLLS | 0.4655 | 325 | WB | Bcl-2 |
| DRB1_1501 | 118 QLHLTPFTARGR-FAT | LHLTPFTAR | 0.4592 | 348 | WB | Bcl-2 |
| DRB1_1501 | 87 SPVPPVVHLTL-RQAG | VVHLTLRQA | 0.4553 | 363 | WB | Bcl-2 |
| DRB1_1501 | 88 PVPPVVHLTL-RQAGD | VVHLTLRQA | 0.4528 | 373 | WB | Bcl-2 |
| DRB1_1501 | 214 WLSLKTLLSLA-LVGA | LKTLLSLAL | 0.4517 | 377 | WB | Bcl-2 |

TABLE E-continued

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | affinity (nM) | Bind Level | Identity |
|---|---|---|---|---|---|---|
| DRB1_1501 | 209 LFDFSWLSLK-TLLSL | WLSLKTLLS | 0.4495 | 386 | WB | Bcl-2 |
| DRB1_1501 | 156 VMCVESVNREM-SPLV | VMCVESVNR | 0.4490 | 388 | WB | Bcl-2 |
| DRB1_1501 | 193 GGWDAFVE-LYGPSMR | FVELYGPSM | 0.4489 | 389 | WB | Bcl-2 |
| DRB1_1501 | 195 WDAFVELYGPSM-RPL | VELYGPSMR | 0.4483 | 391 | WB | Bcl-2 |
| DRB1_1501 | 196 DAFVELYGPSMR-PLF | FVELYGPSM | 0.4482 | 392 | WB | Bcl-2 |
| DRB1_1501 | 132 TVVEELFRDGVN-WGR | LFRDGVNWG | 0.4470 | 397 | WB | Bcl-2 |
| DRB1_1501 | 133 VVEELFRDGVN-WGRI | LFRDGVNWG | 0.4467 | 398 | WB | Bcl-2 |
| DRB1_1501 | 194 GWDAFVE-LYGPSMRP | VELYGPSMR | 0.4467 | 398 | WB | Bcl-2 |
| DRB1_1501 | 174 ALWMTEYLN-RHLHTW | WMTEYLNRH | 0.4463 | 400 | WB | Bcl-2 |
| DRB1_1501 | 208 PLFDFSWLSLK-TLLS | LFDFSWLSL | 0.4459 | 401 | WB | Bcl-2 |
| DRB1_1501 | 172 NIALWMTEYLN-RHLH | WMTEYLNRH | 0.4448 | 406 | WB | Bcl-2 |
| DRB1_1501 | 173 IALWMTEYLN-RHLHT | WMTEYLNRH | 0.4448 | 407 | WB | Bcl-2 |
| DRB1_1501 | 134 VEELFRDGVN-WGRIV | LFRDGVNWG | 0.4431 | 414 | WB | Bcl-2 |
| DRB1_1501 | 171 DNIALWMTEYLN-RHL | WMTEYLNRH | 0.4431 | 414 | WB | Bcl-2 |
| DRB1_1501 | 89 VPPVVHLTL-RQAGDD | VVHLTLRQA | 0.4422 | 418 | WB | Bcl-2 |
| DRB1_1501 | 210 FDFSWLSLK-TLLSLA | WLSLKTLLS | 0.4399 | 429 | WB | Bcl-2 |
| DRB1_1501 | 136 ELFRDGVN-WGRIVAF | LFRDGVNWG | 0.4390 | 433 | WB | Bcl-2 |
| DRB1_1501 | 86 LSPVPPVVHLTL-RQA | PPVVHLTLR | 0.4378 | 438 | WB | Bcl-2 |
| DRB1_1501 | 213 SWLSLKTLLSLA-LVG | LKTLLSLAL | 0.4330 | 461 | WB | Bcl-2 |
| DRB1_1501 | 90 PPVVHLTL-RQAGDDF | VVHLTLRQA | 0.4313 | 470 | WB | Bcl-2 |
| DRB4_0101 | 196 DAFVELYGPSMR-PLF | VELYGPSMR | 0.5364 | 151 | WB | Bcl-2 |
| DRB4_0101 | 197 AFVELYGPSMR-PLFD | VELYGPSMR | 0.5361 | 151 | WB | Bcl-2 |
| DRB4_0101 | 195 WDAFVELYGPSM-RPL | VELYGPSMR | 0.5323 | 158 | WB | Bcl-2 |
| DRB4_0101 | 193 GGWDAFVE-LYGPSMR | FVELYGPSM | 0.4796 | 279 | WB | Bcl-2 |
| DRB4_0101 | 194 GWDAFVE-LYGPSMRP | VELYGPSMR | 0.4785 | 282 | WB | Bcl-2 |
| DRB4_0101 | 198 FVELYGPSMR-PLFDF | VELYGPSMR | 0.4761 | 289 | WB | Bcl-2 |
| DRB4_0101 | 199 VELYGPSMR-PLFDFS | VELYGPSMR | 0.4763 | 289 | WB | Bcl-2 |
| DRB4_0101 | 81 AAGPALSPVPPV-VHL | LSPVPPVVH | 0.4638 | 331 | WB | Bcl-2 |
| DRB4_0101 | 80 AAAGPALSPVP-PVVH | ALSPVPPVV | 0.4614 | 339 | WB | Bcl-2 |
| DRB4_0101 | 170 VDNIALWMTEYL-NRH | IALWMTEYL | 0.4593 | 347 | WB | Bcl-2 |
| DRB4_0101 | 83 GPALSPVPPV-VHLTL | LSPVPPVVH | 0.4589 | 349 | WB | Bcl-2 |
| DRB4_0101 | 82 AGPALSPVPPV-VHLT | LSPVPPVVH | 0.4574 | 354 | WB | Bcl-2 |
| DRB4_0101 | 84 PALSPVPPV-VHLTLR | LSPVPPVVH | 0.4565 | 358 | WB | Bcl-2 |
| DRB4_0101 | 171 DNIALWMTEYLN-RHL | WMTEYLNRH | 0.4552 | 363 | WB | Bcl-2 |
| DRB4_0101 | 172 NIALWMTEYLN-RHLH | LWMTEYLNR | 0.4326 | 464 | WB | Bcl-2 |
| DRB4_0101 | 173 IALWMTEYLN-RHLHT | WMTEYLNRH | 0.4273 | 491 | WB | Bcl-2 |

TABLE E-continued

Prediction of cancer antigen Bcl-2 specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | affinity 1-log50k(aff) | (nM) | Bind Level | Identity |
|---|---|---|---|---|---|---|
| DRB5_0101 | 16 MKYIHYKLSQR-GYEW | YIHYKLSQR | 0.4394 | 431 | WB | Bcl-2 |
| DRB5_0101 | 15 VMKYIHYKLSQR-GYE | YIHYKLSQR | 0.4386 | 435 | WB | Bcl-2 |

SEQ ID NOS: 46594-47133

Preferred fragments of Survivin capable of interacting with one or more MHC class 1 molecules are listed in table F.

TABLE F

Prediction of cancer antigen Survivin specific MHC class 1 peptide sequences. Prediction of 8-, 9-, 10-, 11-mers using the program displayed in FIG. 2.

8 mers:

MGAPTLPP; GAPTLPPA; APTLPPAW; PTLPPAWQ; TLPPAWQP; LPPAWQPF;
PPAWQPFL; PAWQPFLK; AWQPFLKD; WQPFLKDH; QPFLKDHR; PFLKDHRI;
FLKDHRIS; LKDHRIST; KDHRISTF; DHRISTFK; HRISTFKN; RISTFKNW;
ISTFKNWP; STFKNWPF; TFKNWPFL; FKNWPFLE; KNWPFLEG; NWPFLEGC;
WPFLEGCA; PFLEGCAC; FLEGCACT; LEGCACTP; EGCACTPE; GCACTPER;
CACTPERM; ACTPERMA; CTPERMAE; TPERMAEA; PERMAEAG; ERMAEAGF;
RMAEAGFI; MAEAGFIH; AEAGFIHC; EAGFIHCP; AGFIHCPT; GFIHCPTE;
FIHCPTEN; IHCPTENE; HCPTENEP; CPTENEPD; PTENEPDL; TENEPDLA;
ENEPDLAQ; NEPDLAQC; EPDLAQCF; PDLAQCFF; DLAQCFFC; LAQCFFCF;
AQCFFCFK; QCFFCFKE; CFFCFKEL; FFCFKELE; FCFKELEG; CFKELEGW;
FKELEGWE; KELEGWEP; ELEGWEPD; LEGWEPDD; EGWEPDDD; GWEPDDDP;
WEPDDDPI; EPDDDPIE; PDDDPIEE; DDDPIEEH; DDPIEEHK; DPIEEHKK;
PIEEHKKH; IEEHKKHS; EEHKKHSS; EHKKHSSG; HKKHSSGC; KKHSSGCA;
KHSSGCAF; HSSGCAFL; SSGCAFLS; SGCAFLSV; GCAFLSVK; CAFLSVKK;
AFLSVKKQ; FLSVKKQF; LSVKKQFE; SVKKQFEE; VKKQFEEL; KKQFEELT;
KQFEELTL; QFEELTLG; FEELTLGE; EELTLGEF; ELTLGEFL; LTLGEFLK;
TLGEFLKL; LGEFLKLD; GEFLKLDR; EFLKLDRE; FLKLDRER; LKLDRERA;
KLDRERAK; LDRERAKN; DRERAKNK; RERAKNKI; ERAKNKIA; RAKNKIAK;
AKNKIAKE; KNKIAKET; NKIAKETN; KIAKETNN; IAKETNNK; AKETNNKK;
KETNNKKK; ETNNKKKE; TNNKKKEF; NNKKKEFE; NKKKEFEE; KKKEFEET;
KKEFEETA; KEFEETAK; EFEETAKK; FEETAKKV; EETAKKVR; ETAKKVRR;
TAKKVRRA; AKKVRRAI; KKVRRAIE; KVRRAIEQ; VRRAIEQL; RRAIEQLA;
RAIEQLAA; AIEQLAAM; IEQLAAMD; EQLAAMD☐

9 mers:

MGAPTLPPA; GAPTLPPAW; APTLPPAWQ; PTLPPAWQP; TLPPAWQPF; LPPAWQPFL;
PPAWQPFLK; PAWQPFLKD; AWQPFLKDH; WQPFLKDHR; QPFLKDHRI; PFLKDHRIS;
FLKDHRIST; LKDHRISTF; KDHRISTFK; DHRISTFKN; HRISTFKNW; RISTFKNWP;
ISTFKNWPF; STFKNWPFL; TFKNWPFLE; FKNWPFLEG; KNWPFLEGC; NWPFLEGCA;
WPFLEGCAC; PFLEGCACT; FLEGCACTP; LEGCACTPE; EGCACTPER; GCACTPERM;
CACTPERMA; ACTPERMAE; CTPERMAEA; TPERMAEAG; PERMAEAGF; ERMAEAGFI;
RMAEAGFIH; MAEAGFIHC; AEAGFIHCP; EAGFIHCPT; AGFIHCPTE; GFIHCPTEN;
FIHCPTENE; IHCPTENEP; HCPTENEPD; CPTENEPDL; PTENEPDLA; TENEPDLAQ;
ENEPDLAQC; NEPDLAQCF; EPDLAQCFF; PDLAQCFFC; DLAQCFFCF; LAQCFFCFK;
AQCFFCFKE; QCFFCFKEL; CFFCFKELE; FFCFKELEG; FCFKELEGW; CFKELEGWE;
FKELEGWEP; KELEGWEPD; ELEGWEPDD; LEGWEPDDD; EGWEPDDDP; GWEPDDDPI;
WEPDDDPIE; EPDDDPIEE; PDDDPIEEH; DDDPIEEHK; DDPIEEHKK; DPIEEHKKH;
PIEEHKKHS; IEEHKKHSS; EEHKKHSSG; EHKKHSSGC; HKKHSSGCA; KKHSSGCAF;
KHSSGCAFL; HSSGCAFLS; SSGCAFLSV; SGCAFLSVK; GCAFLSVKK; CAFLSVKKQ;
AFLSVKKQF; FLSVKKQFE; LSVKKQFEE; SVKKQFEEL; VKKQFEELT; KKQFEELTL;
KQFEELTLG; QFEELTLGE; FEELTLGEF; EELTLGEFL; ELTLGEFLK; LTLGEFLKL;
TLGEFLKLD; LGEFLKLDR; GEFLKLDRE; EFLKLDRER; FLKLDRERA; LKLDRERAK;
KLDRERAKN; LDRERAKNK; DRERAKNKI; RERAKNKIA; ERAKNKIAK; RAKNKIAKE;
AKNKIAKET; KNKIAKETN; NKIAKETNN; KIAKETNNK; IAKETNNKK; AKETNNKKK;
KETNNKKKE; ETNNKKKEF; TNNKKKEFE; NNKKKEFEE; NKKKEFEET; KKKEFEETA;
KKEFEETAK; KEFEETAKK; EFEETAKKV; FEETAKKVR; EETAKKVRR; ETAKKVRRA;
TAKKVRRAI; AKKVRRAIE; KKVRRAIEQ; KVRRAIEQL; VRRAIEQLA; RRAIEQLAA;
RAIEQLAAM; AIEQLAAMD; ☐

TABLE F-continued

Prediction of cancer antigen Survivin specific MHC class 1 peptide sequences. Prediction of 8-, 9-, 10-, 11-mers using the program displayed in FIG. 2.

10 mers:

MGAPTLPPAW; GAPTLPPAWQ; APTLPPAWQP; PTLPPAWQPF; TLPPAWQPFL;
LPPAWQPFLK; PPAWQPFLKD; PAWQPFLKDH; AWQPFLKDHR; WQPFLKDHRI;
QPFLKDHRIS; PFLKDHRIST; FLKDHRISTF; LKDHRISTFK; KDHRISTFKN;
DHRISTFKNW; HRISTFKNWP; RISTFKNWPF; ISTFKNWPFL; STFKNWPFLE;
TFKNWPFLEG; FKNWPFLEGC; KNWPFLEGCA; NWPFLEGCAC; WPFLEGCACT;
PFLEGCACTP; FLEGCACTPE; LEGCACTPER; EGCACTPERM; GCACTPERMA;
CACTPERMAE; ACTPERMAEA; CTPERMAEAG; TPERMAEAGF; PERMAEAGFI;
ERMAEAGFIH; RMAEAGFIHC; MAEAGFIHCP; AEAGFIHCPT; EAGFIHCPTE;
AGFIHCPTEN; GFIHCPTENE; FIHCPTENEP; IHCPTENEPD; HCPTENEPDL;
CPTENEPDLA; PTENEPDLAQ; TENEPDLAQC; ENEPDLAQCF; NEPDLAQCFF;
EPDLAQCFFC; PDLAQCFFCF; DLAQCFFCFK; LAQCFFCFKE; AQCFFCFKEL;
QCFFCFKELE; CFFCFKELEG; FFCFKELEGW; FCFKELEGWE; CFKELEGWEP;
FKELEGWEPD; KELEGWEPDD; ELEGWEPDDD; LEGWEPDDDP; EGWEPDDDPI;
GWEPDDDPIE; WEPDDDPIEE; EPDDDPIEEH; PDDDPIEEHK; DDDPIEEHKK;
DDPIEEHKKH; DPIEEHKKHS; PIEEHKKHSS; IEEHKKHSSG; EEHKKHSSGC;
EHKKHSSGCA; HKKHSSGCAF; KKHSSGCAFL; KHSSGCAFLS; HSSGCAFLSV;
SSGCAFLSVK; SGCAFLSVKK; GCAFLSVKKQ; CAFLSVKKQF; AFLSVKKQFE;
FLSVKKQFEE; LSVKKQFEEL; SVKKQFEELT; VKKQFEELTL; KKQFEELTLG;
KQFEELTLGE; QFEELTLGEF; FEELTLGEFL; EELTLGEFLK; ELTLGEFLKL;
LTLGEFLKLD; TLGEFLKLDR; LGEFLKLDRE; GEFLKLDRER; EFLKLDRERA;
FLKLDRERAK; LKLDRERAKN; KLDRERAKNK; LDRERAKNKI; DRERAKNKIA;
RERAKNKIAK; ERAKNKIAKE; RAKNKIAKET; AKNKIAKETN; KNKIAKETNN;
NKIAKETNNK; KIAKETNNKK; IAKETNNKKK; AKETNNKKKE; KETNNKKKEF;
ETNNKKKEFE; TNNKKKEFEE; NNKKKEFEET; NKKKEFEETA; KKKEFEETAK;
KKEFEETAKK; KEFEETAKKV; EFEETAKKVR; FEETAKKVRR; EETAKKVRRA;
ETAKKVRRAI; TAKKVRRAIE; AKKVRRAIEQ; KKVRRAIEQL; KVRRAIEQLA;
VRRAIEQLAA; RRAIEQLAAM; RAIEQLAAMD;

11 mers:

MGAPTLPPAWQ; GAPTLPPAWQP; APTLPPAWQPF; PTLPPAWQPFL; TLPPAWQPFLK;
LPPAWQPFLKD; PPAWQPFLKDH; PAWQPFLKDHR; AWQPFLKDHRI; WQPFLKDHRIS;
QPFLKDHRIST; PFLKDHRISTF; FLKDHRISTFK; LKDHRISTFKN; KDHRISTFKNW;
DHRISTFKNWP; HRISTFKNWPF; RISTFKNWPFL; ISTFKNWPFLE; STFKNWPFLEG;
TFKNWPFLEGC; FKNWPFLEGCA; KNWPFLEGCAC; NWPFLEGCACT; WPFLEGCACTP;
PFLEGCACTPE; FLEGCACTPER; LEGCACTPERM; EGCACTPERMA; GCACTPERMAE;
CACTPERMAEA; ACTPERMAEAG; CTPERMAEAGF; TPERMAEAGFI; PERMAEAGFIH;
ERMAEAGFIHC; RMAEAGFIHCP; MAEAGFIHCPT; AEAGFIHCPTE; EAGFIHCPTEN;
AGFIHCPTENE; GFIHCPTENEP; FIHCPTENEPD; IHCPTENEPDL; HCPTENEPDLA;
CPTENEPDLAQ; PTENEPDLAQC; TENEPDLAQCF; ENEPDLAQCFF; NEPDLAQCFFC;
EPDLAQCFFCF; PDLAQCFFCFK; DLAQCFFCFKE; LAQCFFCFKEL; AQCFFCFKELE;
QCFFCFKELEG; CFFCFKELEGW; FFCFKELEGWE; FCFKELEGWEP; CFKELEGWEPD;
FKELEGWEPDD; KELEGWEPDDD; ELEGWEPDDDP; LEGWEPDDDPI; EGWEPDDDPIE;
GWEPDDDPIEE; WEPDDDPIEEH; EPDDDPIEEHK; PDDDPIEEHKK; DDDPIEEHKKH;
DDPIEEHKKHS; DPIEEHKKHSS; PIEEHKKHSSG; IEEHKKHSSGC; EEHKKHSSGCA;
EHKKHSSGCAF; HKKHSSGCAFL; KKHSSGCAFLS; KHSSGCAFLSV; HSSGCAFLSVK;
SSGCAFLSVKK; SGCAFLSVKKQ; GCAFLSVKKQF; CAFLSVKKQFE; AFLSVKKQFEE;
FLSVKKQFEEL; LSVKKQFEELT; SVKKQFEELTL; VKKQFEELTLG; KKQFEELTLGE;
KQFEELTLGEF; QFEELTLGEFL; FEELTLGEFLK; EELTLGEFLKL; ELTLGEFLKLD;
LTLGEFLKLDR; TLGEFLKLDRE; LGEFLKLDRER; GEFLKLDRERA; EFLKLDRERAK;
FLKLDRERAKN; LKLDRERAKNK; KLDRERAKNKI; LDRERAKNKIA; DRERAKNKIAK;
RERAKNKIAKE; ERAKNKIAKET; RAKNKIAKETN; AKNKIAKETNN; KNKIAKETNNK;
NKIAKETNNKK; KIAKETNNKKK; IAKETNNKKKE; AKETNNKKKEF; KETNNKKKEFE;
ETNNKKKEFEE; TNNKKKEFEET; NNKKKEFEETA; NKKKEFEETAK; KKKEFEETAKK;
KKEFEETAKKV; KEFEETAKKVR; EFEETAKKVRR; FEETAKKVRRA; EETAKKVRRAI;
ETAKKVRRAIE; TAKKVRRAIEQ; AKKVRRAIEQL; KKVRRAIEQLA; KVRRAIEQLAA;
VRRAIEQLAAM; RRAIEQLAAMD

SEQ ID NOS: 47646-48180

Preferred fragments of Mcl-1 capable of interacting with one or more MHC class 2 molecules are listed in table G.

TABLE G

Prediction of cancer antigen Mcl-1 specific MHC class 2 peptide sequences. Prediction of 13-, 14-, 15-, 16-mers using the program displayed in FIG. 2.;

13 mers:

MFGLKRNAVIGLN; FGLKRNAVIGLNL; GLKRNAVIGLNLY; LKRNAVIGLNLYC;
KRNAVIGLNLYCG; RNAVIGLNLYCGG; NAVIGLNLYCGGA; AVIGLNLYCGGAG;
VIGLNLYCGGAGL; IGLNLYCGGAGLG; GLNLYCGGAGLGA; LNLYCGGAGLGAG;
NLYCGGAGLGAGS; LYCGGAGLGAGSG; YCGGAGLGAGSGG; CGGAGLGAGSGGA;
GGAGLGAGSGGAT; GAGLGAGSGGATR; AGLGAGSGGATRP; GLGAGSGGATRPG;
LGAGSGGATRPGG; GAGSGGATRPGGR; AGSGGATRPGGRL; GSGGATRPGGRLL;
SGGATRPGGRLLA; GGATRPGGRLLAT; GATRPGGRLLATE; ATRPGGRLLATEK;
TRPGGRLLATEKE; RPGGRLLATEKEA; PGGRLLATEKEAS; GGRLLATEKEASA;
GRLLATEKEASAR; RLLATEKEASARR; LLATEKEASARRE; LATEKEASARREI;
ATEKEASARREIG; TEKEASARREIGG; EKEASARREIGGG; KEASARREIGGGE;
EASARREIGGGEA; ASARREIGGGEAG; SARREIGGGEAGA; ARREIGGGEAGAV;
RREIGGGEAGAVI; REIGGGEAGAVIG; EIGGGEAGAVIGG; IGGGEAGAVIGGS;
GGGEAGAVIGGSA; GGEAGAVIGGSAG; GEAGAVIGGSAGA; EAGAVIGGSAGAS;
AGAVIGGSAGASP; GAVIGGSAGASPP; AVIGGSAGASPPS; VIGGSAGASPPST;
IGGSAGASPPSTL; GGSAGASPPSTLT; GSAGASPPSTLTP; SAGASPPSTLTPD;
AGASPPSTLTPDS; GASPPSTLTPDSR; ASPPSTLTPDSRR; SPPSTLTPDSRRV;
PPSTLTPDSRRVA; PSTLTPDSRRVAR; STLTPDSRRVARP; TLTPDSRRVARPP;
LTPDSRRVARPPP; TPDSRRVARPPPI; PDSRRVARPPPIG; DSRRVARPPPIGA;
SRRVARPPPIGAE; RRVARPPPIGAEV; RVARPPPIGAEVP; VARPPPIGAEVPD;
ARPPPIGAEVPDV; RPPPIGAEVPDVT; PPPIGAEVPDVTA; PPIGAEVPDVTAT;
PIGAEVPDVTATP; IGAEVPDVTATPA; GAEVPDVTATPAR; AEVPDVTATPARL;
EVPDVTATPARLL; VPDVTATPARLLF; PDVTATPARLLFF; DVTATPARLLFFA;
VTATPARLLFFAP; TATPARLLFFAPT; ATPARLLFFAPTR; TPARLLFFAPTRR;
PARLLFFAPTRRA; ARLLFFAPTRRAA; RLLFFAPTRRAAP; LLFFAPTRRAAPL;
LFFAPTRRAAPLE; FFAPTRRAAPLEE; FAPTRRAAPLEEM; APTRRAAPLEEME;
PTRRAAPLEEMEA; TRRAAPLEEMEAP; RRAAPLEEMEAPA; RAAPLEEMEAPAA;
AAPLEEMEAPAAD; APLEEMEAPAADA; PLEEMEAPAADAI; LEEMEAPAADAIM;
EEMEAPAADAIMS; EMEAPAADAIMSP; MEAPAADAIMSPE; EAPAADAIMSPEE;
APAADAIMSPEEE; PAADAIMSPEEEL; AADAIMSPEEELD; ADAIMSPEEELDG;
DAIMSPEEELDGY; AIMSPEEELDGYE; IMSPEEELDGYEP; MSPEEELDGYEPE;
SPEEELDGYEPEP; PEEELDGYEPEPL; EEELDGYEPEPLG; EELDGYEPEPLGK;
ELDGYEPEPLGKR; LDGYEPEPLGKRP; DGYEPEPLGKRPA; GYEPEPLGKRPAV;
YEPEPLGKRPAVL; EPEPLGKRPAVLP; PEPLGKRPAVLPL; EPLGKRPAVLPLL;
PLGKRPAVLPLLE; LGKRPAVLPLLEL; GKRPAVLPLLELV; KRPAVLPLLELVG;
RPAVLPLLELVGE; PAVLPLLELVGES; AVLPLLELVGESG; VLPLLELVGESGN;
LPLLELVGESGNN; PLLELVGESGNNT; LLELVGESGNNTS; LELVGESGNNTST;
ELVGESGNNTSTD; LVGESGNNTSTDG; VGESGNNTSTDGS; GESGNNTSTDGSL;
ESGNNTSTDGSLP; SGNNTSTDGSLPS; GNNTSTDGSLPST; NNTSTDGSLPSTP;
NTSTDGSLPSTPP; TSTDGSLPSTPPP; STDGSLPSTPPPA; TDGSLPSTPPPAE;
DGSLPSTPPPAEE; GSLPSTPPPAEEE; SLPSTPPPAEEEE; LPSTPPPAEEEED;
PSTPPPAEEEEDD; STPPPAEEEEDDL; TPPPAEEEEDDLY; PPPAEEEEDDLYR;
PPAEEEEDDLYRQ; PAEEEEDDLYRQS; AEEEEDDLYRQSL; EEEEDDLYRQSLE;
EEEDDLYRQSLEI; EEDDLYRQSLEII; EDDLYRQSLEIIS; DDLYRQSLEIISR;
DLYRQSLEIISRY; LYRQSLEIISRYL; YRQSLEIISRYLR; RQSLEIISRYLRE;
QSLEIISRYLREQ; SLEIISRYLREQA; LEIISRYLREQAT; EIISRYLREQATG;
IISRYLREQATGA; ISRYLREQATGAK; SRYLREQATGAKD; RYLREQATGAKDT;
YLREQATGAKDTK; LREQATGAKDTKP; REQATGAKDTKPM; EQATGAKDTKPMG;
QATGAKDTKPMGR; ATGAKDTKPMGRS; TGAKDTKPMGRSG; GAKDTKPMGRSGA;
AKDTKPMGRSGAT; KDTKPMGRSGATS; DTKPMGRSGATSR; TKPMGRSGATSRK;
KPMGRSGATSRKA; PMGRSGATSRKAL; MGRSGATSRKALE; GRSGATSRKALET;
RSGATSRKALETL; SGATSRKALETLR; GATSRKALETLRR; ATSRKALETLRRV;
TSRKALETLRRVG; SRKALETLRRVGD; RKALETLRRVGDG; KALETLRRVGDGV;
ALETLRRVGDGVQ; LETLRRVGDGVQR; ETLRRVGDGVQRN; TLRRVGDGVQRNH;
LRRVGDGVQRNHE; RRVGDGVQRNHET; RVGDGVQRNHETA; VGDGVQRNHETAF;
GDGVQRNHETAFQ; DGVQRNHETAFQG; GVQRNHETAFQGM; VQRNHETAFQGML;
QRNHETAFQGMLR; RNHETAFQGMLRK; NHETAFQGMLRKL; HETAFQGMLRKLD;
ETAFQGMLRKLDI; TAFQGMLRKLDIK; AFQGMLRKLDIKN; FQGMLRKLDIKNE;
QGMLRKLDIKNED; GMLRKLDIKNEDD; MLRKLDIKNEDDV; LRKLDIKNEDDVK;
RKLDIKNEDDVKS; KLDIKNEDDVKSL; LDIKNEDDVKSLS; DIKNEDDVKSLSR;
IKNEDDVKSLSRV; KNEDDVKSLSRVM; NEDDVKSLSRVMI; EDDVKSLSRVMIH;
DDVKSLSRVMIHV; DVKSLSRVMIHVF; VKSLSRVMIHVFS; KSLSRVMIHVFSD;
SLSRVMIHVFSDG; LSRVMIHVFSDGV; SRVMIHVFSDGVT; RVMIHVFSDGVTN;
VMIHVFSDGVTNW; MIHVFSDGVTNWG; IHVFSDGVTNWGR; HVFSDGVTNWGRI;
VFSDGVTNWGRIV; FSDGVTNWGRIVT; SDGVTNWGRIVTL; DGVTNWGRIVTLI;
GVTNWGRIVTLIS; VTNWGRIVTLISF; TNWGRIVTLISFG; NWGRIVTLISFGA;
WGRIVTLISFGAF; GRIVTLISFGAFV; RIVTLISFGAFVA; IVTLISFGAFVAK;
VTLISFGAFVAKH; TLISFGAFVAKHL; LISFGAFVAKHLK; ISFGAFVAKHLKT;
SFGAFVAKHLKTI; FGAFVAKHLKTIN; GAFVAKHLKTINQ; AFVAKHLKTINQE;
FVAKHLKTINQES; VAKHLKTINQESC; AKHLKTINQESCI; KHLKTINQESCIE;
HLKTINQESCIEP; LKTINQESCIEPL; KTINQESCIEPLA; TINQESCIEPLAE;
INQESCIEPLAES; NQESCIEPLAESI; QESCIEPLAESIT; ESCIEPLAESITD;

TABLE G-continued

Prediction of cancer antigen Mcl-1 specific MHC class 2 peptide sequences. Prediction of 13-, 14-, 15-, 16-mers using the program displayed in FIG. 2.;

SCIEPLAESITDV; CIEPLAESITDVL; IEPLAESITDVLV; EPLAESITDVLVR;
PLAESITDVLVRT; LAESITDVLVRTK; AESITDVLVRTKR; ESITDVLVRTKRD;
SITDVLVRTKRDW; ITDVLVRTKRDWL; TDVLVRTKRDWLV; DVLVRTKRDWLVK;
VLVRTKRDWLVKQ; LVRTKRDWLVKQR; VRTKRDWLVKQRG; RTKRDWLVKQRGW;
TKRDWLVKQRGWD; KRDWLVKQRGWDG; RDWLVKQRGWDGF; DWLVKQRGWDGFV;
WLVKQRGWDGFVE; LVKQRGWDGFVEF; VKQRGWDGFVEFF; KQRGWDGFVEFFH;
QRGWDGFVEFFHV; RGWDGFVEFFHVE; GWDGFVEFFHVED; WDGFVEFFHVEDL;
DGFVEFFHVEDLE; GFVEFFHVEDLEG; FVEFFHVEDLEGG; VEFFHVEDLEGGI;
EFFHVEDLEGGIR; FFHVEDLEGGIRN; FHVEDLEGGIRNV; HVEDLEGGIRNVL;
VEDLEGGIRNVLL; EDLEGGIRNVLLA; DLEGGIRNVLLAF; LEGGIRNVLLAFA;
EGGIRNVLLAFAG; GGIRNVLLAFAGV; GIRNVLLAFAGVA; IRNVLLAFAGVAG;
RNVLLAFAGVAGV; NVLLAFAGVAGVG; VLLAFAGVAGVGA; LLAFAGVAGVGAG;
LAFAGVAGVGAGL; AFAGVAGVGAGLA; FAGVAGVGAGLAY; AGVAGVGAGLAYL;
GVAGVGAGLAYLI; VAGVGAGLAYLIR 14 mers:

MFGLKRNAVIGLNL; FGLKRNAVIGLNLY; GLKRNAVIGLNLYC; LKRNAVIGLNLYCG;
KRNAVIGLNLYCGG; RNAVIGLNLYCGGA; NAVIGLNLYCGGAG; AVIGLNLYCGGAGL;
VIGLNLYCGGAGLG; IGLNLYCGGAGLGA; GLNLYCGGAGLGAG; LNLYCGGAGLGAGS;
NLYCGGAGLGAGSG; LYCGGAGLGAGSGG; YCGGAGLGAGSGGA; CGGAGLGAGSGGAT;
GGAGLGAGSGGATR; GAGLGAGSGGATRP; AGLGAGSGGATRPG; GLGAGSGGATRPGG;
LGAGSGGATRPGGR; GAGSGGATRPGGRL; AGSGGATRPGGRLL; GSGGATRPGGRLLA;
SGGATRPGGRLLAT; GGATRPGGRLLATE; GATRPGGRLLATEK; ATRPGGRLLATEKE;
TRPGGRLLATEKEA; RPGGRLLATEKEAS; PGGRLLATEKEASA; GGRLLATEKEASAR;
GRLLATEKEASARR; RLLATEKEASARRE; LLATEKEASARREI; LATEKEASARREIG;
ATEKEASARREIGG; TEKEASARREIGGG; EKEASARREIGGGE; KEASARREIGGGEA;
EASARREIGGGEAG; ASARREIGGGEAGA; SARREIGGGEAGAV; ARREIGGGEAGAVI;
RREIGGGEAGAVIG; REIGGGEAGAVIGG; EIGGGEAGAVIGGS; IGGGEAGAVIGGSA;
GGGEAGAVIGGSAG; GGEAGAVIGGSAGA; GEAGAVIGGSAGAS; EAGAVIGGSAGASP;
AGAVIGGSAGASPP; GAVIGGSAGASPPS; AVIGGSAGASPPST; VIGGSAGASPPSTL;
IGGSAGASPPSTLT; GGSAGASPPSTLTP; GSAGASPPSTLTPD; SAGASPPSTLTPDS;
AGASPPSTLTPDSR; GASPPSTLTPDSRR; ASPPSTLTPDSRRV; SPPSTLTPDSRRVA;
PPSTLTPDSRRVAR; PSTLTPDSRRVARP; STLTPDSRRVARPP; TLTPDSRRVARPPP;
LTPDSRRVARPPPI; TPDSRRVARPPPIG; PDSRRVARPPPIGA; DSRRVARPPPIGAE;
SRRVARPPPIGAEV; RRVARPPPIGAEVP; RVARPPPIGAEVPD; VARPPPIGAEVPDV;
ARPPPIGAEVPDVT; RPPPIGAEVPDVTA; PPPIGAEVPDVTAT; PPIGAEVPDVTATP;
PIGAEVPDVTATPA; IGAEVPDVTATPAR; GAEVPDVTATPARL; AEVPDVTATPARLL;
EVPDVTATPARLLF; VPDVTATPARLLFF; PDVTATPARLLFFA; DVTATPARLLFFAP;
VTATPARLLFFAPT; TATPARLLFFAPTR; ATPARLLFFAPTRR; TPARLLFFAPTRRA;
PARLLFFAPTRRAA; ARLLFFAPTRRAAP; RLLFFAPTRRAAPL; LLFFAPTRRAAPLE;
LFFAPTRRAAPLEE; FFAPTRRAAPLEEM; FAPTRRAAPLEEME; APTRRAAPLEEMEA;
PTRRAAPLEEMEAP; TRRAAPLEEMEAPA; RRAAPLEEMEAPAA; RAAPLEEMEAPAAD;
AAPLEEMEAPAADA; APLEEMEAPAADAI; PLEEMEAPAADAIM; LEEMEAPAADAIMS;
EEMEAPAADAIMSP; EMEAPAADAIMSPE; MEAPAADAIMSPEE; EAPAADAIMSPEEE;
APAADAIMSPEEEL; PAADAIMSPEEELD; AADAIMSPEEELDG; ADAIMSPEEELDGY;
DAIMSPEEELDGYE; AIMSPEEELDGYEP; IMSPEEELDGYEPE; MSPEEELDGYEPEP;
SPEEELDGYEPEPL; PEEELDGYEPEPLG; EEELDGYEPEPLGK; EELDGYEPEPLGKR;
ELDGYEPEPLGKRP; LDGYEPEPLGKRPA; DGYEPEPLGKRPAV; GYEPEPLGKRPAVL;
YEPEPLGKRPAVLP; EPEPLGKRPAVLPL; PEPLGKRPAVLPLL; EPLGKRPAVLPLLE;
PLGKRPAVLPLLEL; LGKRPAVLPLLELV; GKRPAVLPLLELVG; KRPAVLPLLELVGE;
RPAVLPLLELVGES; PAVLPLLELVGESG; AVLPLLELVGESGN; VLPLLELVGESGNN;
LPLLELVGESGNNT; PLLELVGESGNNTS; LLELVGESGNNTST; LELVGESGNNTSTD;
ELVGESGNNTSTDG; LVGESGNNTSTDGS; VGESGNNTSTDGSL; GESGNNTSTDGSLP;
ESGNNTSTDGSLPS; SGNNTSTDGSLPST; GNNTSTDGSLPSTP; NNTSTDGSLPSTPP;
NTSTDGSLPSTPPP; TSTDGSLPSTPPPA; STDGSLPSTPPPAE; TDGSLPSTPPPAEE;
DGSLPSTPPPAEEE; GSLPSTPPPAEEEE; SLPSTPPPAEEEED; LPSTPPPAEEEEDD;
PSTPPPAEEEEDDL; STPPPAEEEEDDLY; TPPPAEEEEDDLYR; PPPAEEEEDDLYRQ;
PPAEEEEDDLYRQS; PAEEEEDDLYRQSL; AEEEEDDLYRQSLE; EEEEDDLYRQSLEI;
EEEDDLYRQSLEII; EEDDLYRQSLEIIS; EDDLYRQSLEIISR; DDLYRQSLEIISRY;
DLYRQSLEIISRYL; LYRQSLEIISRYLR; YRQSLEIISRYLRE; RQSLEIISRYLREQ;
QSLEIISRYLREQA; SLEIISRYLREQAT; LEIISRYLREQATG; EIISRYLREQATGA;
IISRYLREQATGAK; ISRYLREQATGAKD; SRYLREQATGAKDT; RYLREQATGAKDTK;
YLREQATGAKDTKP; LREQATGAKDTKPM; REQATGAKDTKPMG; EQATGAKDTKPMGR;
QATGAKDTKPMGRS; ATGAKDTKPMGRSG; TGAKDTKPMGRSGA; GAKDTKPMGRSGAT;
AKDTKPMGRSGATS; KDTKPMGRSGATSR; DTKPMGRSGATSRK; TKPMGRSGATSRKA;
KPMGRSGATSRKAL; PMGRSGATSRKALE; MGRSGATSRKALET; GRSGATSRKALETL;
RSGATSRKALETLR; SGATSRKALETLRR; GATSRKALETLRRV; ATSRKALETLRRVG;
TSRKALETLRRVGD; SRKALETLRRVGDG; RKALETLRRVGDGV; KALETLRRVGDGVQ;
ALETLRRVGDGVQR; LETLRRVGDGVQRN; ETLRRVGDGVQRNH; TLRRVGDGVQRNHE;
LRRVGDGVQRNHET; RRVGDGVQRNHETA; RVGDGVQRNHETAF; VGDGVQRNHETAFQ;
GDGVQRNHETAFQG; DGVQRNHETAFQGM; GVQRNHETAFQGML; VQRNHETAFQGMLR;
QRNHETAFQGMLRK; RNHETAFQGMLRKL; NHETAFQGMLRKLD; HETAFQGMLRKLDI;
ETAFQGMLRKLDIK; TAFQGMLRKLDIKN; AFQGMLRKLDIKNE; FQGMLRKLDIKNED;
QGMLRKLDIKNEDD; GMLRKLDIKNEDDV; MLRKLDIKNEDDVK; LRKLDIKNEDDVKS;
RKLDIKNEDDVKSL; KLDIKNEDDVKSLS; LDIKNEDDVKSLSR; DIKNEDDVKSLSRV;

TABLE G-continued

Prediction of cancer antigen Mcl-1 specific MHC class 2 peptide sequences. Prediction of 13-, 14-, 15-, 16-mers using the program displayed in FIG. 2.;

IKNEDDVKSLSRVM; KNEDDVKSLSRVMI; NEDDVKSLSRVMIH; EDDVKSLSRVMIHV;
DDVKSLSRVMIHVF; DVKSLSRVMIHVFS; VKSLSRVMIHVFSD; KSLSRVMIHVFSDG;
SLSRVMIHVFSDGV; LSRVMIHVFSDGVT; SRVMIHVFSDGVTN; RVMIHVFSDGVTNW;
VMIHVFSDGVTNWG; MIHVFSDGVTNWGR; IHVFSDGVTNWGRI; HVFSDGVTNWGRIV;
VFSDGVTNWGRIVT; FSDGVTNWGRIVTL; SDGVTNWGRIVTLI; DGVTNWGRIVTLIS;
GVTNWGRIVTLISF; VTNWGRIVTLISFG; TNWGRIVTLISFGA; NWGRIVTLISFGAF;
WGRIVTLISFGAFV; GRIVTLISFGAFVA; RIVTLISFGAFVAK; IVTLISFGAFVAKH;
VTLISFGAFVAKHL; TLISFGAFVAKHLK; LISFGAFVAKHLKT; ISFGAFVAKHLKTI;
SFGAFVAKHLKTIN; FGAFVAKHLKTINQ; GAFVAKHLKTINQE; AFVAKHLKTINQES;
FVAKHLKTINQESC; VAKHLKTINQESCI; AKHLKTINQESCIE; KHLKTINQESCIEP;
HLKTINQESCIEPL; LKTINQESCIEPLA; KTINQESCIEPLAE; TINQESCIEPLAES;
INQESCIEPLAESI; NQESCIEPLAESIT; QESCIEPLAESITD; ESCIEPLAESITDV;
SCIEPLAESITDVL; CIEPLAESITDVLV; IEPLAESITDVLVR; EPLAESITDVLVRT;
PLAESITDVLVRTK; LAESITDVLVRTKR; AESITDVLVRTKRD; ESITDVLVRTKRDW;
SITDVLVRTKRDWL; ITDVLVRTKRDWLV; TDVLVRTKRDWLVK; DVLVRTKRDWLVKQ;
VLVRTKRDWLVKQR; LVRTKRDWLVKQRG; VRTKRDWLVKQRGW; RTKRDWLVKQRGWD;
TKRDWLVKQRGWDG; KRDWLVKQRGWDGF; RDWLVKQRGWDGFV; DWLVKQRGWDGFVE;
WLVKQRGWDGFVEF; LVKQRGWDGFVEFF; VKQRGWDGFVEFFH; KQRGWDGFVEFFHV;
QRGWDGFVEFFHVE; RGWDGFVEFFHVED; GWDGFVEFFHVEDL; WDGFVEFFHVEDLE;
DGFVEFFHVEDLEG; GFVEFFHVEDLEGG; FVEFFHVEDLEGGI; VEFFHVEDLEGGIR;
EFFHVEDLEGGIRN; FFHVEDLEGGIRNV; FHVEDLEGGIRNVL; HVEDLEGGIRNVLL;
VEDLEGGIRNVLLA; EDLEGGIRNVLLAF; DLEGGIRNVLLAFA; LEGGIRNVLLAFAG;
EGGIRNVLLAFAGV; GGIRNVLLAFAGVA; GIRNVLLAFAGVAG; IRNVLLAFAGVAGV;
RNVLLAFAGVAGVG; NVLLAFAGVAGVGA; VLLAFAGVAGVGAG; LLAFAGVAGVGAGL;
LAFAGVAGVGAGLA; AFAGVAGVGAGLAY; FAGVAGVGAGLAYL; AGVAGVGAGLAYLI;
GVAGVGAGLAYLIR 15 mers:

MFGLKRNAVIGLNLY; FGLKRNAVIGLNLYC; GLKRNAVIGLNLYCG;
LKRNAVIGLNLYCGG; KRNAVIGLNLYCGGA; RNAVIGLNLYCGGAG;
NAVIGLNLYCGGAGL; AVIGLNLYCGGAGLG; VIGLNLYCGGAGLGA;
IGLNLYCGGAGLGAG; GLNLYCGGAGLGAGS; LNLYCGGAGLGAGSG;
NLYCGGAGLGAGSGG; LYCGGAGLGAGSGGA; YCGGAGLGAGSGGAT;
CGGAGLGAGSGGATR; GGAGLGAGSGGATRP; GAGLGAGSGGATRPG;
AGLGAGSGGATRPGG; GLGAGSGGATRPGGR; LGAGSGGATRPGGRL;
GAGSGGATRPGGRLL; AGSGGATRPGGRLLA; GSGGATRPGGRLLAT;
SGGATRPGGRLLATE; GGATRPGGRLLATEK; GATRPGGRLLATEKE;
ATRPGGRLLATEKEA; TRPGGRLLATEKEAS; RPGGRLLATEKEASA;
PGGRLLATEKEASAR; GGRLLATEKEASARR; GRLLATEKEASARRE;
RLLATEKEASARREI; LLATEKEASARREIG; LATEKEASARREIGG;
ATEKEASARREIGGG; TEKEASARREIGGGE; EKEASARREIGGGEA;
KEASARREIGGGEAG; EASARREIGGGEAGA; ASARREIGGGEAGAV;
SARREIGGGEAGAVI; ARREIGGGEAGAVIG; RREIGGGEAGAVIGG;
REIGGGEAGAVIGGS; EIGGGEAGAVIGGSA; IGGGEAGAVIGGSAG;
GGGEAGAVIGGSAGA; GGEAGAVIGGSAGAS; GEAGAVIGGSAGASP;
EAGAVIGGSAGASPP; AGAVIGGSAGASPPS; GAVIGGSAGASPPST;
AVIGGSAGASPPSTL; VIGGSAGASPPSTLT; IGGSAGASPPSTLTP;
GGSAGASPPSTLTPD; GSAGASPPSTLTPDS; SAGASPPSTLTPDSR;
AGASPPSTLTPDSRR; GASPPSTLTPDSRRV; ASPPSTLTPDSRRVA;
SPPSTLTPDSRRVAR; PPSTLTPDSRRVARP; PSTLTPDSRRVARPP;
STLTPDSRRVARPPP; TLTPDSRRVARPPPI; LTPDSRRVARPPPIG;
TPDSRRVARPPPIGA; PDSRRVARPPPIGAE; DSRRVARPPPIGAEV;
SRRVARPPPIGAEVP; RRVARPPPIGAEVPD; RVARPPPIGAEVPDV;
VARPPPIGAEVPDVT; ARPPPIGAEVPDVTA; RPPPIGAEVPDVTAT;
PPPIGAEVPDVTATP; PPIGAEVPDVTATPA; PIGAEVPDVTATPAR;
IGAEVPDVTATPARL; GAEVPDVTATPARLL; AEVPDVTATPARLLF;
EVPDVTATPARLLFF; VPDVTATPARLLFFA; PDVTATPARLLFFAP;
DVTATPARLLFFAPT; VTATPARLLFFAPTR; TATPARLLFFAPTRR;
ATPARLLFFAPTRRA; TPARLLFFAPTRRAA; PARLLFFAPTRRAAP;
ARLLFFAPTRRAAPL; RLLFFAPTRRAAPLE; LLFFAPTRRAAPLEE;
LFFAPTRRAAPLEEM; FFAPTRRAAPLEEME; FAPTRRAAPLEEMEA;
APTRRAAPLEEMEAP; PTRRAAPLEEMEAPA; TRRAAPLEEMEAPAA;
RRAAPLEEMEAPAAD; RAAPLEEMEAPAADA; AAPLEEMEAPAADAI;
APLEEMEAPAADAIM; PLEEMEAPAADAIMS; LEEMEAPAADAIMSP;
EEMEAPAADAIMSPE; EMEAPAADAIMSPEE; MEAPAADAIMSPEEE;
EAPAADAIMSPEEEL; APAADAIMSPEEELD; PAADAIMSPEEELDG;
AADAIMSPEEELDGY; ADAIMSPEEELDGYE; DAIMSPEEELDGYEP;
AIMSPEEELDGYEPE; IMSPEEELDGYEPEP; MSPEEELDGYEPEPL;
SPEEELDGYEPEPLG; PEEELDGYEPEPLGK; EEELDGYEPEPLGKR;
EELDGYEPEPLGKRP; ELDGYEPEPLGKRPA; LDGYEPEPLGKRPAV;
DGYEPEPLGKRPAVL; GYEPEPLGKRPAVLP; YEPEPLGKRPAVLPL;
EPEPLGKRPAVLPLL; PEPLGKRPAVLPLLE; EPLGKRPAVLPLLEL;
PLGKRPAVLPLLELV; LGKRPAVLPLLELVG; GKRPAVLPLLELVGE;
KRPAVLPLLELVGES; RPAVLPLLELVGESG; PAVLPLLELVGESGN;
AVLPLLELVGESGNN; VLPLLELVGESGNNT; LPLLELVGESGNNTS;

TABLE G-continued

Prediction of cancer antigen Mcl-1 specific MHC class 2 peptide sequences. Prediction of 13-, 14-, 15-, 16-mers using the program displayed in FIG. 2.;

PLLELVGESGNNTST; LLELVGESGNNTSTD; LELVGESGNNTSTDG;
ELVGESGNNTSTDGS; LVGESGNNTSTDGSL; VGESGNNTSTDGSLP;
GESGNNTSTDGSLPS; ESGNNTSTDGSLPST; SGNNTSTDGSLPSTP;
GNNTSTDGSLPSTPP; NNTSTDGSLPSTPPP; NTSTDGSLPSTPPPA;
TSTDGSLPSTPPPAE; STDGSLPSTPPPAEE; TDGSLPSTPPPAEEE;
DGSLPSTPPPAEEEE; GSLPSTPPPAEEEED; SLPSTPPPAEEEEDD;
LPSTPPPAEEEEDDL; PSTPPPAEEEEDDLY; STPPPAEEEEDDLYR;
TPPPAEEEEDDLYRQ; PPPAEEEEDDLYRQS; PPAEEEEDDLYRQSL;
PAEEEEDDLYRQSLE; AEEEEDDLYRQSLEI; EEEEDDLYRQSLEII;
EEEDDLYRQSLEIIS; EEDDLYRQSLEIISR; EDDLYRQSLEIISRY;
DDLYRQSLEIISRYL; DLYRQSLEIISRYLR; LYRQSLEIISRYLRE;
YRQSLEIISRYLREQ; RQSLEIISRYLREQA; QSLEIISRYLREQAT;
SLEIISRYLREQATG; LEIISRYLREQATGA; EIISRYLREQATGAK;
IISRYLREQATGAKD; ISRYLREQATGAKDT; SRYLREQATGAKDTK;
RYLREQATGAKDTKP; YLREQATGAKDTKPM; LREQATGAKDTKPMG;
REQATGAKDTKPMGR; EQATGAKDTKPMGRS; QATGAKDTKPMGRSG;
ATGAKDTKPMGRSGA; TGAKDTKPMGRSGAT; GAKDTKPMGRSGATS;
AKDTKPMGRSGATSR; KDTKPMGRSGATSRK; DTKPMGRSGATSRKA;
TKPMGRSGATSRKAL; KPMGRSGATSRKALE; PMGRSGATSRKALET;
MGRSGATSRKALETL; GRSGATSRKALETLR; RSGATSRKALETLRR;
SGATSRKALETLRRV; GATSRKALETLRRVG; ATSRKALETLRRVGD;
TSRKALETLRRVGDG; SRKALETLRRVGDGV; RKALETLRRVGDGVQ;
KALETLRRVGDGVQR; ALETLRRVGDGVQRN; LETLRRVGDGVQRNH;
ETLRRVGDGVQRNHE; TLRRVGDGVQRNHET; LRRVGDGVQRNHETA;
RRVGDGVQRNHETAF; RVGDGVQRNHETAFQ; VGDGVQRNHETAFQG;
GDGVQRNHETAFQGM; DGVQRNHETAFQGML; GVQRNHETAFQGMLR;
VQRNHETAFQGMLRK; QRNHETAFQGMLRKL; RNHETAFQGMLRKLD;
NHETAFQGMLRKLDI; HETAFQGMLRKLDIK; ETAFQGMLRKLDIKN;
TAFQGMLRKLDIKNE; AFQGMLRKLDIKNED; FQGMLRKLDIKNEDD;
QGMLRKLDIKNEDDV; GMLRKLDIKNEDDVK; MLRKLDIKNEDDVKS;
LRKLDIKNEDDVKSL; RKLDIKNEDDVKSLS; KLDIKNEDDVKSLSR;
LDIKNEDDVKSLSRV; DIKNEDDVKSLSRVM; IKNEDDVKSLSRVMI;
KNEDDVKSLSRVMIH; NEDDVKSLSRVMIHV; EDDVKSLSRVMIHVF;
DDVKSLSRVMIHVFS; DVKSLSRVMIHVFSD; VKSLSRVMIHVFSDG;
KSLSRVMIHVFSDGV; SLSRVMIHVFSDGVT; LSRVMIHVFSDGVTN;
SRVMIHVFSDGVTNW; RVMIHVFSDGVTNWG; VMIHVFSDGVTNWGR;
MIHVFSDGVTNWGRI; IHVFSDGVTNWGRIV; HVFSDGVTNWGRIVT;
VFSDGVTNWGRIVTL; FSDGVTNWGRIVTLI; SDGVTNWGRIVTLIS;
DGVTNWGRIVTLISF; GVTNWGRIVTLISFG; VTNWGRIVTLISFGA;
TNWGRIVTLISFGAF; NWGRIVTLISFGAFV; WGRIVTLISFGAFVA;
GRIVTLISFGAFVAK; RIVTLISFGAFVAKH; IVTLISFGAFVAKHL;
VTLISFGAFVAKHLK; TLISFGAFVAKHLKT; LISFGAFVAKHLKTI;
ISFGAFVAKHLKTIN; SFGAFVAKHLKTINQ; FGAFVAKHLKTINQE;
GAFVAKHLKTINQES; AFVAKHLKTINQESC; FVAKHLKTINQESCI;
VAKHLKTINQESCIE; AKHLKTINQESCIEP; KHLKTINQESCIEPL;
HLKTINQESCIEPLA; LKTINQESCIEPLAE; KTINQESCIEPLAES;
TINQESCIEPLAESI; INQESCIEPLAESIT; NQESCIEPLAESITD;
QESCIEPLAESITDV; ESCIEPLAESITDVL; SCIEPLAESITDVLV;
CIEPLAESITDVLVR; IEPLAESITDVLVRT; EPLAESITDVLVRTK;
PLAESITDVLVRTKR; LAESITDVLVRTKRD; AESITDVLVRTKRDW;
ESITDVLVRTKRDWL; SITDVLVRTKRDWLV; ITDVLVRTKRDWLVK;
TDVLVRTKRDWLVKQ; DVLVRTKRDWLVKQR; VLVRTKRDWLVKQRG;
LVRTKRDWLVKQRGW; VRTKRDWLVKQRGWD; RTKRDWLVKQRGWDG;
TKRDWLVKQRGWDGF; KRDWLVKQRGWDGFV; RDWLVKQRGWDGFVE;
DWLVKQRGWDGFVEF; WLVKQRGWDGFVEFF; LVKQRGWDGFVEFFH;
VKQRGWDGFVEFFHV; KQRGWDGFVEFFHVE; QRGWDGFVEFFHVED;
RGWDGFVEFFHVEDL; GWDGFVEFFHVEDLE; WDGFVEFFHVEDLEG;
DGFVEFFHVEDLEGG; GFVEFFHVEDLEGGI; FVEFFHVEDLEGGIR;
VEFFHVEDLEGGIRN; EFFHVEDLEGGIRNV; FFHVEDLEGGIRNVL;
FHVEDLEGGIRNVLL; HVEDLEGGIRNVLLA; VEDLEGGIRNVLLAF;
EDLEGGIRNVLLAFA; DLEGGIRNVLLAFAG; LEGGIRNVLLAFAGV;
EGGIRNVLLAFAGVA; GGIRNVLLAFAGVAG; GIRNVLLAFAGVAGV;
IRNVLLAFAGVAGVG; RNVLLAFAGVAGVGA; NVLLAFAGVAGVGAG;
VLLAFAGVAGVGAGL; LLAFAGVAGVGAGLA; LAFAGVAGVGAGLAY;
AFAGVAGVGAGLAYL; FAGVAGVGAGLAYLI; AGVAGVGAGLAYLIR 16 mers:

MFGLKRNAVIGLNLYC; FGLKRNAVIGLNLYCG; GLKRNAVIGLNLYCGG;
LKRNAVIGLNLYCGGA; KRNAVIGLNLYCGGAG; RNAVIGLNLYCGGAGL;
NAVIGLNLYCGGAGLG; AVIGLNLYCGGAGLGA; VIGLNLYCGGAGLGAG;
IGLNLYCGGAGLGAGS; GLNLYCGGAGLGAGSG; LNLYCGGAGLGAGSGG;
NLYCGGAGLGAGSGGA; LYCGGAGLGAGSGGAT; YCGGAGLGAGSGGATR;
CGGAGLGAGSGGATRP; GGAGLGAGSGGATRPG; GAGLGAGSGGATRPGG;
AGLGAGSGGATRPGGR; GLGAGSGGATRPGGRL; LGAGSGGATRPGGRLL;
GAGSGGATRPGGRLLA; AGSGGATRPGGRLLAT; GSGGATRPGGRLLATE;

TABLE G-continued

Prediction of cancer antigen Mcl-1 specific MHC class 2 peptide sequences. Prediction of 13-, 14-, 15-, 16-mers using the program displayed in FIG. 2.;

SGGATRPGGRLLATEK; GGATRPGGRLLATEKE; GATRPGGRLLATEKEA;
ATRPGGRLLATEKEAS; TRPGGRLLATEKEASA; RPGGRLLATEKEASAR;
PGGRLLATEKEASARR; GGRLLATEKEASARRE; GRLLATEKEASARREI;
RLLATEKEASARREIG; LLATEKEASARREIGG; LATEKEASARREIGGG;
ATEKEASARREIGGGE; TEKEASARREIGGGEA; EKEASARREIGGGEAG;
KEASARREIGGGEAGA; EASARREIGGGEAGAV; ASARREIGGGEAGAVI;
SARREIGGGEAGAVIG; ARREIGGGEAGAVIGG; RREIGGGEAGAVIGGS;
REIGGGEAGAVIGGSA; EIGGGEAGAVIGGSAG; IGGGEAGAVIGGSAGA;
GGGEAGAVIGGSAGAS; GGEAGAVIGGSAGASP; GEAGAVIGGSAGASPP;
EAGAVIGGSAGASPPS; AGAVIGGSAGASPPST; GAVIGGSAGASPPSTL;
AVIGGSAGASPPSTLT; VIGGSAGASPPSTLTP; IGGSAGASPPSTLTPD;
GGSAGASPPSTLTPDS; GSAGASPPSTLTPDSR; SAGASPPSTLTPDSRR;
AGASPPSTLTPDSRRV; GASPPSTLTPDSRRVA; ASPPSTLTPDSRRVAR;
SPPSTLTPDSRRVARP; PPSTLTPDSRRVARPP; PSTLTPDSRRVARPPP;
STLTPDSRRVARPPPI; TLTPDSRRVARPPPIG; LTPDSRRVARPPPIGA;
TPDSRRVARPPPIGAE; PDSRRVARPPPIGAEV; DSRRVARPPPIGAEVP;
SRRVARPPPIGAEVPD; RRVARPPPIGAEVPDV; RVARPPPIGAEVPDVT;
VARPPPIGAEVPDVTA; ARPPPIGAEVPDVTAT; RPPPIGAEVPDVTATP;
PPPIGAEVPDVTATPA; PPIGAEVPDVTATPAR; PIGAEVPDVTATPARL;
IGAEVPDVTATPARLL; GAEVPDVTATPARLLF; AEVPDVTATPARLLFF;
EVPDVTATPARLLFFA; VPDVTATPARLLFFAP; PDVTATPARLLFFAPT;
DVTATPARLLFFAPTR; VTATPARLLFFAPTRR; TATPARLLFFAPTRRA;
ATPARLLFFAPTRRAA; TPARLLFFAPTRRAAP; PARLLFFAPTRRAAPL;
ARLLFFAPTRRAAPLE; RLLFFAPTRRAAPLEE; LLFFAPTRRAAPLEEM;
LFFAPTRRAAPLEEME; FFAPTRRAAPLEEMEA; FAPTRRAAPLEEMEAP;
APTRRAAPLEEMEAPA; PTRRAAPLEEMEAPAA; TRRAAPLEEMEAPAAD;
RRAAPLEEMEAPAADA; RAAPLEEMEAPAADAI; AAPLEEMEAPAADAIM;
APLEEMEAPAADAIMS; PLEEMEAPAADAIMSP; LEEMEAPAADAIMSPE;
EEMEAPAADAIMSPEE; EMEAPAADAIMSPEEE; MEAPAADAIMSPEEEL;
EAPAADAIMSPEEELD; APAADAIMSPEEELDG; PAADAIMSPEEELDGY;
AADAIMSPEEELDGYE; ADAIMSPEEELDGYEP; DAIMSPEEELDGYEPE;
AIMSPEEELDGYEPEP; IMSPEEELDGYEPEPL; MSPEEELDGYEPEPLG;
SPEEELDGYEPEPLGK; PEEELDGYEPEPLGKR; EEELDGYEPEPLGKRP;
EELDGYEPEPLGKRPA; ELDGYEPEPLGKRPAV; LDGYEPEPLGKRPAVL;
DGYEPEPLGKRPAVLP; GYEPEPLGKRPAVLPL; YEPEPLGKRPAVLPLL;
EPEPLGKRPAVLPLLE; PEPLGKRPAVLPLLEL; EPLGKRPAVLPLLELV;
PLGKRPAVLPLLELVG; LGKRPAVLPLLELVGE; GKRPAVLPLLELVGES;
KRPAVLPLLELVGESG; RPAVLPLLELVGESGN; PAVLPLLELVGESGNN;
AVLPLLELVGESGNNT; VLPLLELVGESGNNTS; LPLLELVGESGNNTST;
PLLELVGESGNNTSTD; LLELVGESGNNTSTDG; LELVGESGNNTSTDGS;
ELVGESGNNTSTDGSL; LVGESGNNTSTDGSLP; VGESGNNTSTDGSLPS;
GESGNNTSTDGSLPST; ESGNNTSTDGSLPSTP; SGNNTSTDGSLPSTPP;
GNNTSTDGSLPSTPPP; NNTSTDGSLPSTPPPA; NTSTDGSLPSTPPPAE;
TSTDGSLPSTPPPAEE; STDGSLPSTPPPAEEE; TDGSLPSTPPPAEEEE;
DGSLPSTPPPAEEEED; GSLPSTPPPAEEEEDD; SLPSTPPPAEEEEDDL;
LPSTPPPAEEEEDDLY; PSTPPPAEEEEDDLYR; STPPPAEEEEDDLYRQ;
TPPPAEEEEDDLYRQS; PPPAEEEEDDLYRQSL; PPAEEEEDDLYRQSLE;
PAEEEEDDLYRQSLEI; AEEEEDDLYRQSLEII; EEEEDDLYRQSLEIIS;
EEEDDLYRQSLEIISR; EEDDLYRQSLEIISRY; EDDLYRQSLEIISRYL;
DDLYRQSLEIISRYLR; DLYRQSLEIISRYLRE; LYRQSLEIISRYLREQ;
YRQSLEIISRYLREQA; RQSLEIISRYLREQAT; QSLEIISRYLREQATG;
SLEIISRYLREQATGA; LEIISRYLREQATGAK; EIISRYLREQATGAKD;
IISRYLREQATGAKDT; ISRYLREQATGAKDTK; SRYLREQATGAKDTKP;
RYLREQATGAKDTKPM; YLREQATGAKDTKPMG; LREQATGAKDTKPMGR;
REQATGAKDTKPMGRS; EQATGAKDTKPMGRSG; QATGAKDTKPMGRSGA;
ATGAKDTKPMGRSGAT; TGAKDTKPMGRSGATS; GAKDTKPMGRSGATSR;
AKDTKPMGRSGATSRK; KDTKPMGRSGATSRKA; DTKPMGRSGATSRKAL;
TKPMGRSGATSRKALE; KPMGRSGATSRKALET; PMGRSGATSRKALETL;
MGRSGATSRKALETLR; GRSGATSRKALETLRR; RSGATSRKALETLRRV;
SGATSRKALETLRRVG; GATSRKALETLRRVGD; ATSRKALETLRRVGDG;
TSRKALETLRRVGDGV; SRKALETLRRVGDGVQ; RKALETLRRVGDGVQR;
KALETLRRVGDGVQRN; ALETLRRVGDGVQRNH; LETLRRVGDGVQRNHE;
ETLRRVGDGVQRNHET; TLRRVGDGVQRNHETA; LRRVGDGVQRNHETAF;
RRVGDGVQRNHETAFQ; RVGDGVQRNHETAFQG; VGDGVQRNHETAFQGM;
GDGVQRNHETAFQGML; DGVQRNHETAFQGMLR; GVQRNHETAFQGMLRK;
VQRNHETAFQGMLRKL; QRNHETAFQGMLRKLD; RNHETAFQGMLRKLDI;
NHETAFQGMLRKLDIK; HETAFQGMLRKLDIKN; ETAFQGMLRKLDIKNE;
TAFQGMLRKLDIKNED; AFQGMLRKLDIKNEDD; FQGMLRKLDIKNEDDV;
QGMLRKLDIKNEDDVK; GMLRKLDIKNEDDVKS; MLRKLDIKNEDDVKSL;
LRKLDIKNEDDVKSLS; RKLDIKNEDDVKSLSR; KLDIKNEDDVKSLSRV;
LDIKNEDDVKSLSRVM; DIKNEDDVKSLSRVMI; IKNEDDVKSLSRVMIH;
KNEDDVKSLSRVMIHV; NEDDVKSLSRVMIHVF; EDDVKSLSRVMIHVFS;
DDVKSLSRVMIHVFSD; DVKSLSRVMIHVFSDG; VKSLSRVMIHVFSDGV;
KSLSRVMIHVFSDGVT; SLSRVMIHVFSDGVTN; LSRVMIHVFSDGVTNW;
SRVMIHVFSDGVTNWG; RVMIHVFSDGVTNWGR; VMIHVFSDGVTNWGRI;
MIHVFSDGVTNWGRIV; IHVFSDGVTNWGRIVT; HVFSDGVTNWGRIVTL;

TABLE G-continued

Prediction of cancer antigen Mcl-1 specific MHC class 2
peptide sequences. Prediction of 13-, 14-, 15-, 16-mers using
the program displayed in FIG. 2.;

VFSDGVTNWGRIVTLI; FSDGVTNWGRIVTLIS; SDGVTNWGRIVTLISF;
DGVTNWGRIVTLISFG; GVTNWGRIVTLISFGA; VTNWGRIVTLISFGAF;
TNWGRIVTLISFGAFV; NWGRIVTLISFGAFVA; WGRIVTLISFGAFVAK;
GRIVTLISFGAFVAKH; RIVTLISFGAFVAKHL; IVTLISFGAFVAKHLK;
VTLISFGAFVAKHLKT; TLISFGAFVAKHLKTI; LISFGAFVAKHLKTIN;
ISFGAFVAKHLKTINQ; SFGAFVAKHLKTINQE; FGAFVAKHLKTINQES;
GAFVAKHLKTINQESC; AFVAKHLKTINQESCI; FVAKHLKTINQESCIE;
VAKHLKTINQESCIEP; AKHLKTINQESCIEPL; KHLKTINQESCIEPLA;
HLKTINQESCIEPLAE; LKTINQESCIEPLAES; KTINQESCIEPLAESI;
TINQESCIEPLAESIT; INQESCIEPLAESITD; NQESCIEPLAESITDV;
QESCIEPLAESITDVL; ESCIEPLAESITDVLV; SCIEPLAESITDVLVR;
CIEPLAESITDVLVRT; IEPLAESITDVLVRTK; EPLAESITDVLVRTKR;
PLAESITDVLVRTKRD; LAESITDVLVRTKRDW; AESITDVLVRTKRDWL;
ESITDVLVRTKRDWLV; SITDVLVRTKRDWLVK; ITDVLVRTKRDWLVKQ;
TDVLVRTKRDWLVKQR; DVLVRTKRDWLVKQRG; VLVRTKRDWLVKQRGW;
LVRTKRDWLVKQRGWD; VRTKRDWLVKQRGWDG; RTKRDWLVKQRGWDGF;
TKRDWLVKQRGWDGFV; KRDWLVKQRGWDGFVE; RDWLVKQRGWDGFVEF;
DWLVKQRGWDGFVEFF; WLVKQRGWDGFVEFFH; LVKQRGWDGFVEFFHV;
VKQRGWDGFVEFFHVE; KQRGWDGFVEFFHVED; QRGWDGFVEFFHVEDL;
RGWDGFVEFFHVEDLE; GWDGFVEFFHVEDLEG; WDGFVEFFHVEDLEGG;
DGFVEFFHVEDLEGGI; GFVEFFHVEDLEGGIR; FVEFFHVEDLEGGIRN;
VEFFHVEDLEGGIRNV; EFFHVEDLEGGIRNVL; FFHVEDLEGGIRNVLL;
FHVEDLEGGIRNVLLA; HVEDLEGGIRNVLLAF; VEDLEGGIRNVLLAFA;
EDLEGGIRNVLLAFAG; DLEGGIRNVLLAFAGV; LEGGIRNVLLAFAGVA;
EGGIRNVLLAFAGVAG; GGIRNVLLAFAGVAGV; GIRNVLLAFAGVAGVG;
IRNVLLAFAGVAGVGA; RNVLLAFAGVAGVGAG; NVLLAFAGVAGVGAGL;
VLLAFAGVAGVGAGLA; LLAFAGVAGVGAGLAY; LAFAGVAGVGAGLAYL;
AFAGVAGVGAGLAYLI; FAGVAGVGAGLAYLIR

SEQ ID NOS: 48181-49526

The one or more antigenic peptides can in one embodiment comprise a fragment of one or more BK virus antigens.

The one or more BK virus antigens can be selected from Table H.

TABLE H

Protein designation and accession numbers for the proteins encoded by the
BK virus genome. The amino acid sequence of each protein is displayed.

| BK virus protein accession data | Amino acid sequence |
|---|---|
| >gi\|118752\|sp\|P14998\|DNBI_POVBA DNA-binding protein (Agnoprotein) | MFCEPKNLVVLRQLSRQASVKVGKTWTGTKKRAQRIFIFILELL LEFCRGEDSVDGKNKSTTALPAVKDSVKDS |
| >gi\|135313\|sp\|P15000\|TASM_POVBA Small T antigen | MDKVLNREESMELMDLLGLERAAWGNLPLMRKAYLKKCKEFHPD KGGDEDKMKRMNTLYKKMEQDVKVAHQPDFGTWNSSEVCADFPL CPDTLYCKEWPICSKKPSVHCPCMLCQLRLRHLNRKFLRKEPLV WIDCYCIDCFTQWFGLDLTEETLQWWVQIIGETPFRDLKL |
| >gi\|135279\|sp\|P14999\|TALA_POVBA Large T antigen | MDKVLNREESMELMDLLGLERAAWGNLPLMRKAYLKKCKEFHPD KGGDEDKMKRMNTLYKKMEQDVKVAHQPDFGTWNSSEVPTYGTE EWESWWSSFNEKWDEDLFCHEDMFASDEEATADSQHSTPPKKKR KVEDPKDFPSDLHQFLSQAVFSNRTLACFAVYTTKEKAQILYKK LMEKYSVTFISRHMCAGHNIIFFLTPHRHRVSAINNFCQKLCTF SFLICKGVNKEYLLYSALTRDPYHIIEESIQGGLKEHDFNPEEP EETKQVSWKLITEYAVETKCEDVFLLLGMYLEFQYNVEECKKCQ KKDQPYHFKYHEKHFANAIIFAESKNQKSICQQAVDTVLAKKRV DTLHMTREEMLTERFNHILDKMDLIFGAHGNAVLEQYMAGVAWL HCLLPKMDSVIFDFLHCVVFNVPKRRYWLFKGPIDSGKTTLAAG LLDLCGGKALNVNLPMERLTFELGVAIDQYMVVFEDVKGTGAES KDLPSGHGINNLDSLRDYLDGSVKVNLEKKHLNKRTQIFPPGLV TMNEYPVPKTLQARFVRQIDFRPKIYLRKSLQNSEFLLEKRILQ SGMTLLLLLIWFRPVADFSKDIQSRIVEWKERLDSEISMYTFSR MKYNICMGKCILDITREEDSETEDSGHGSSTESQSQCSSQVSDT SAPDSENPHSQELHLCKGFQCFKRPKTPPPK |
| >gi\|116622\|sp\|P14996\|COA1_POVBA Coat protein VP1 | MAPTKRKGECPGAAPKKPKEPVQVPKLLIKGGVEVLEVKTGVDA ITEVECFLNPEMGDPDDNLRGYSQHLSAENAFESDSPDRKMLPC YSTARIPLPNLNEDLTCGNLLMWEAVTVKTEVIGITSMLNLHAG SQKVHENGGGKPVQGSNFHFFAVGGDPLEMQGVLMNYRTKYPQG TITPKNPTAQSQVMNTDHKAYLDKNNAYPVECWIPDPSRNENTR |

TABLE H-continued

Protein designation and accession numbers for the proteins encoded by the BK virus genome. The amino acid sequence of each protein is displayed.

| BK virus protein accession data | Amino acid sequence |
|---|---|
| | YFGTYTGGENVPPVLHVTNTATTVLLDEQGVGPLCKADSLYVSA ADICGLFTNSSGTQQWRGLARYFKIRLRKRSVKNPYPISFLLSD LINRRTQKVDGQPMYGMESQVEEVRVFDGTEQLPGDPDMIRYID RQGQLQTKMV |
| >gi\|116641\|sp\|P14997\|COA2_POVBA Coat protein VP2/VP3 | MGAALALLGDLVASVSEAAAATGFSVAEIAAGEAAAAIEVQIAS LATVEGITTTSEAIAAIGLTPQTYAVIAGAPGAIAGFAALIQTV TGISSLAQVGYRFFSDWDHKVSTVGLYQQSGMALELFNPDEYYD ILFPGVNTFVNNIQYLDPRHWGPSLFATISQALWHVIRDDIPAI TSQELQRRTERFFRDSLARFLEETTWTIVNAPINFYNYIQDYYS NLSPIRPSMVRQVAEREGTHVNFGHTYSIDNADSIEEVTQRMDL RNKESVHSGEFIEKTIAPGGANQRTAPQWMLPLLLGLYGTVTPA LEAYEDGPNQKKRRVSRGSSQKAKGTRASAKTTNKRRSRSSRS MAHAGRTGYDNREIVMKYIHYKLSQRGYEWDAGDVGAAPPGAAP APGIFSSQPGHTPHPAASRDPVARTS PLQTPAAPGAAAGPALSPVPPVVHLTLRQAGDDFSRRYRRDFAE MSSQLHLTPFTARGRFATVVEELFRD GVNWGRIVAFFEFGGVMCVESVNREMSPLVDNIALWMTEYLNRH LHTWIQDNGGWDAFVELYGPSMRPLF DFSWLSLKTLLSLALVGACITLGAYLGHK |

SEQ ID NOS: 1-6

Preferred BK virus fragments capable of interacting with one or more MHC class 1 molecules are listed in Table I.

TABLE I

Predicted MHC class 1 BK virus peptide sequences. Prediction of 8-, 9-, 10-, 11-mers from all 6 reading frames of the genome (access no #V01108) obtained using the program displayed in FIG. 2.

BK virus reading frame 1

8 mers:

FCKNCKRI; CKNCKRIG; KNCKRIGI; NCKRIGIS; CKRIGISP; KRIGISPN; RIGISPNS; IGISPNSF; GISPNSFA; ISPNSFAR; SPNSFARP; PNSFARPQ; NSFARPQK; SFARPQKK; FARPQKKP; ARPQKKPP; RPQKKPPH; PQKKPPHP; QKKPPHPY; KKPPHPYY; KPPHPYYL; PPHPYYLR; PHPYYLRE; HPYYLRER; PYYLRERV; YYLRERVE; YLRERVEA; LRERVEAE; RERVEAEA; ERVEAEAA; RVEAEAAS; VEAEAASA; EAEAASAS; AEAASASY; EAASASYI; AASASYIL; KKRPQGGA; KRPQGGAA; RPQGGAAY; PQGGAAYP; QGGAAYPW; GGAAYPWN; GAAYPWNA; AAYPWNAA; AYPWNAAK; YPWNAAKP; PQEGKCMT; QEGKCMTH; EGKCMTHR; GKCMTHRG; KCMTHRGM; CMTHRGMQ; MTHRGMQP; THRGMQPN; HRGMQPNH; RGMQPNHD; GMQPNHDL; MQPNHDLR; QPNHDLRK; PNHDLRKE; NHDLRKES; HDLRKESA; LTGRSCLP; TGRSCLPM; GRSCLPME; RSCLPMEC; SCLPMECS; CLPMECSQ; LPMECSQT; PMECSQTM; MECSQTMT; ECSQTMTS; CSQTMTSG; SQTMTSGR; QTMTSGRK; TMTSGRKV; MTSGRKVH; TSGRKVHD; SGRKVHDR; GRKVHDRH; RKVHDRHV; KVHDRHVL; VHDRHVLR; HDRHVLRA; ESWPCPQL; SWPCPQLN; WPCPQLNW; PCPQLNWT; CPQLNWTK; PQLNWTKA; QLNWTKAM; LNWTKAMV; NWTKAMVL; WTKAMVLR; TKAMVLRQ; KAMVLRQL; AMVLRQLS; MVLRQLSR; VLRQLSRQ; LRQLSRQA; RQLSRQAS; QLSRQASV; LSRQASVK; SRQASVKV; RQASVKVG; QASVKVGK; ASVKVGKT; SVKVGKTW; VKVGKTWT; KVGKTWTG; VGKTWTGT; GKTWTGTK; KTWTGTKK; TWTGTKKR; WTGTKKRA; TGTKKRAQ; GTKKRAQR; TKKRAQRI; KKRAQRIF; KRAQRIFI; RAQRIFIF; AQRIFIFI; QRIFIFIL; RIFIFILE; IFIFILEL; FIFILELL; IFILELLL; FILELLLE; ILELLLEF; LELLLEFC; ELLLEFCR; LLLEFCRG; LLEFCRGE; LEFCRGED; EFCRGEDS; FCRGEDSV; CRGEDSVD; RGEDSVDG; GEDSVDGK; EDSVDGKN; DSVDGKNK; SVDGKNKS; VDGKNKST; DGKNKSTT; GKNKSTTA; KNKSTTAL; NKSTTALP; KSTTALPA; STTALPAV; TTALPAVK; TALPAVKD; ALPAVKDS; LPAVKDSV; PAVKDSVK; AVKDSVKD; VKDSVKDS; VSNPFFFV; SNPFFFVF; NPFFFVFP; PFFFVFPG; FFFVFPGS; FFVFPGSW; FVFPGSWV; VFPGSWVL; FPGSWVLL; LPVYLRLL; PVYLRLLL; VYLRLLLP; YLRLLLPQ; LRLLLPQD; RLLLPQDF; LLLPQDFQ; LLPQDFQW; LPQDFQWL; PQDFQWLK; QDFQWLKL; DFQWLKLL; FQWLKLLL; QWLKLLLG; WLKLLLGR; LKLLLGRL; KLLLGRLL; LLLGRLLL; LLGRLLLL; KFKLHPLL; FKLHPLLL; LLVLLGLL; LVLLGLLL; VLLGLLLG; LLGLLLGL; LGLLLGLL; GLLLGLLL; FKLLVVLV; KLLVVLVP; GISSLMIG; ISSLMIGI; SSLMIGIT; SLMIGITK; LMIGITKF; MIGITKFP; IGITKFPL; ASISNQAW; SISNQAWL; ISNQAWLW; SNQAWLWN; NQAWLWNC; QAWLWNCL; AWLWNCLT; WLWNCLTQ; LWNCLTQM; WNCLTQMS; NCLTQMST; CLTQMSTM; LTQMSTMI; TQMSTMIF; QMSTMIFC; MSTMIFCF; STMIFCFL; TMIFCFLV; ILLLIIFN; LLLIIFNT; LLIIFNTL; LIIFNTLI; IIFNTLIL; IFNTLILG; FNTLILGI; NTLILGIG; TLILGIGV; LILGIGVL; ILGIGVLL; LGIGVLLC; GIGVLLCL; IGVLLCLL; GVLLCLLL; VLLCLLLF; LLCLLLFP; LCLLLFPR; CLLLFPRL; LLLFPRLC; LLFPRLCG; LFPRLCGM; FPRLCGML; PRLCGMLL; RLCGMLLG; LCGMLLGM; CGMLLGMI; GMLLGMIY; MLLGMIYL; LLGMIYLL; PHRNCREE; HRNCREEQ; RNCREEQK;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

NCREEQKD; CREEQKDF; REEQKDFL; EEQKDFLE; EQKDFLET; QKDFLETP; KDFLETPW;
DFLETPWL; FLETPWLD; LETPWLDF; ETPWLDFW; TPWLDFWR; PWLDFWRK; WLDFWRKL;
LDFWRKLP; DFWRKLPG; FWRKLPGQ; WRKLPGQL; TFIIIFNN; FIIIFNNI; IIIFNNII;
IIFNNIIL; IFNNIILI; FNNIILIF; NNIILIFP; NIILIFPL; IILIFPLL; ILIFPLLG;
LIFPLLGP; IFPLLGPQ; FPLLGPQW; PLLGPQWL; LLGPQWLD; LGPQWLDK; LGKVPVY;
KGKVPVYI; GKVPVYIL; KVPVYILA; VPVYILAI; PVYILAIL; VYILAILI; YILAILIV;
KKLHKEWT; EINKVYIQ; INKVYIQE; NKVYIQES; KVYIQESL; KKLLPQEV; KLLPQEVL;
LLPQEVLI; LPQEVLIK; PQEVLIKE; QEVLIKEL; EVLIKELL; VLIKELLL; LIKELLLN;
IKELLLNG; KELLLNGC; ELLLNGCC; LLLNGCCL; LLNGCCLY; LNGCCLYF; HLLLKHMK;
LLLKHMKM; LLKHMKMA; LKHMKMAP; KHMKMAPT; HMKMAPTK; MKMAPTKR; KMAPTKRK;
MAPTKRKG; APTKRKGE; PTKRKGEC; TKRKGECP; KRKGECPG; RKGECPGA; KGECPGAA;
GECPGAAP; ECPGAAPK; CPGAAPKK; PGAAPKKP; GAAPKKPK; AAPKKPKE; APKKPKEP;
PKKPKEPV; KKPKEPVQ; KPKEPVQV; PKEPVQVP; KEPVQVPK; EPVQVPKL; PVQVPKLL;
VQVPKLLI; QVPKLLIK; VPKLLIKG; PKLLIKGG; KLLIKGGV; LLIKGGVE; LIKGGVEV;
IKGGVEVL; KGGVEVLE; GGVEVLEV; GVEVLEVK; VEVLEVKT; EVLEVKTG; VLEVKTGV;
LEVKTGVD; EVKTGVDA; VKTGVDAI; KTGVDAIT; TGVDAITE; GVDAITEV; VDAITEVE;
DAITEVEC; AITEVECF; ITEVECFL; TEVECFLN; EVECFLNP; VECFLNPE; ECFLNPEM;
CFLNPEMG; FLNPEMGD; LNPEMGDP; NPEMGDPD; PEMGDPDE; EMGDPDEN; MGDPDENL;
GDPDENLR; DPDENLRG; PDENLRGF; DENLRGFS; ENLRGFSL; NLRGFSLK; LRGFSLKL;
RGFSLKLS; GFSLKLSA; FSLKLSAE; SLKLSAEN; LKLSAEND; KLSAENDF; LSAENDFS;
SAENDFSS; AENDFSSD; ENDFSSDS; NDFSSDSP; DFSSDSPE; FSSDSPER; SSDSPERK;
SDSPERKM; DSPERKML; SPERKMLP; PERKMLPC; ERKMLPCY; RKMLPCYS; KMLPCYST;
MLPCYSTA; LPCYSTAR; PCYSTARI; CYSTARIP; YSTARIPL; STARIPLP; TARIPLPN;
ARIPLPNL; RIPLPNLN; IPLPNLNE; PLPNLNED; LPNLNEDL; PNLNEDLT; NLNEDLTC;
LNEDLTCG; NEDLTCGN; EDLTCGNL; DLTCGNLL; LTCGNLLM; TCGNLLMW; CGNLLMWE;
GNLLMWEA; NLLMWEAV; LLMWEAVT; LMWEAVTV; MWEAVTVQ; WEAVTVQT; EAVTVQTE;
AVTVQTEV; VTVQTEVI; TVQTEVIG; VQTEVIGI; QTEVIGIT; TEVIGITS; EVIGITSM;
VIGITSML; IGITSMLN; GITSMLNL; ITSMLNLH; TSMLNLHA; SMLNLHAG; MLNLHAGS;
LNLHAGSQ; NLHAGSQK; LHAGSQKV; HAGSQKVH; AGSQKVHE; GSQKVHEH; SQKVHEHG;
QKVHEHGG; KVHEHGGG; VHEHGGGK; HEHGGGKP; EHGGGKPI; HGGGKPIQ; GGGKPIQG;
GGKPIQGS; GKPIQGSN; KPIQGSNF; PIQGSNFH; IQGSNFHF; QGSNFHFF; GSNFHFFA;
SNFHFFAV; NFHFFAVG; FHFFAVGG; HFFAVGGE; FFAVGGEP; FAVGGEPL; AVGGEPLE;
VGGEPLEM; GGEPLEMQ; GEPLEMQG; EPLEMQGV; PLEMQGVL; LEMQGVLM; EMQGVLMN;
MQGVLMNY; QGVLMNYR; GVLMNYRS; VLMNYRSK; LMNYRSKY; MNYRSKYP; NYRSKYPD;
YRSKYPDG; RSKYPDGT; SKYPDGTI; KYPDGTIT; YPDGTITP; PDGTITPK; DGTITPKN;
GTITPKNP; TITPKNPT; ITPKNPTA; TPKNPTAQ; PKNPTAQS; KNPTAQSQ; NPTAQSQV;
PTAQSQVM; TAQSQVMN; AQSQVMNT; QSQVMNTD; SQVMNTDH; QVMNTDHK; VMNTDHKA;
MNTDHKAY; NTDHKAYL; TDHKAYLD; DHKAYLDK; HKAYLDKN; KAYLDKNN; AYLDKNNA;
YLDKNNAY; LDKNNAYP; DKNNAYPV; KNNAYPVE; NNAYPVEC; NAYPVECW; AYPVECWV;
YPVECWVP; PVECWVPD; VECWVPDP; ECWVPDPS; CWVPDPSR; WVPDPSRN; VPDPSRNE;
PDPSRNEN; DPSRNENA; PSRNENAR; SRNENARY; RNENARYF; NENARYFG; ENARYFGT;
NARYFGTF; ARYFGTFT; RYFGTFTG; YFGTFTGG; FGTFTGGE; GTFTGGEN; TFTGGENV;
FTGGENVP; TGGENVPP; GGENVPPV; GENVPPVL; ENVPPVLH; NVPPVLHV; VPPVLHVT;
PPVLHVTN; PVLHVTNT; VLHVTNTA; LHVTNTAT; HVTNTATT; VTNTATTV; TNTATTVL;
NTATTVLL; TATTVLLD; ATTVLLDE; TTVLLDEQ; TVLLDEQG; VLLDEQGV; LLDEQGVG;
LDEQGVGP; DEQGVGPL; EQGVGPLC; QGVGPLCK; GVGPLCKA; VGPLCKAD; GPLCKADS;
PLCKADSL; LCKADSLY; CKADSLYV; KADSLYVS; ADSLYVSA; DSLYVSAA; SLYVSAAD;
LYVSAADI; YVSAADIC; VSAADICG; SAADICGL; AADICGLF; ADICGLFT; DICGLFTN;
ICGLFTNS; CGLFTNSS; GLFTNSSG; LFTNSSGT; FTNSSGTQ; TNSSGTQQ; NSSGTQQW;
SSGTQQWR; SGTQQWRG; GTQQWRGL; TQQWRGLA; QQWRGLAR; QWRGLARY; WRGLARYF;
RGLARYFK; GLARYFKI; LARYFKIR; ARYFKIRL; RYFKIRLR; YFKIRLRK; FKIRLRKR;
KIRLRKRS; IRLRKRSV; RLRKRSVK; LRKRSVKN; RKRSVKNP; KRSVKNPY; RSVKNPYP;
SVKNPYPI; VKNPYPIS; KNPYPISF; NPYPISFL; PYPISFLL; YPISFLLS; PISFLLSD;
ISFLLSDL; SFLLSDLI; FLLSDLIN; LLSDLINR; LSDLINRR; SDLINRRT; DLINRRTQ;
LINRRTQR; INRRTQRV; NRRTQRVD; RRTQRVDG; RTQRVDGQ; TQRVDGQP; QRVDGQPM;
RVDGQPMY; VDGQPMYG; DGQPMYGM; GQPMYGME; QPMYGMES; PMYGMESQ; MYGMESQV;
YGMESQVE; GMESQVEE; MESQVEEV; ESQVEEVR; SQVEEVRV; QVEEVRVF; VEEVRVFD;
EEVRVFDG; EVRVFDGT; VRVFDGTE; RVFDGTER; VFDGTERL; FDGTERLP; DGTERLPG;
GTERLPGD; TERLPGDP; ERLPGDPD; RLPGDPDM; LPGDPDMI; PGDPDMIR; GDPDMIRY;
DPDMIRYI; PDMIRYID; DMIRYIDK; MIRYIDKQ; IRYIDKQG; RYIDKQGQ; YIDKQGQL;
IDKQGQLQ; DKQGQLQT; KQGQLQTK; QGQLQTKM; GQLQTKML; TGAFIVHI; GAFIVHIH;
AFIVHIHL; FIVHIHLI; IVHIHLIN; VHIHLINA; HIHLINAA; IHLINAAF; HLINAAFV;
ATFKLVLF; TFKLVLFW; FKLVLFWG; KLVLFWGW; LVLFWGWC; VLFWGWCF; LFWGWCFR;
FWGWCFRP; WGWCFRPF; GWCFRPFK; WCFRPFKT; CFRPFKTL; FRPFKTLK; RPFKTLKA;
PFKTLKAF; FKTLKAFT; KTLKAFTQ; TLKAFTQM; LKAFTQMQ; KAFTQMQL; AFTQMQLL;
FTQMQLLT; TQMQLLTM; QMQLLTMG; MQLLTMGV; PLGIFSRG; SMSRVFSF; ILFSCNIK;
LFSCNIKN; FSCNIKNT; SCNIKNTF; CNIKNTFP; NIKNTFPH; IKNTFPHA; KNTFPHAY;
NTFPHAYI; TFPHAYII; FPHAYIIF; PHAYIIFH; HAYIIFHP; KSIHTYLR; SIHTYLRI;
IHTYLRIQ; HTYLRIQP; TYLRIQPF; YLRIQPFL; LRIQPFLP; RIQPFLPF; IQPFLPFN;
QPFLPFNN; PFLPFNNS; FLPFNNSR; LPFNNSRL; PFNNSRLY; FNNSRLYI; NNSRLYIS;
NSRLYISC; SRLYISCK; RLYISCKI; LYISCKIS; YISCKISY; ISCKISYR; SCKISYRP;
CKISYRPK; KISYRPKP; ISYRPKPN; IYFGPKIY; YFGPKIYL; FGPKIYLS; GPKIYLSY;
PKIYLSYK; KIYLSYKS; IYLSYKSS; YLSYKSSL; LSYKSSLQ; SYKSSLQG; YKSSLQGF;
KSSLQGFR; SSLQGFRD; SLQGFRDR; LQGFRDRI; QGFRDRIL; GFRDRILI; FRDRILIH;
RDRILIHC; DRILIHCN; RILIHCNQ; ILIHCNQA; LIHCNQAW; IHCNQAWW; HCNQAWWK;
CNQAWWKY; NQAWWKYL; QAWWKYLG; AWWKYLGS; WWKYLGSF; WKYLGSFV; FSSCPFYI;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

SSCPFYIF; SCPFYIFK; CPFYIFKN; PFYIFKNN; FYIFKNNH; YIFKNNHV; IFKNNHVL;
FKNNHVLI; KNNHVLIY; NNHVLIYS; NHVLIYSY; HVLIYSYT; CCFSTING; CFSTINGT;
FSTINGTF; STINGTFK; PVSSFRYI; VSSFRYIE; SSFRYIEN; SFRYIENN; FRYIENNT;
RYIENNTV; YIENNTVQ; IENNTVQK; ENNTVQKI; NNTVQKIK; NTVQKIKY; TVQKIKYY;
VQKIKYYR; QKIKYYRI; KIKYYRIH; IKYYRIHF; KYYRIHFR; QTVQPSNT; TVQPSNTC;
VQPSNTCH; QPSNTCHI; PSNTCHIL; SNTCHILF; YSISMSSK; SISMSSKY; HFFPGHMK;
FFPGHMKG; FPGHMKGI; PGHMKGIY; GHMKGIYS; HMKGIYSF; MKGIYSFF; KGIYSFFS;
NCIYCLLT; CIYCLLTN; IYCLLTNT; YCLLTNTF; CLLTNTFL; LLTNTFLI; LTNTFLIF;
TNTFLIFT; NTFLIFTF; TFLIFTFC; FLIFTFCK; LIFTFCKN; IFTFCKNN; FTFCKNNS;
TFCKNNSI; FCKNNSIC; CKNNSICK; KNNSICKV; NNSICKVL; NSICKVLF; SICKVLFM;
ICKVLFMI; CKVLFMIL; KVLFMILK; VLFMILKV; LFMILKVI; FMILKVIR; MILKVIRL;
ILKVIRLV; LKVIRLVF; KVIRLVFF; VIRLVFFL; IRLVFFLT; RLVFFLTL; LVFFLTLF;
VFFLTLFT; FFLTLFTL; FLTLFTLL; LTLFTLLY; TLFTLLYI; FTLLYIVL;
TLLYIVLK; LLYIVLKF; KHILTLCL; HILTLCLY; ILTLCLYC; LTLCLYCI; TLCLYCIL;
LCLYCILS; CLYCILSN; FPRHLLCF; PRHLLCFF; RHLLCFFR; HLLCFFRL; LLCFFRLF;
LCFFRLFW; CFFRLFWA; FFRLFWAK; FRLFWAKI; RLFWAKIM; LFWAKIML; FWAKIMLL;
APLNAFFY; PLNAFFYS; LNAFFYSM; NAFFYSMV; AFFYSMVW; FFYSMVWI; FYSMVWIS;
YSMVWISS; VFLINTLT; FLINTLTN; KTKGTQLL; TKGTQLLT; KGTQLLTE; GTQLLTEI;
TQLLTEII; QLLTEIIN; LLTEIINC; LTEIINCR; TEIINCRN; EIINCRNS; IINCRNSM;
INCRNSMS; NCRNSMSM; CRNSMSMW; RNSMSMWS; KEYNIMPS; EYNIMPST; YNIMPSTH;
NIMPSTHV; IMPSTHVS; MPSTHVST; PSTHVSTN; STHVSTNK; THVSTNKS; HVSTNKSY;
VSTNKSYR; STNKSYRI; TNKSYRIF; NKSYRIFF; KSYRIFFH; SYRIFFHK; YRIFFHKF;
RIFFHKFF; IFFHKFFI; FFHKFFIQ; PHKFFIQN; HKFFIQNL; KFFIQNLS; FFIQNLSF;
FIQNLSFF; IQNLSFFF; QNLSFFFS; NLSFFFSS; LSFFFSSI; SFFFSSIH; FFFSSIHS;
FFSSIHSK; FSSIHSKA; SSIHSKAG; SIHSKAGK; IHSKAGKG; HSKAGKGS; SKAGKGSI;
KAGKGSIT; AGKGSITK; GKGSITKY; KGSITKYS; GSITKYSL; SITKYSLT; ITKYSLTK;
TKYSLTKK; KYSLTKKL; YSLTKKLV; IRGKVFRV; RGKVFRVF; GKVFRVFY; KVFRVFYL;
VFRVFYLS; FRVFYLSF; RVFYLSFF; VFYLSFFF; FYLSFFFG; YLSFFFGW; LSFFFGWC;
VLRICCCF; LRICCCFF; RICCCFFI; ICCCFFIT; CCCFFITG; CCFFITGK; CFFITGKH;
FFITGKHI; FITGKHIF; ITGKHIFM; TGKHIFMA; GKHIFMAK; IPIPFFIK; FIPFFIKG;
IPFFIKGT; PFFIKGTP; FFIKGTPP; FIKGTPPG; IKGTPPGL; KGTPPGLP; GTPPGLPL;
TPPGLPLF; PPGLPLFC; PGLPLFCS; GLPLFCSI; LPLFCSIG; PLFCSIGW; LFCSIGWH;
FCSIGWHL; YPIIYLNI; FIIYLNIS; SFRSLKGV; FRSLKGVS; RSLKGVSP; SLKGVSPI;
LKGVSPII; KGVSPIIW; GVSPIIWT; VSPIIWTH; SPIIWTHH; PIIWTHHC; IIWTHHCV;
IWTHHCRV; WTHHCRVS; THHCRVSS; HHCRVSSV; HCRVSSVR; CRVSSVRS; RVSSVRSK;
VSSVRSKP; SSVRSKPN; SVRSKPNH; VRSKPNHC; RSKPNHCV; SKPNHCVK; KPNHCVKQ;
PNHCVKQS; NHCVKQSM; HCVKQSMQ; QSIQTKGS; SIQTKGSF; IQTKGSFL; QTKGSFLK;
TKGSFLKN; KGSFLKNF; GSFLKNFL; SFLKNFLF; FLKNFLFK; LKNFLFKC; KNFLFKCL;
NFLFKCLN; FLFKCLNL; LFKCLNLS; HSMQGCT; SMQGCTE; MQGCTEG; QGCTEGF;
GQCTEGFL; QCTEGFLE; CTEGFLEQ; TEGFLEQI; EGFLEQIG; GFLEQIGH; FLEQIGHS;
LEQIGHSL; EQIGHSLQ; QIGHSLQY; IGHSLQYR; GHSLQYRV; HSLQYRVS; SLQYRVSG;
LQYRVSGQ; QYRVSGQR; YRVSGQRG; RVSGQRGK; VSGQRGKS; SGQRGKSA; GQRGKSAQ;
QRGKSAQT; RGKSAQTS; GKSAQTSE; KSAQTSEL; SAQTSELL; AQTSELLQ; QTSELLQV;
TSELLQVP; SELLQVPK; ELLQVPKS; LLQVPKSG; ATFTSCSI; TFTSCSIF; FTSCSIFL;
TSCSIFLY; SCSIFLYK; CSIFLYKV; SIFLYKVF; IFLYKVFI; FLYKVFIL; LYKVFILF;
YKVFILFI; KVFILFIL; VFILFILS; FILFILSS; ILFILSSS; LFILSSSP; FILSSSPP;
ILSSSPPL; LSSSPPLS; SSSPPLSG; AFLIKGRF; FLIKGRFP; LIKGRFPQ; IKGRFPQA;
KGRFPQAA; GRFPQAAL; RFPQAALS; FPQAALSR; PQAALSRP; QAALSRPK; AALSRPKR;
ALSRPKRS; LSRPKRSM; SRPKRSMS; RPKRSMSS; PKRSMSSM; KRSMSSMD; RSMSSMDS;
SMSSMDSS; MSSMDSSL; SSMDSSLL; SMDSSLLR; MDSSLLRT; DSSLLRTL; SSLLRTLS 9 mers:

FCKNCKRIG; CKNCKRIGI; KNCKRIGIS; NCKRIGISP; CKRIGISPN; KRIGISPNS;
RIGISPNSF; IGISPNSFA; GISPNSFAR; ISPNSFARP; SPNSFARPQ; PNSFARPQK;
NSFARPQKK; SFARPQKKP; FARPQKKPP; ARPQKKPPH; RPQKKPPHP; PQKKPPHPY;
QKKPPHPYY; KKPPHPYYL; KPPHPYYLR; PPHPYYLRE; PHPYYLRER; HPYYLRERV;
PYYLRERVE; YYLRERVEA; YLRERVEAE; LRERVEAEA; RERVEAEAA; ERVEAEAAS;
RVEAEAASA; VEAEAASAS; EAEAASASY; AEAASASYI; EAASASYIL; KKRPQGGAA;
KRPQGGAAY; RPQGGAAYP; PQGGAAYPW; QGGAAYPWN; GGAAYPWNA; GAAYPWNAA;
AAYPWNAAK; AYPWNAAKP; PQEGKCMTH; QEGKCMTHR; EGKCMTHRG; GKCMTHRGM;
KCMTHRGMQ; CMTHRGMQP; MTHRGMQPN; THRGMQPNH; HRGMQPNHD; RGMQPNHDL;
GMQPNHDLR; MQPNHDLRK; QPNHDLRKE; PNHDLRKES; NHDLRKESA; LTGRSCLPM;
TGRSCLPME; GRSCLPMEC; RSCLPMECS; SCLPMECSQ; CLPMECSQT; LPMECSQTM;
PMECSQTMT; MECSQTMTS; ECSQTMTSG; CSQTMTSGR; SQTMTSGRK; QTMTSGRKV;
TMTSGRKVH; MTSGRKVHD; TSGRKVHDR; SGRKVHDRH; GRKVHDRHV; RKVHDRHVL;
KVHDRHVLR; VHDRHVLRA; ESWPCPQLN; SWPCPQLNW; WPCPQLNWT; PCPQLNWTK;
CPQLNWTKA; PQLNWTKAM; QLNWTKAMV; LNWTKAMVL; NWTKAMVLR; WTKAMVLRQ;
TKAMVLRQL; KAMVLRQLS; AMVLRQLSR; MVLRQLSRQ; VLRQLSRQA; LRQLSRQAS;
RQLSRQASV; QLSRQASVK; LSRQASVKV; SRQASVKVG; RQASVKVGK; QASVKVGKT;
ASVKVGKTW; SVKVGKTWT; VKVGKTWTG; KVGKTWTGT; VGKTWTGTK; GKTWTGTKK;
KTWTGTKKR; TWTGTKKRA; WTGTKKRAQ; TGTKKRAQR; GTKKRAQRI; TKKRAQRIF;
KKRAQRIFI; KRAQRIFIF; RAQRIFIFI; AQRIFIFIL; QRIFIFILE; RIFIFILEL;
IFIFILELL; FIFILELLL; IFILELLLE; FILELLLEF; ILELLLEFC; LELLLEFCR;
ELLLEFCRG; LLLEFCRGE; LLEFCRGED; LEFCRGEDS; EFCRGEDSV; FCRGEDSVD;
CRGEDSVDG; RGEDSVDGK; GEDSVDGKN; EDSVDGKNK; DSVDGKNKS; SVDGKNKST;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

VDGKNKSTT; DGKNKSTTA; GKNKSTTAL; KNKSTTALP; NKSTTALPA; KSTTALPAV;
STTALPAVK; TTALPAVKD; TALPAVKDS; ALPAVKDSV; LPAVKDSVK; PAVKDSVKD;
AVKDSVKDS; VSNPFFFVF; SNPFFFVFP; NPFFFVFPG; PFFFVFPGS; FFFVFPGSW;
FFVFPGSWV; FVFPGSWVL; VFPGSWVLL; LPVYLRLLL; PVYLRLLLP; VYLRLLLPQ;
YLRLLLPQD; LRLLLPQDF; RLLLPQDFQ; LLLPQDFQW; LLPQDFQWL; LPQDFQWLK;
PQDFQWLKL; QDFQWLKLL; DFQWLKLLL; FQWLKLLLG; QWLKLLLGR; WLKLLLGRL;
LKLLLGRLL; KLLLGRLLL; LLLGRLLLL; KFKLHPLLL; LLVLLGLLL; LVLLGLLLG;
VLLGLLLGL; LLGLLLGLL; LGLLLGLLL; FKLLVVLVP; GISSLMIGI; ISSLMIGIT;
SSLMIGITK; SLMIGITKF; LMIGITKFP; MIGITKFPL; ASISNQAWL; SISNQAWLW;
ISNQAWLWN; SNQAWLWNC; NQAWLWNCL; QAWLWNCLT; AWLWNCLTQ; WLWNCLTQM;
LWNCLTQMS; WNCLTQMST; NCLTQMSTM; CLTQMSTMI; LTQMSTMIF; TQMSTMIFC;
QMSTMIFCF; MSTMIFCFL; STMIFCFLV; ILLLIIFNT; LLLIIFNTL; LLIIFNTLI;
LIIFNTLIL; IIFNTLILG; IFNTLILGI; FNTLILGIG; NTLILGIGV; TLILGIGVL;
LILGIGVLL; ILGIGVLLC; LGIGVLLCL; GIGVLLCLL; IGVLLCLLL; GVLLCLLLF;
VLLCLLLFP; LLCLLLFPR; LCLLLFPRL; CLLLFPRLC; LLLFPRLCG; LLFPRLCGM;
LFPRLCGML; FPRLCGMLL; PRLCGMLLG; RLCGMLLGM; LCGMLLGMI; CGMLLGMIY;
GMLLGMIYL; MLLGMIYLL; PHRNCREEQ; HRNCREEQK; RNCREEQKD; NCREEQKDF;
CREEQKDFL; REEQKDFLE; EEQKDFLET; EQKDFLETP; QKDFLETPW; KDFLETPWL;
DFLETPWLD; FLETPWLDF; LETPWLDFW; ETPWLDFWR; TPWLDFWRK; PWLDFWRKL;
WLDFWRKLP; LDFWRKLPG; DFWRKLPGQ; FWRKLPGQL; TFIIIFNNI; FIIIFNNII;
IIIFNNIIL; IIFNNIILI; IFNNIILIF; FNNIILIFP; NNIILIFPL; NIILIFPLL;
IILIFPLLG; ILIFPLLGP; LIFPLLGPQ; IFPLLGPQW; FPLLGPQWL; PLLGPQWLD;
LLGPQWLDK; LKGKVPVYI; KGKVPVYIL; GKVPVYILA; KVPVYILAI; VPVYILAIL;
PVYILAILI; VYILAILIV; EINKVYIQE; INKVYIQES; NKVYIQESL; KKLLPQEVL;
KLLPQEVLI; LLPQEVLIK; LPQEVLIKE; PQEVLIKEL; QEVLIKELL; EVLIKELLL;
VLIKELLLN; LIKELLLNG; IKELLLNGC; KELLLNGCC; ELLLNGCCL; LLLNGCCLY;
LLNGCCLYF; HLLLKHMKM; LLLKHMKMA; LLKHMKMAP; LKHMKMAPT; KHMKMAPTK;
HMKMAPTKR; MKMAPTKRK; KMAPTKRKG; MAPTKRKGE; APTKRKGEC; PTKRKGECP;
TKRKGECPG; KRKGECPGA; RKGECPGAA; KGECPGAAP; GECPGAAPK; ECPGAAPKK;
CPGAAPKKP; PGAAPKKPK; GAAPKKPKE; AAPKKPKEP; APKKPKEPV; PKKPKEPVQ;
KKPKEPVQV; KPKEPVQVP; PKEPVQVPK; KEPVQVPKL; EPVQVPKLL; PVQVPKLLI;
VQVPKLLIK; QVPKLLIKG; VPKLLIKGG; PKLLIKGGV; KLLIKGGVE; LLIKGGVEV;
LIKGGVEVL; IKGGVEVLE; KGGVEVLEV; GGVEVLEVK; GVEVLEVKT; VEVLEVKTG;
EVLEVKTGV; VLEVKTGVD; LEVKTGVDA; EVKTGVDAI; VKTGVDAIT; KTGVDAITE;
TGVDAITEV; GVDAITEVE; VDAITEVEC; DAITEVECF; AITEVECFL; ITEVECFLN;
TEVECFLNP; EVECFLNPE; VECFLNPEM; ECFLNPEMG; CFLNPEMGD; FLNPEMGDP;
LNPEMGDPD; NPEMGDPDE; PEMGDPDEN; EMGDPDENL; MGDPDENLR; GDPDENLRG;
DPDENLRGF; PDENLRGFS; DENLRGFSL; ENLRGFSLK; NLRGFSLKL; LRGFSLKLS;
RGFSLKLSA; GFSLKLSAE; FSLKLSAEN; SLKLSAEND; LKLSAENDF; KLSAENDFS;
LSAENDFSS; SAENDFSSD; AENDFSSDS; ENDFSSDSP; NDFSSDSPE; DFSSDSPER;
FSSDSPERK; SSDSPERKM; SDSPERKML; DSPERKMLP; SPERKMLPC; PERKMLPCY;
ERKMLPCYS; RKMLPCYST; KMLPCYSTA; MLPCYSTAR; LPCYSTARI; PCYSTARIP;
CYSTARIPL; YSTARIPLP; STARIPLPN; TARIPLPNL; ARIPLPNLN; RIPLPNLNE;
IPLPNLNED; PLPNLNEDL; LPNLNEDLT; PNLNEDLTC; NLNEDLTCG; LNEDLTCGN;
NEDLTCGNL; EDLTCGNLL; DLTCGNLLM; LTCGNLLMW; TCGNLLMWE; CGNLLMWEA;
GNLLMWEAV; NLLMWEAVT; LLMWEAVTV; LMWEAVTVQ; MWEAVTVQT; WEAVTVQTE;
EAVTVQTEV; AVTVQTEVI; VTVQTEVIG; TVQTEVIGI; VQTEVIGIT; QTEVIGITS;
TEVIGITSM; EVIGITSML; VIGITSMLN; IGITSMLNL; GITSMLNLH; ITSMLNLHA;
TSMLNLHAG; SMLNLHAGS; MLNLHAGSQ; LNLHAGSQK; NLHAGSQKV; LHAGSQKVH;
HAGSQKVHE; AGSQKVHEH; GSQKVHEHG; SQKVHEHGG; QKVHEHGGG; KVHEHGGGK;
VHEHGGGKP; HEHGGGKPI; EHGGGKPIQ; HGGGKPIQG; GGGKPIQGS; GGKPIQGSN;
GKPIQGSNF; KPIQGSNFH; PIQGSNFHF; IQGSNFHFF; QGSNFHFFA; GSNFHFFAV;
SNFHFFAVG; NFHFFAVGG; FHFFAVGGE; HFFAVGGEP; FFAVGGEPL; FAVGGEPLE;
AVGGEPLEM; VGGEPLEMQ; GGEPLEMQG; GEPLEMQGV; EPLEMQGVL; PLEMQGVLM;
LEMQGVLMN; EMQGVLMNY; MQGVLMNYR; QGVLMNYRS; GVLMNYRSK; VLMNYRSKY;
LMNYRSKYP; MNYRSKYPD; NYRSKYPDG; YRSKYPDGT; RSKYPDGTI; SKYPDGTIT;
KYPDGTITP; YPDGTITPK; PDGTITPKN; DGTITPKNP; GTITPKNPT; TITPKNPTA;
ITPKNPTAQ; TPKNPTAQS; PKNPTAQSQ; KNPTAQSQV; NPTAQSQVM; PTAQSQVMN;
TAQSQVMNT; AQSQVMNTD; QSQVMNTDH; SQVMNTDHK; QVMNTDHKA; VMNTDHKAY;
MNTDHKAYL; NTDHKAYLD; TDHKAYLDK; DHKAYLDKN; HKAYLDKNN; KAYLDKNNA;
AYLDKNNAY; YLDKNNAYP; LDKNNAYPV; DKNNAYPVE; KNNAYPVEC; NNAYPVECW;
NAYPVECWV; AYPVECWVP; YPVECWVPD; PVECWVPDP; VECWVPDPS; ECWVPDPSR;
CWVPDPSRN; WVPDPSRNE; VPDPSRNEN; PDPSRNENA; DPSRNENAR; PSRNENARY;
SRNENARYF; RNENARYFG; NENARYFGT; ENARYFGTF; NARYFGTFT; ARYFGTFTG;
RYFGTFTGG; YFGTFTGGE; FGTFTGGEN; GTFTGGENV; TFTGGENVP; FTGGENVPP;
TGGENVPPV; GGENVPPVL; GENVPPVLH; ENVPPVLHV; NVPPVLHVT; VPPVLHVTN;
PPVLHVTNT; PVLHVTNTA; VLHVTNTAT; LHVTNTATT; HVTNTATTV; VTNTATTVL;
TNTATTVLL; NTATTVLLD; TATTVLLDE; ATTVLLDEQ; TTVLLDEQG; TVLLDEQGV;
VLLDEQGVG; LLDEQGVGP; LDEQGVGPL; DEQGVGPLC; EQGVGPLCK; QGVGPLCKA;
GVGPLCKAD; VGPLCKADS; GPLCKADSL; PLCKADSLY; LCKADSLYV; CKADSLYVS;
KADSLYVSA; ADSLYVSAA; DSLYVSAAD; SLYVSAADI; LYVSAADIC; YVSAADICG;
VSAADICGL; SAADICGLF; AADICGLFT; ADICGLFTN; DICGLFTNS; ICGLFTNSS;
CGLFTNSSG; GLFTNSSGT; LFTNSSGTQ; FTNSSGTQQ; TNSSGTQQW; NSSGTQQWR;
SSGTQQWRG; SGTQQWRGL; GTQQWRGLA; TQQWRGLAR; QQWRGLARY; QWRGLARYF;
WRGLARYFK; RGLARYFKI; GLARYFKIR; LARYFKIRL; ARYFKIRLR; RYFKIRLRK;
YFKIRLRKR; FKIRLRKRS; KIRLRKRSV; IRLRKRSVK; RLRKRSVKN; LRKRSVKNP;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

RKRSVKNPY; KRSVKNPYP; RSVKNPYPI; SVKNPYPIS; VKNPYPISF; KNPYPISFL;
NPYPISFLL; PYPISFLLS; YPISFLLSD; PISFLLSDL; ISFLLSDLI; SFLLSDLIN;
FLLSDLINR; LLSDLINRR; LSDLINRRT; SDLINRRTQ; DLINRRTQR; LINRRTQRV;
INRRTQRVD; NRRTQRVDG; RRTQRVDGQ; RTQRVDGQP; TQRVDGQPM; QRVDGQPMY;
RVDGQPMYG; VDGQPMYGM; DGQPMYGME; GQPMYGMES; QPMYGMESQ; PMYGMESQV;
MYGMESQVE; YGMESQVEE; GMESQVEEV; MESQVEEVR; ESQVEEVRV; SQVEEVRVF;
QVEEVRVFD; VEEVRVFDG; EEVRVFDGT; EVRVFDGTE; VRVFDGTER; RVFDGTERL;
VFDGTERLP; FDGTERLPG; DGTERLPGD; GTERLPGDP; TERLPGDPD; ERLPGDPDM;
RLPGDPDMI; LPGDPDMIR; PGDPDMIRY; GDPDMIRYI; DPDMIRYID; PDMIRYIDK;
DMIRYIDKQ; MIRYIDKQG; IRYIDKQGQ; RYIDKQGQL; YIDKQGQLQ; IDKQGQLQT;
DKQGQLQTK; KQGQLQTKM; QGQLQTKML; TGAFIVHIH; GAFIVHIHL; AFIVHIHLI;
FIVHIHLIN; IVHIHLINA; VHIHLINAA; HIHLINAAF; IHLINAAFV; ATFKLVLFW;
TFKLVLFWG; FKLVLFWGW; KLVLFWGWC; LVLFWGWCF; VLFWGWCFR; LFWGWCFRP;
FWGWCFRPF; WGWCFRPFK; GWCFRPFKT; WCFRPFKTL; CFRPFKTLK; FRPFKTLKA;
RPFKTLKAF; PFKTLKAFT; FKTLKAFTQ; KTLKAFTQM; TLKAFTQMQ; LKAFTQMQL;
KAFTQMQLL; AFTQMQLLT; FTQMQLLTM; TQMQLLTMG; QMQLLTMGV; ILFSCNIKN;
LFSCNIKNT; FSCNIKNTF; SCNIKNTFP; CNIKNTFPH; NIKNTFPHA; IKNTFPHAY;
KNTFPHAYI; NTFPHAYII; TFPHAYIIF; FPHAYIIFH; PHAYIIFHP; KSIHTYLRI;
SIHTYLRIQ; IHTYLRIQP; HTYLRIQPF; TYLRIQPFL; YLRIQPFLP; LRIQPFLPF;
RIQPFLPFN; IQPFLPFNN; QPFLPFNNS; PFLPFNNSR; FLPFNNSRL; LPFNNSRLY;
PFNNSRLYI; FNNSRLYIS; NNSRLYISC; NSRLYISCK; SRLYISCKI; RLYISCKIS;
LYISCKISY; YISCKISYR; ISCKISYRP; SCKISYRPK; CKISYRPKP; KISYRPKPN;
IYFGPKIYL; YFGPKIYLS; FGPKIYLSY; GPKIYLSYK; PKIYLSYKS; KIYLSYKSS;
IYLSYKSSL; YLSYKSSLQ; LSYKSSLQG; SYKSSLQGF; YKSSLQGFR; KSSLQGFRD;
SSLQGFRDR; SLQGFRDRI; LQGFRDRIL; QGFRDRILI; GFRDRILIH; FRDRILIHC;
RDRILIHCN; DRILIHCNQ; RILIHCNQA; ILIHCNQAW; LIHCNQAWW; IHCNQAWWK;
HCNQAWWKY; CNQAWWKYL; NQAWWKYLG; QAWWKYLGS; AWWKYLGSF; WWKYLGSFV;
FSSCPFYIF; SSCPFYIFK; SCPFYIFKN; CPFYIFKNN; PFYIFKNNH; FYIFKNNHV;
YIFKNNHVL; IFKNNHVLI; FKNNHVLIY; KNNHVLIYS; NNHVLIYSY; NHVLIYSYT;
CCFSTINGT; CFSTINGTF; FSTINGTFK; PVSSFRYIE; VSSFRYIEN; SSFRYIENN;
SFRYIENNT; FRYIENNTV; RYIENNTVQ; YIENNTVQK; IENNTVQKI; ENNTVQKIK;
NNTVQKIKY; NTVQKIKYY; TVQKIKYYR; VQKIKYYRI; QKIKYYRIH; KIKYYRIHF;
IKYYRIHFR; QTVQPSNTC; TVQPSNTCH; VQPSNTCHI; QPSNTCHIL; PSNTCHILF;
YSISMSSKY; HFFPGHMKG; FFPGHMKGI; FPGHMKGIY; PGHMKGIYS; GHMKGIYSF;
HMKGIYSFF; MKGIYSFFS; NCIYCLLTN; CIYCLLTNT; IYCLLTNTF; YCLLTNTFL;
CLLTNTFLI; LLTNTFLIF; LTNTFLIFT; TNTFLIFTF; NTFLIFTFC; TFLIFTFCK;
FLIFTFCKN; LIFTFCKNN; IFTFCKNNS; FTFCKNNSI; TFCKNNSIC; FCKNNSICK;
CKNNSICKV; KNNSICKVL; NNSICKVLF; NSICKVLFM; SICKVLFMI; ICKVLFMIL;
CKVLFMILK; KVLFMILKV; VLFMILKVI; LFMILKVIR; FMILKVIRL; MILKVIRLV;
ILKVIRLVF; LKVIRLVFF; KVIRLVFFL; VIRLVFFLT; IRLVFFLTL; RLVFFLTLF;
LVFFLTLFT; VFFLTLFTL; FFLTLFTLL; FLTLFTLLY; LTLFTLLYI; TLFTLLYIV;
LFTLLYIVL; FTLLYIVLK; TLLYIVLKF; KHILTLCLY; HILTLCLYC; ILTLCLYCI;
LTLCLYCIL; TLCLYCILS; LCLYCILSN; FPRHLLCFF; PRHLLCFFR; RHLLCFFRL;
HLLCFFRLF; LLCFFRLFW; LCFFRLFWA; CFFRLFWAK; FFRLFWAKI; FRLFWAKIM;
RLFWAKIML; LFWAKIMLL; APLNAFFYS; PLNAFFYSM; LNAFFYSMV; NAFFYSMVW;
AFFYSMVWI; FFYSMVWIS; FYSMVWISS; VFLINTLTN; KTKGTQLLT; TKGTQLLTE;
KGTQLLTEI; GTQLLTEII; TQLLTEIIN; QLLTEIINC; LLTEIINCR; LTEIINCRN;
TEIINCRNS; EIINCRNSM; IINCRNSMS; INCRNSMSM; NCRNSMSMW; CRNSMSMWS;
KEYNIMPST; EYNIMPSTH; YNIMPSTHV; NIMPSTHVS; IMPSTHVST; MPSTHVSTN;
PSTHVSTNK; STHVSTNKS; THVSTNKSY; HVSTNKSYR; VSTNKSYRI; STNKSYRIF;
TNKSYRIFF; NKSYRIFFH; KSYRIFFHK; SYRIFFHKF; YRIFFHKFF; RIFFHKFFI;
IFFHKFFIQ; FFHKFFIQN; FHKFFIQNL; HKFFIQNLS; KFFIQNLSF; FFIQNLSFF;
FIQNLSFFF; IQNLSFFFS; QNLSFFFSS; NLSFFFSSI; LSFFFSSIH; SFFFSSIHS;
FFFSSIHSK; FFSSIHSKA; FSSIHSKAG; SSIHSKAGK; SIHSKAGKG; IHSKAGKGS;
HSKAGKGSI; SKAGKGSIT; KAGKGSITK; AGKGSITKY; GKGSITKYS; KGSITKYSL;
GSITKYSLT; SITKYSLTK; ITKYSLTKK; TKYSLTKKL; KYSLTKKLV; IRGKVFRVF;
RGKVFRVFY; GKVFRVFYL; KVFRVFYLS; VFRVFYLSF; FRVFYLSFF; RVFYLSFFF;
VFYLSFFFG; FYLSFFFGW; YLSFFFGWC; VLRICCCFF; LRICCCFFI; RICCCFFIT;
ICCCFFITG; CCCFFITGK; CCFFITGKH; CFFITGKHI; FFITGKHIF; FITGKHIFM;
ITGKHIFMA; TGKHIFMAK; IFIPPFIKG; FIPPFIKGT; IPPFIKGTP; PPFIKGTPP;
FFIKGTPPG; FIKGTPPGL; IKGTPPGLP; KGTPPGLPL; GTPPGLPLF; TPPGLPLFC;
PPGLPLFCS; PGLPLFCSI; GLPLFCSIG; LPLFCSIGW; PLFCSIGWH; LFCSIGWHL;
YPIIYLNIS; SFRSLKGVS; FRSLKGVSP; RSLKGVSPI; SLKGVSPII; LKGVSPIIW;
KGVSPIIWT; GVSPIIWTH; VSPIIWTHH; SPIIWTHHC; PIIWTHHCR; IIWTHHCRV;
IWTHHCRVS; WTHHCRVSS; THHCRVSSV; HHCRVSSVR; HCRVSSVRS; CRVSSVRSK;
RVSSVRSKP; VSSVRSKPN; SSVRSKPNH; SVRSKPNHC; VRSKPNHCV; RSKPNHCVK;
SKPNHCVKQ; KPNHCVKQS; PNHCVKQSM; NHCVKQSMV; QSIQTKGSF; SIQTKGSFL;
IQTKGSFLK; QTKGSFLKN; TKGSFLKNF; KGSFLKNFL; GSFLKNFLF; SFLKNFLFK;
FLKNFLFKC; LKNFLFKCL; KNFLFKCLN; NFLFKCLNL; FLFKCLNLS; HSMQGQCTE;
SMQGQCTEG; MQGQCTEGF; QGQCTEGFL; GQCTEGFLE; QCTEGFLEQ; CTEGFLEQI;
TEGFLEQIG; EGFLEQIGH; GFLEQIGHS; FLEQIGHSL; LEQIGHSLQ; EQIGHSLQY;
QIGHSLQYR; IGHSLQYRV; GHSLQYRVS; HSLQYRVSG; SLQYRVSGQ; LQYRVSGQR;
QYRVSGQRG; YRVSGQRGK; RVSGQRGKS; VSGQRGKSA; SGQRGKSAQ; GQRGKSAQT;
QRGKSAQTS; RGKSAQTSE; GKSAQTSEL; KSAQTSELL; SAQTSELLQ; AQTSELLQV;
QTSELLQVP; TSELLQVPK; SELLQVPKS; ELLQVPKSG; ATFTSCSIF; TFTSCSIFL;
FTSCSIFLY; TSCSIFLYK; SCSIFLYKV; CSIFLYKVF; SIFLYKVFI; IFLYKVFIL;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

FLYKVFILF; LYKVFILFI; YKVFILFIL; KVFILFILS; VFILFILSS; FILFILSSS;
ILFILSSSP; LFILSSSPP; FILSSSPPL; ILSSSPPLS; LSSSPPLSG; AFLIKGRFP;
FLIKGRFPQ; LIKGRFPQA; IKGRFPQAA; KGRFPQAAL; GRFPQAALS; RFPQAALSR;
FPQAALSRP; PQAALSRPK; QAALSRPKR; AALSRPKRS; ALSRPKRSM; LSRPKRSMS;
SRPKRSMSS; RPKRSMSSM; PKRSMSSMD; KRSMSSMDS; RSMSSMDSS; SMSSMDSSL;
MSSMDSSLL; SSMDSSLLR; SMDSSLLRT; MDSSLLRTL; DSSLLRTLS 10 mers:

FCKNCKRIGI; CKNCKRIGIS; KNCKRIGISP; NCKRIGISPN; CKRIGISPNS;
KRIGISPNSF; RIGISPNSFA; IGISPNSFAR; GISPNSFARP; ISPNSFARPQ;
SPNSFARPQK; PNSFARPQKK; NSFARPQKKP; SFARPQKKPP; FARPQKKPPH;
ARPQKKPPHP; RPQKKPPHPY; PQKKPPHPYY; QKKPPHPYYL; KKPPHPYYLR;
KPPHPYYLRE; PPHPYYLRER; PHPYYLRERV; HPYYLRERVE; PYYLRERVEA;
YYLRERVEAE; YLRERVEAEA; LRERVEAEAA; RERVEAEAAS; ERVEAEAASA;
RVEAEAASAS; VEAEAASASY; EAEAASASYI; AEAASASYIL; KKRPQGGAAY;
KRPQGGAAYP; RPQGGAAYPW; PQGGAAYPWN; QGGAAYPWNA; GGAAYPWNAAK;
GAAYPWNAAK; AAYPWNAAKP; PQEGKCMTHR; QEGKCMTHRG; EGKCMTHRGM;
GKCMTHRGMQ; KCMTHRGMQP; CMTHRGMQPN; MTHRGMQPNH; THRGMQPNHD;
HRGMQPNHDL; RGMQPNHDLR; GMQPNHDLRK; MQPNHDLRKE; QPNHDLRKES;
PNHDLRKESA; LTGRSCLPME; TGRSCLPMEC; GRSCLPMECS; RSCLPMECSQ;
SCLPMECSQT; CLPMECSQTM; LPMECSQTMT; PMECSQTMTS; MECSQTMTSG;
ECSQTMTSGR; CSQTMTSGRK; SQTMTSGRKV; QTMTSGRKVH; TMTSGRKVHD;
MTSGRKVHDR; TSGRKVHDRH; SGRKVHDRHV; GRKVHDRHVL; RKVHDRHVLR;
KVHDRHVLRA; ESWPCPQLNW; SWPCPQLNWT; WPCPQLNWTK; PCPQLNWTKA;
CPQLNWTKAM; PQLNWTKAMV; QLNWTKAMVL; LNWTKAMVLR; NWTKAMVLRQ;
WTKAMVLRQL; TKAMVLRQLS; KAMVLRQLSR; AMVLRQLSRQ; MVLRQLSRQA;
VLRQLSRQAS; LRQLSRQASV; RQLSRQASVK; QLSRQASVKV; LSRQASVKVG;
SRQASVKVGK; RQASVKVGKT; QASVKVGKTW; ASVKVGKTWT; SVKVGKTWTG;
VKVGKTWTGT; KVGKTWTGTK; VGKTWTGTKK; GKTWTGTKKR; KTWTGTKKRA;
TWTGTKKRAQ; WTGTKKRAQR; TGTKKRAQRI; GTKKRAQRIF; TKKRAQRIFI;
KKRAQRIFIF; KRAQRIFIFI; RAQRIFIFIL; AQRIFIFILE; QRIFIFILEL;
RIFIFILELL; IFIFILELLL; FIFILELLLE; IFILELLLEF; FILELLLEFC;
ILELLLEFCR; LELLLEFCRG; ELLLEFCRGE; LLLEFCRGED; LLEFCRGEDS;
LEFCRGEDSV; EFCRGEDSVD; FCRGEDSVDG; CRGEDSVDGK; RGEDSVDGKN;
GEDSVDGKNK; EDSVDGKNKS; DSVDGKNKST; SVDGKNKSTT; VDGKNKSTTA;
DGKNKSTTAL; GKNKSTTALP; KNKSTTALPA; NKSTTALPAV; KSTTALPAVK;
STTALPAVKD; TTALPAVKDS; TALPAVKDSV; ALPAVKDSVK; LPAVKDSVKD;
PAVKDSVKDS; VSNPFFFVFP; SNPFFFVFPG; NPFFFVFPGS; PFFFVFPGSW;
FFFVFPGSWV; FFVFPGSWVL; FVFPGSWVLL; LPVYLRLLLP; PVYLRLLLPQ;
VYLRLLLPQD; YLRLLLPQDF; LRLLLPQDFQ; RLLLPQDFQW; LLLPQDFQWL;
LLPQDFQWLK; LPQDFQWLKL; PQDFQWLKLL; QDFQWLKLLL; DFQWLKLLLG;
FQWLKLLLGR; QWLKLLLGRL; WLKLLLGRLL; LKLLLGRLLL; KLLLGRLLLL;
LLVLLGLLLG; LVLLGLLLGL; VLLGLLLGLL; LLGLLLGLLL; GISSLMIGIT;
ISSLMIGITK; SSLMIGITKF; SLMIGITKFP; LMIGITKFPL; ASISNQAWLW;
SISNQAWLWN; ISNQAWLWNC; SNQAWLWNCL; NQAWLWNCLT; QAWLWNCLTQ;
AWLWNCLTQM; WLWNCLTQMS; LWNCLTQMST; WNCLTQMSTM; NCLTQMSTMI;
CLTQMSTMIF; LTQMSTMIFC; TQMSTMIFCF; QMSTMIFCFL; MSTMIFCFLV;
ILLLIIFNTL; LLLIIFNTLI; LLIIFNTLIL; LIIFNTLILG; IIFNTLILGI;
IFNTLILGIG; FNTLILGIGV; NTLILGIGVL; TLILGIGVLL; LILGIGVLLC;
ILGIGVLLCL; LGIGVLLCLL; GIGVLLCLLL; IGVLLCLLLF; GVLLCLLLFP;
VLLCLLLFPR; LLCLLLFPRL; LCLLLFPRLC; CLLLFPRLCG; LLLFPRLCGM;
LLFPRLCGML; LFPRLCGMLL; FPRLCGMLLG; PRLCGMLLGM; RLCGMLLGMI;
LCGMLLGMIY; CGMLLGMIYL; GMLLGMIYLL; PHRNCREEQK; HRNCREEQKD;
RNCREEQKDF; NCREEQKDFL; CREEQKDFLE; REEQKDFLET; EEQKDFLETP;
EQKDFLETPW; QKDFLETPWL; KDFLETPWLD; DFLETPWLDF; FLETPWLDFW;
LETPWLDFWR; ETPWLDFWRK; TPWLDFWRKL; PWLDFWRKLP; WLDFWRKLPG;
LDFWRKLPGQ; DFWRKLPGQL; TFIIIFNNII; FIIIFNNIIL; IIIFNNIILI;
IIFNNIILIF; IFNNIILIFP; FNNIILIFPL; NNIILIFPLL; NIILIFPLLG;
IILIFPLLGP; ILIFPLLGPQ; LIFPLLGPQW; IFPLLGPQWL; FPLLGPQWLD;
PLLGPQWLDK; LKGKVPVYIL; KGKVPVYILA; GKVPVYILAI; KVPVYILAIL;
VPVYILAILI; PVYILAILIV; EINKVYIQES; INKVYIQESL; KKLLPQEVLI;
KLLPQEVLIK; LLPQEVLIKE; LPQEVLIKEL; PQEVLIKELL; QEVLIKELLL;
EVLIKELLLN; VLIKELLLNG; LIKELLLNGC; IKELLLNGCC; KELLLNGCCL;
ELLLNGCCLY; LLLNGCCLYF; HLLLKHMKMA; LLLKHMKMAP; LLKHMKMAPT;
LKHMKMAPTK; KHMKMAPTKR; HMKMAPTKRK; MKMAPTKRKG; KMAPTKRKGE;
MAPTKRKGEC; APTKRKGECP; PTKRKGECPG; TKRKGECPGA; KRKGECPGAA;
RKGECPGAAP; KGECPGAAPK; GECPGAAPKK; ECPGAAPKKP; CPGAAPKKPK;
PGAAPKKPKE; GAAPKKPKEP; AAPKKPKEPV; APKKPKEPVQ; PKKPKEPVQV;
KKPKEPVQVP; KPKEPVQVPK; PKEPVQVPKL; KEPVQVPKLL; EPVQVPKLLI;
PVQVPKLLIK; VQVPKLLIKG; QVPKLLIKGG; VPKLLIKGGV; PKLLIKGGVE;
KLLIKGGVEV; LLIKGGVEVL; LIKGGVEVLE; IKGGVEVLEV; KGGVEVLEVK;
GGVEVLEVKT; GVEVLEVKTG; VEVLEVKTGV; EVLEVKTGVD; VLEVKTGVDA;
LEVKTGVDAI; EVKTGVDAIT; VKTGVDAITE; KTGVDAITEV; TGVDAITEVE;
GVDAITEVEC; VDAITEVECF; DAITEVECFL; AITEVECFLN; ITEVECFLNP;
TEVECFLNPE; EVECFLNPEM; VECFLNPEMG; ECFLNPEMGD; CFLNPEMGDP;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

FLNPEMGDPD; LNPEMGDPDE; NPEMGDPDEN; PEMGDPDENL; EMGDPDENLR;
MGDPDENLRG; GDPDENLRGF; DPDENLRGFS; PDENLRGFSL; DENLRGFSLK;
ENLRGFSLKL; NLRGFSLKLS; LRGFSLKLSA; RGFSLKLSAE; GFSLKLSAEN;
FSLKLSAEND; SLKLSAENDF; LKLSAENDFS; KLSAENDFSS; LSAENDFSSD;
SAENDFSSDS; AENDFSSDSP; ENDFSSDSPE; NDFSSDSPER; DFSSDSPERK;
FSSDSPERKM; SSDSPERKML; SDSPERKMLP; DSPERKMLPC; SPERKMLPCY;
PERKMLPCYS; ERKMLPCYST; RKMLPCYSTA; KMLPCYSTAR; MLPCYSTARI;
LPCYSTARIP; PCYSTARIPL; CYSTARIPLP; YSTARIPLPN; STARIPLPNL;
TARIPLPNLN; ARIPLPNLNE; RIPLPNLNED; IPLPNLNEDL; PLPNLNEDLT;
LPNLNEDLTC; PNLNEDLTCG; NLNEDLTCGN; LNEDLTCGNL; NEDLTCGNLL;
EDLTCGNLLM; DLTCGNLLMW; LTCGNLLMWE; TCGNLLMWEA; CGNLLMWEAV;
GNLLMWEAVT; NLLMWEAVTV; LLMWEAVTVQ; LMWEAVTVQT; MWEAVTVQTE;
WEAVTVQTEV; EAVTVQTEVI; AVTVQTEVIG; VTVQTEVIGI; TVQTEVIGIT;
VQTEVIGITS; QTEVIGITSM; TEVIGITSML; EVIGITSMLN; VIGITSMLNL;
IGITSMLNLH; GITSMLNLHA; ITSMLNLHAG; TSMLNLHAGS; SMLNLHAGSQ;
MLNLHAGSQK; LNLHAGSQKV; NLHAGSQKVH; LHAGSQKVHE; HAGSQKVHEH;
AGSQKVHEHG; GSQKVHEHGG; SQKVHEHGGG; QKVHEHGGGK; KVHEHGGGKP;
VHEHGGGKPI; HEHGGGKPIQ; EHGGGKPIQG; HGGGKPIQGS; GGGKPIQGSN;
GGKPIQGSNF; GKPIQGSNFH; KPIQGSNFHF; PIQGSNFHFF; IQGSNFHFFA;
QGSNFHFFAV; GSNFHFFAVG; SNFHFFAVGG; NFHFFAVGGE; FHFFAVGGEP;
HFFAVGGEPL; FFAVGGEPLE; FAVGGEPLEM; AVGGEPLEMQ; VGGEPLEMQG;
GGEPLEMQGV; GEPLEMQGVL; EPLEMQGVLM; PLEMQGVLMN; LEMQGVLMNY;
EMQGVLMNYR; MQGVLMNYRS; QGVLMNYRSK; GVLMNYRSKY; VLMNYRSKYP;
LMNYRSKYPD; MNYRSKYPDG; NYRSKYPDGT; YRSKYPDGTI; RSKYPDGTIT;
SKYPDGTITP; KYPDGTITPK; YPDGTITPKN; PDGTITPKNP; DGTITPKNPT;
GTITPKNPTA; TITPKNPTAQ; ITPKNPTAQS; TPKNPTAQSQ; PKNPTAQSQV;
KNPTAQSQVM; NPTAQSQVMN; PTAQSQVMNT; TAQSQVMNTD; AQSQVMNTDH;
QSQVMNTDHK; SQVMNTDHKA; QVMNTDHKAY; VMNTDHKAYL; MNTDHKAYLD;
NTDHKAYLDK; TDHKAYLDKN; DHKAYLDKNN; HKAYLDKNNA; KAYLDKNNAY;
AYLDKNNAYP; YLDKNNAYPV; LDKNNAYPVE; DKNNAYPVEC; KNNAYPVECW;
NNAYPVECWV; NAYPVECWVP; AYPVECWVPD; YPVECWVPDP; PVECWVPDPS;
VECWVPDPSR; ECWVPDPSRN; CWVPDPSRNE; WVPDPSRNEN; VPDPSRNENA;
PDPSRNENAR; DPSRNENARY; PSRNENARYF; SRNENARYFG; RNENARYFGT;
NENARYFGTF; ENARYFGTFT; NARYFGTFTG; ARYFGTFTGG; RYFGTFTGGE;
YFGTFTGGEN; FGTFTGGENV; GTFTGGENVP; TFTGGENVPP; FTGGENVPPV;
TGGENVPPVL; GGENVPPVLH; GENVPPVLHV; ENVPPVLHVT; NVPPVLHVTN;
VPPVLHVTNT; PPVLHVTNTA; PVLHVTNTAT; VLHVTNTATT; LHVTNTATTV;
HVTNTATTVL; VTNTATTVLL; TNTATTVLLD; NTATTVLLDE; TATTVLLDEQ;
ATTVLLDEQG; TTVLLDEQGV; TVLLDEQGVG; VLLDEQGVGP; LLDEQGVGPL;
LDEQGVGPLC; DEQGVGPLCK; EQGVGPLCKA; QGVGPLCKAD; GVGPLCKADS;
VGPLCKADSL; GPLCKADSLY; PLCKADSLYV; LCKADSLYVS; CKADSLYVSA;
KADSLYVSAA; ADSLYVSAAD; DSLYVSAADI; SLYVSAADIC; LYVSAADICG;
YVSAADICGL; VSAADICGLF; SAADICGLFT; AADICGLFTN; ADICGLFTNS;
DICGLFTNSS; ICGLFTNSSG; CGLFTNSSGT; GLFTNSSGTQ; LFTNSSGTQQ;
FTNSSGTQQW; TNSSGTQQWR; NSSGTQQWRG; SSGTQQWRGL; SGTQQWRGLA;
GTQQWRGLAR; TQQWRGLARY; QQWRGLARYF; QWRGLARYFK; WRGLARYFKI;
RGLARYFKIR; GLARYFKIRL; LARYFKIRLR; ARYFKIRLRK; RYFKIRLRKR;
YFKIRLRKRS; FKIRLRKRSV; KIRLRKRSVK; IRLRKRSVKN; RLRKRSVKNP;
LRKRSVKNPY; RKRSVKNPYP; KRSVKNPYPI; RSVKNPYPIS; SVKNPYPISF;
VKNPYPISFL; KNPYPISFLL; NPYPISFLLS; PYPISFLLSD; YPISFLLSDL;
PISFLLSDLI; ISFLLSDLIN; SFLLSDLINR; FLLSDLINRR; LLSDLINRRT;
LSDLINRRTQ; SDLINRRTQR; DLINRRTQRV; LINRRTQRVD; INRRTQRVDG;
NRRTQRVDGQ; RRTQRVDGQP; RTQRVDGQPM; TQRVDGQPMY; QRVDGQPMYG;
RVDGQPMYGM; VDGQPMYGME; DGQPMYGMES; GQPMYGMESQ; QPMYGMESQV;
PMYGMESQVE; MYGMESQVEE; YGMESQVEEV; GMESQVEEVR; MESQVEEVRV;
ESQVEEVRVF; SQVEEVRVFD; QVEEVRVFDG; VEEVRVFDGT; EEVRVFDGTE;
EVRVFDGTER; VRVFDGTERL; RVFDGTERLP; VFDGTERLPG; FDGTERLPGD;
DGTERLPGDP; GTERLPGDPD; TERLPGDPDM; ERLPGDPDMI; RLPGDPDMIR;
LPGDPDMIRY; PGDPDMIRYI; GDPDMIRYID; DPDMIRYIDK; PDMIRYIDKQ;
DMIRYIDKQG; MIRYIDKQGQ; IRYIDKQGQL; RYIDKQGQLQ; YIDKQGQLQT;
IDKQGQLQTK; DKQGQLQTKM; KQGQLQTKML; TGAFIVHIHL; GAFIVHIHLI;
AFIVHIHLIN; FIVHIHLINA; IVHIHLINAA; VHIHLINAAF; HIHLINAAFV;
ATFKLVLFWG; TFKLVLFWGW; FKLVLFWGWC; KLVLFWGWCF; LVLFWGWCFR;
VLFWGWCFRP; LFWGWCFRPF; FWGWCFRPFK; WGWCFRPFKT; GWCFRPFKTL;
WCFRPFKTLK; CFRPFKTLKA; FRPFKTLKAF; RPFKTLKAFT; PFKTLKAFTQ;
FKTLKAFTQM; KTLKAFTQMQ; TLKAFTQMQL; LKAFTQMQLL; KAFTQMQLLT;
AFTQMQLLTM; FTQMQLLTMG; TQMQLLTMGV; ILFSCNIKNT; LFSCNIKNTF;
FSCNIKNTFP; SCNIKNTFPH; CNIKNTFPHA; NIKNTFPHAY; IKNTFPHAYI;
KNTFPHAYII; NTFPHAYIIF; TFPHAYIIFH; FPHAYIIFHP; KSIHTYLRIQ;
SIHTYLRIQP; IHTYLRIQPF; HTYLRIQPFL; TYLRIQPFLP; YLRIQPFLPF;
LRIQPFLPFN; RIQPFLPFNN; IQPFLPFNNS; QPFLPFNNSR; PFLPFNNSRL;
FLPFNNSRLY; LPFNNSRLYI; PFNNSRLYIS; FNNSRLYISC; NNSRLYISCK;
NSRLYISCKI; SRLYISCKIS; RLYISCKISY; LYISCKISYR; YISCKISYRP;
ISCKISYRPK; SCKISYRPKP; CKISYRPKPN; IYFGPKIYLS; YFGPKIYLSY;
FGPKIYLSYK; GPKIYLSYKS; PKIYLSYKSS; KIYLSYKSSL; IYLSYKSSLQ;
YLSYKSSLQG; LSYKSSLQGF; SYKSSLQGFR; YKSSLQGFRD; KSSLQGFRDR;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

SSLQGFRDRI; SLQGFRDRIL; LQGFRDRILI; QGFRDRILIH; GFRDRILIHC;
FRDRILIHCN; RDRILIHCNQ; DRILIHCNQA; RILIHCNQAW; ILIHCNQAWW;
LIHCNQAWWK; IHCNQAWWKY; HCNQAWWKYL; CNQAWWKYLG; NQAWWKYLGS;
QAWWKYLGSF; AWWKYLGSFV; FSSCPFYIFK; SSCPFYIFKN; SCPFYIFKNN;
CPFYIFKNNH; PFYIFKNNHV; FYIFKNNHVL; YIFKNNHVLI; IFKNNHVLIY;
FKNNHVLIYS; KNNHVLIYSY; NNHVLIYSYT; CCFSTINGTF; CFSTINGTFK;
PVSSFRYIEN; VSSFRYIENN; SSFRYIENNT; SFRYIENNTV; FRYIENNTVQ;
RYIENNTVQK; YIENNTVQKI; IENNTVQKIK; ENNTVQKIKY; NNTVQKIKYY;
NTVQKIKYYR; TVQKIKYYRI; VQKIKYYRIH; QKIKYYRIHF; KIKYYRIHFR;
QTVQPSNTCH; TVQPSNTCHI; VQPSNTCHIL; QPSNTCHILF; HFFPGHMKGI;
FFPGHMKGIY; FPGHMKGIYS; PGHMKGIYSF; GHMKGIYSFF; HMKGIYSFFS;
NCIYCLLTNT; CIYCLLTNTF; IYCLLTNTFL; YCLLTNTFLI; CLLTNTFLIF;
LLTNTFLIFT; LTNTFLIFTF; TNTFLIFTFC; NTFLIFTFCK; TFLIFTFCKN;
FLIFTFCKNN; LIFTFCKNNS; IFTFCKNNSI; FTFCKNNSIC; TFCKNNSICK;
FCKNNSICKV; CKNNSICKVL; KNNSICKVLF; NNSICKVLFM; NSICKVLFMI;
SICKVLFMIL; ICKVLFMILK; CKVLFMILKV; KVLFMILKVI; VLFMILKVIR;
LFMILKVIRL; FMILKVIRLV; MILKVIRLVF; ILKVIRLVFF; LKVIRLVFFL;
KVIRLVFFLT; VIRLVFFLTL; IRLVFFLTLF; RLVFFLTLFT; LVFFLTLFTL;
VFFLTLFTLL; FFLTLFTLLY; FLTLFTLLYI; LTLFTLLYIV; TLFTLLYIVL;
LFTLLYIVLK; FTLLYIVLKF; KHILTLCLYC; HILTLCLYCI; ILTLCLYCIL;
LTLCLYCILS; TLCLYCILSN; FPRHLLCFFR; PRHLLCFFRL; RHLLCFFRLF;
HLLCFFRLFW; LLCFFRLFWA; LCFFRLFWAK; CFFRLFWAKI; FFRLFWAKIM;
FRLFWAKIML; RLFWAKIMLL; APLNAFFYSM; PLNAFFYSMV; LNAFFYSMVW;
NAFFYSMVWI; AFFYSMVWIS; FFYSMVWISS; KTKGTQLLTE; TKGTQLLTEI;
KGTQLLTEII; GTQLLTEIIN; TQLLTEIINC; QLLTEIINCR; LLTEIINCRN;
LTEIINCRNS; TEIINCRNSM; EIINCRNSMS; IINCRNSMSM; INCRNSMSMW;
NCRNSMSMWS; KEYNIMPSTH; EYNIMPSTHV; YNIMPSTHVS; NIMPSTHVST;
IMPSTHVSTN; MPSTHVSTNK; PSTHVSTNKS; STHVSTNKSY; THVSTNKSYR;
HVSTNKSYRI; VSTNKSYRIF; STNKSYRIFF; TNKSYRIFFH; NKSYRIFFHK;
KSYRIFFHKF; SYRIFFHKFF; YRIFFHKFFI; RIFFHKFFIQ; IFFHKFFIQN;
FFHKFFIQNL; FHKFFIQNLS; HKFFIQNLSF; KFFIQNLSFF; FFIQNLSFFF;
FIQNLSFFFS; IQNLSFFFSS; QNLSFFFSSI; NLSFFFSSIH; LSFFFSSIHS;
SFFFSSIHSK; FFFSSIHSKA; FFSSIHSKAG; FSSIHSKAGK; SSIHSKAGKG;
SIHSKAGKGS; IHSKAGKGSI; HSKAGKGSIT; SKAGKGSITK; KAGKGSITKY;
AGKGSITKYS; GKGSITKYSL; KGSITKYSLT; GSITKYSLTK; SITKYSLTKK;
ITKYSLTKKL; TKYSLTKKLV; IRGKVFRVFY; RGKVFRVFYL; GKVFRVFYLS;
KVFRVFYLSF; VFRVFYLSFF; FRVFYLSFFF; RVFYLSFFFG; VFYLSFFFGW;
FYLSFFFGWC; VLRICCCFFI; LRICCCFFIT; RICCCFFITG; ICCCFFITGK;
CCCFFITGKH; CCFFITGKHI; CFFITGKHIF; FFITGKHIFM; FITGKHIFMA;
ITGKHIFMAK; IFIPFFIKGT; FIPFFIKGTP; IPFFIKGTPP; PFFIKGTPPG;
FFIKGTPPGL; FIKGTPPGLP; IKGTPPGLPL; KGTPPGLPLF; GTPPGLPLFC;
TPPGLPLFCS; PPGLPLFCSI; PGLPLFCSIG; GLPLFCSIGW; LPLFCSIGWH;
PLFCSIGWHL; SFRSLKGVSP; FRSLKGVSPI; RSLKGVSPII; SLKGVSPIIW;
LKGVSPIIWT; KGVSPIIWTH; GVSPIIWTHH; VSPIIWTHHC; SPIIWTHHCR;
PIIWTHHCRV; IIWTHHCRVS; IWTHHCRVSS; WTHHCRVSSV; THHCRVSSVR;
HHCRVSSVRS; HCRVSSVRSK; CRVSSVRSKP; RVSSVRSKPN; VSSVRSKPNH;
SSVRSKPNHC; SVRSKPNHCV; VRSKPNHCVK; RSKPNHCVKQ; SKPNHCVKQS;
KPNHCVKQSM; PNHCVKQSMQ; QSIQTKGSFL; SIQTKGSFLK; IQTKGSFLKN;
QTKGSFLKNF; TKGSFLKNFL; KGSFLKNFLF; GSFLKNFLFK; SFLKNFLFKC;
FLKNFLFKCL; LKNFLFKCLN; KNFLFKCLNL; NFLFKCLNLS; HSMQGQCTEG;
SMQGQCTEGF; MQGQCTEGFL; QGQCTEGFLE; GQCTEGFLEQ; QCTEGFLEQI;
CTEGFLEQIG; TEGFLEQIGH; EGFLEQIGHS; GFLEQIGHSL; FLEQIGHSLQ;
LEQIGHSLQY; EQIGHSLQYR; QIGHSLQYRV; IGHSLQYRVS; GHSLQYRVSG;
HSLQYRVSGQ; SLQYRVSGQR; LQYRVSGQRG; QYRVSGQRGK; YRVSGQRGKS;
RVSGQRGKSA; VSGQRGKSAQ; SGQRGKSAQT; GQRGKSAQTS; QRGKSAQTSE;
RGKSAQTSEL; GKSAQTSELL; KSAQTSELLQ; SAQTSELLQV; AQTSELLQVP;
QTSELLQVPK; TSELLQVPKS; SELLQVPKSG; ATFTSCSIFL; TFTSCSIFLY;
FTSCSIFLYK; TSCSIFLYKV; SCSIFLYKVF; CSIFLYKVFI; SIFLYKVFIL;
IFLYKVFILF; FLYKVFILFI; LYKVFILFIL; YKVFILFILS; KVFILFILSS;
VFILFILSSS; FILFILSSSP; ILFILSSSPP; LFILSSSPPL; FILSSSPPLS;
ILSSSPPLSG; AFLIKGRFPQ; FLIKGRFPQA; LIKGRFPQAA; IKGRFPQAAL;
KGRFPQAALS; GRFPQAALSR; RFPQAALSRP; FPQAALSRPK; PQAALSRPKR;
QAALSRPKRS; AALSRPKRSM; ALSRPKRSMS; LSRPKRSMSS; SRPKRSMSSM;
RPKRSMSSMD; PKRSMSSMDS; KRSMSSMDSS; RSMSSMDSSL; SMSSMDSSLL;
MSSMDSSLLR; SSMDSSLLRT; SMDSSLLRTL; MDSSLLRTLS 11 mers:

FCKNCKRIGIS; CKNCKRIGISP; KNCKRIGISPN; NCKRIGISPNS; CKRIGISPNSF;
KRIGISPNSFA; RIGISPNSFAR; IGISPNSFARP; GISPNSFARPQ; ISPNSFARPQK;
SPNSFARPQKK; PNSFARPQKKP; NSFARPQKKPP; SFARPQKKPPH; FARPQKKPPHP;
ARPQKKPPHPY; RPQKKPPHPYY; PQKKPPHPYYL; QKKPPHPYYLR; KKPPHPYYLRE;
KPPHPYYLRER; PPHPYYLRERV; PHPYYLRERVE; HPYYLRERVEA; PYYLRERVEAE;
YYLRERVEAEA; YLRERVEAEAA; LRERVEAEAAS; RERVEAEAASA; ERVEAEAASAS;
RVEAEAASASY; VEAEAASASYI; EAEAASASYIL; KKRPQGGAAYP; KRPQGGAAYPW;
RPQGGAAYPWN; PQGGAAYPWNA; QGGAAYPWNAA; GGAAYPWNAAK; GAAYPWNAAKP;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

PQEGKCMTHRG; QEGKCMTHRGM; EGKCMTHRGMQ; GKCMTHRGMQP; KCMTHRGMQPN;
CMTHRGMQPNH; MTHRGMQPNHD; THRGMQPNHDL; HRGMQPNHDLR; RGMQPNHDLRK;
GMQPNHDLRKE; MQPNHDLRKES; QPNHDLRKESA; LTGRSCLPMEC; TGRSCLPMECS;
GRSCLPMECSQ; RSCLPMECSQT; SCLPMECSQTM; CLPMECSQTMT; LPMECSQTMTS;
PMECSQTMTSG; MECSQTMTSGR; ECSQTMTSGRK; CSQTMTSGRKV; SQTMTSGRKVH;
QTMTSGRKVHD; TMTSGRKVHDR; MTSGRKVHDRH; TSGRKVHDRHV; SGRKVHDRHVL;
GRKVHDRHVLR; RKVHDRHVLRA; ESWPCPQLNWT; SWPCPQLNWTK; WPCPQLNWTKA;
PCPQLNWTKAM; CPQLNWTKAMV; PQLNWTKAMVL; QLNWTKAMVLR; LNWTKAMVLRQ;
NWTKAMVLRQL; WTKAMVLRQLS; TKAMVLRQLSR; KAMVLRQLSRQ; AMVLRQLSRQA;
MVLRQLSRQAS; VLRQLSRQASV; LRQLSRQASVK; RQLSRQASVKV; QLSRQASVKVG;
LSRQASVKVGK; SRQASVKVGKT; RQASVKVGKTW; QASVKVGKTWT; ASVKVGKTWTG;
SVKVGKTWTGT; VKVGKTWTGTK; KVGKTWTGTKK; VGKTWTGTKKR; GKTWTGTKKRA;
KTWTGTKKRAQ; TWTGTKKRAQR; WTGTKKRAQRI; TGTKKRAQRIF; GTKKRAQRIFI;
TKKRAQRIFIF; KKRAQRIFIFI; KRAQRIFIFIL; RAQRIFIFILE; AQRIFIFILEL;
QRIFIFILELL; RIFIFILELLL; IFIFILELLLE; FIFILELLLEF; IFILELLLEFC;
FILELLLEFCR; ILELLLEFCRG; LELLLEFCRGE; ELLLEFCRGED; LLLEFCRGEDS;
LLEFCRGEDSV; LEFCRGEDSVD; EFCRGEDSVDG; FCRGEDSVDGK; CRGEDSVDGKN;
RGEDSVDGKNK; GEDSVDGKNKS; EDSVDGKNKST; DSVDGKNKSTT; SVDGKNKSTTA;
VDGKNKSTTAL; DGKNKSTTALP; GKNKSTTALPA; KNKSTTALPAV; NKSTTALPAVK;
KSTTALPAVKD; STTALPAVKDS; TTALPAVKDSV; TALPAVKDSVK; ALPAVKDSVKD;
LPAVKDSVKDS; VSNPFFVFPG; SNPFFVFPGS; NPFFFVFPGSW; PFFFVFPGSWV;
FFFVFPGSWVL; FFVFPGSWVLL; LPVYLRLLLPQ; PVYLRLLLPQD; VYLRLLLPQDF;
YLRLLLPQDFQ; LRLLLPQDFQW; RLLLPQDFQWL; LLLPQDFQWLK; LLPQDFQWLKL;
LPQDFQWLKLL; PQDFQWLKLLL; QDFQWLKLLLG; DFQWLKLLLGR; FQWLKLLLGRL;
QWLKLLLGRLL; WLKLLLGRLLL; LKLLLGRLLLL; LLLGLLLGLL; VLLGLLLGLLL;
VLLGLLLGLLL; GISSLMIGITK; ISSLMIGITKF; SSLMIGITKFP; SLMIGITKFPL;
ASISNQAWLWN; SISNQAWLWNC; ISNQAWLWNCL; SNQAWLWNCLT; NQAWLWNCLTQ;
QAWLWNCLTQM; AWLWNCLTQMS; WLWNCLTQMST; LWNCLTQMSTM; WNCLTQMSTMI;
NCLTQMSTMIF; CLTQMSTMIFC; LTQMSTMIFCF; TQMSTMIFCFL; QMSTMIFCFLV;
ILLLIIFNTLI; LLLIIFNTLIL; LLIIFNTLILG; LIIFNTLILGI; IIFNTLILGIG;
IFNTLILGIGV; FNTLILGIGVL; NTLILGIGVLL; TLILGIGVLLC; LILGIGVLLCL;
ILGIGVLLCLL; LGIGVLLCLLL; GIGVLLCLLLF; IGVLLCLLLFP; GVLLCLLLFPR;
VLLCLLLFPRL; LLCLLLFPRLC; LCLLLFPRLCG; CLLLFPRLCGM; LLLFPRLCGML;
LLFPRLCGMLL; LFPRLCGMLLG; FPRLCGMLLGM; PRLCGMLLGMI; RLCGMLLGMIY;
LCGMLLGMIYL; CGMLLGMIYLL; PHRNCREEQKD; HRNCREEQKDF; RNCREEQKDFL;
NCREEQKDFLE; CREEQKDFLET; REEQKDFLETP; EEQKDFLETPW; EQKDFLETPWL;
QKDFLETPWLD; KDFLETPWLDF; DFLETPWLDFW; FLETPWLDFWR; LETPWLDFWRK;
ETPWLDFWRKL; TPWLDFWRKLP; PWLDFWRKLPG; WLDFWRKLPGQ; LDFWRKLPGQL;
TFIIIFNNIIL; FIIIFNNIILI; IIIFNNIILIF; IIFNNIILIFP; IFNNIILIFPL;
FNNIILIFPLL; NNIILIFPLLG; NIILIFPLLGP; IILIFPLLGPQ; ILIFPLLGPQW;
LIFPLLGPQWL; IFPLLGPQWLD; FPLLGPQWLDK; LKGKVPVYILA; KGKVPVYILAI;
GKVPVYILAIL; KVPVYILAILI; VPVYILAILIV; EINKVYIQESL; KKLLPQEVLIK;
KLLPQEVLIKE; LLPQEVLIKEL; LPQEVLIKELL; PQEVLIKELLL; QEVLIKELLLN;
EVLIKELLLNG; VLIKELLLNGC; LIKELLLNGCC; IKELLLNGCCL; KELLLNGCCLY;
ELLLNGCCLYF; HLLLKHMKMAP; LLLKHMKMAPT; LLKHMKMAPTK; LKHMKMAPTKR;
KHMKMAPTKRK; HMKMAPTKRKG; MKMAPTKRKGE; KMAPTKRKGEC; MAPTKRKGECP;
APTKRKGECPG; PTKRKGECPGA; TKRKGECPGAA; KRKGECPGAAP; RKGECPGAAPK;
KGECPGAAPKK; GECPGAAPKKP; ECPGAAPKKPK; CPGAAPKKPKE; PGAAPKKPKEP;
GAAPKKPKEPV; AAPKKPKEPVQ; APKKPKEPVQV; PKKPKEPVQVP; KKPKEPVQVPK;
KPKEPVQVPKL; PKEPVQVPKLL; KEPVQVPKLLI; EPVQVPKLLIK; PVQVPKLLIKG;
VQVPKLLIKGG; QVPKLLIKGGV; VPKLLIKGGVE; PKLLIKGGVEV; KLLIKGGVEVL;
LLIKGGVEVLE; LIKGGVEVLEV; IKGGVEVLEVK; KGGVEVLEVKT; GGVEVLEVKTG;
GVEVLEVKTGV; VEVLEVKTGVD; EVLEVKTGVDA; VLEVKTGVDAI; LEVKTGVDAIT;
EVKTGVDAITE; VKTGVDAITEV; KTGVDAITEVE; TGVDAITEVEC; GVDAITEVECF;
VDAITEVECFL; DAITEVECFLN; AITEVECFLNP; ITEVECFLNPE; TEVECFLNPEM;
EVECFLNPEMG; VECFLNPEMGD; ECFLNPEMGDP; CFLNPEMGDPD; FLNPEMGDPDE;
LNPEMGDPDEN; NPEMGDPDENL; PEMGDPDENLR; EMGDPDENLRG; MGDPDENLRGF;
GDPDENLRGFS; DPDENLRGFSL; PDENLRGFSLK; DENLRGFSLKL; ENLRGFSLKLS;
NLRGFSLKLSA; LRGFSLKLSAE; RGFSLKLSAEN; GFSLKLSAEND; FSLKLSAENDF;
SLKLSAENDFS; LKLSAENDFSS; KLSAENDFSSD; LSAENDFSSDS; SAENDFSSDSP;
AENDFSSDSPE; ENDFSSDSPER; NDFSSDSPERK; DFSSDSPERKM; FSSDSPERKML;
SSDSPERKMLP; SDSPERKMLPC; DSPERKMLPCY; SPERKMLPCYS; PERKMLPCYST;
ERKMLPCYSTA; RKMLPCYSTAR; KMLPCYSTARI; MLPCYSTARIP; LPCYSTARIPL;
PCYSTARIPLP; CYSTARIPLPN; YSTARIPLPNL; STARIPLPNLN; TARIPLPNLNE;
ARIPLPNLNED; RIPLPNLNEDL; IPLPNLNEDLT; PLPNLNEDLTC; LPNLNEDLTCG;
PNLNEDLTCGN; NLNEDLTCGNL; LNEDLTCGNLL; NEDLTCGNLLM; EDLTCGNLLMW;
DLTCGNLLMWE; LTCGNLLMWEA; TCGNLLMWEAV; CGNLLMWEAVT; GNLLMWEAVTV;
NLLMWEAVTVQ; LLMWEAVTVQT; LMWEAVTVQTE; MWEAVTVQTEV; WEAVTVQTEVI;
EAVTVQTEVIG; AVTVQTEVIGI; VTVQTEVIGIT; TVQTEVIGITS; VQTEVIGITSM;
QTEVIGITSML; TEVIGITSMLN; EVIGITSMLNL; VIGITSMLNLH; IGITSMLNLHA;
GITSMLNLHAG; ITSMLNLHAGS; TSMLNLHAGSQ; SMLNLHAGSQK; MLNLHAGSQKV;
LNLHAGSQKVH; NLHAGSQKVHE; LHAGSQKVHEH; HAGSQKVHEHG; AGSQKVHEHGG;
GSQKVHEHGGG; SQKVHEHGGGK; QKVHEHGGGKP; KVHEHGGGKPI; VHEHGGGKPIQ;
HEHGGGKPIQG; EHGGGKPIQGS; HGGGKPIQGSN; GGGKPIQGSNF; GGKPIQGSNFH;
GKPIQGSNFHF; KPIQGSNFHFF; PIQGSNFHFFA; IQGSNFHFFAV; QGSNFHFFAVG;
GSNFHFFAVGG; SNFHFFAVGGE; NFHFFAVGGEP; FHFFAVGGEPL; HFFAVGGEPLE;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

FFAVGGEPLEM; FAVGGEPLEMQ; AVGGEPLEMQG; VGGEPLEMQGV; GGEPLEMQGVL;
GEPLEMQGVLM; EPLEMQGVLMN; PLEMQGVLMNY; LEMQGVLMNYR; EMQGVLMNYRS;
MQGVLMNYRSK; QGVLMNYRSKY; GVLMNYRSKYP; VLMNYRSKYPD; LMNYRSKYPDG;
MNYRSKYPDGT; NYRSKYPDGTI; YRSKYPDGTIT; RSKYPDGTITP; SKYPDGTITPK;
KYPDGTITPKN; YPDGTITPKNP; PDGTITPKNPT; DGTITPKNPTA; GTITPKNPTAQ;
TITPKNPTAQS; ITPKNPTAQSQ; TPKNPTAQSQV; PKNPTAQSQVM; KNPTAQSQVMN;
NPTAQSQVMNT; PTAQSQVMNTD; TAQSQVMNTDH; AQSQVMNTDHK; QSQVMNTDHKA;
SQVMNTDHKAY; QVMNTDHKAYL; VMNTDHKAYLD; MNTDHKAYLDK; NTDHKAYLDKN;
TDHKAYLDKNN; DHKAYLDKNNA; HKAYLDKNNAY; KAYLDKNNAYP; AYLDKNNAYPV;
YLDKNNAYPVE; LDKNNAYPVEC; DKNNAYPVECW; KNNAYPVECWV; NNAYPVECWVP;
NAYPVECWVPD; AYPVECWVPDP; YPVECWVPDPS; PVECWVPDPSR; VECWVPDPSRN;
ECWVPDPSRNE; CWVPDPSRNEN; WVPDPSRNENA; VPDPSRNENAR; PDPSRNENARY;
DPSRNENARYF; PSRNENARYFG; SRNENARYFGT; RNENARYFGTF; NENARYFGTFT;
ENARYFGTFTG; NARYFGTFTGG; ARYFGTFTGGE; RYFGTFTGGEN; YFGTFTGGENV;
FGTFTGGENVP; GTFTGGENVPP; TFTGGENVPPV; FTGGENVPPVL; TGGENVPPVLH;
GGENVPPVLHV; GENVPPVLHVT; ENVPPVLHVTN; NVPPVLHVTNT; VPPVLHVTNTA;
PPVLHVTNTAT; PVLHVTNTATT; VLHVTNTATTV; LHVTNTATTVL; HVTNTATTVLL;
VTNTATTVLLD; TNTATTVLLDE; NTATTVLLDEQ; TATTVLLDEQG; ATTVLLDEQGV;
TTVLLDEQGVG; TVLLDEQGVGP; VLLDEQGVGPL; LLDEQGVGPLC; LDEQGVGPLCK;
DEQGVGPLCKA; EQGVGPLCKAD; QGVGPLCKADS; GVGPLCKADSL; VGPLCKADSLY;
GPLCKADSLYV; PLCKADSLYVS; LCKADSLYVSA; CKADSLYVSAA; KADSLYVSAAD;
ADSLYVSAADI; DSLYVSAADIC; SLYVSAADICG; LYVSAADICGL; YVSAADICGLF;
VSAADICGLFT; SAADICGLFTN; AADICGLFTNS; ADICGLFTNSS; DICGLFTNSSG;
ICGLFTNSSGT; CGLFTNSSGTQ; GLFTNSSGTQQ; LFTNSSGTQQW; FTNSSGTQQWR;
TNSSGTQQWRG; NSSGTQQWRGL; SSGTQQWRGLA; SGTQQWRGLAR; GTQQWRGLARY;
TQQWRGLARYF; QQWRGLARYFK; QWRGLARYFKI; WRGLARYFKIR; RGLARYFKIRL;
GLARYFKIRLR; LARYFKIRLRK; ARYFKIRLRKR; RYFKIRLRKRS; YFKIRLRKRSV;
FKIRLRKRSVK; KIRLRKRSVKN; IRLRKRSVKNP; RLRKRSVKNPY; LRKRSVKNPYP;
RKRSVKNPYPI; KRSVKNPYPIS; RSVKNPYPISF; SVKNPYPISFL; VKNPYPISFLL;
KNPYPISFLLS; NPYPISFLLSD; PYPISFLLSDL; YPISFLLSDLI; PISFLLSDLIN;
ISFLLSDLINR; SFLLSDLINRR; FLLSDLINRRT; LLSDLINRRTQ; LSDLINRRTQR;
SDLINRRTQRV; DLINRRTQRVD; LINRRTQRVDG; INRRTQRVDGQ; NRRTQRVDGQP;
RRTQRVDGQPM; RTQRVDGQPMY; TQRVDGQPMYG; QRVDGQPMYGM; RVDGQPMYGME;
VDGQPMYGMES; DGQPMYGMESQ; GQPMYGMESQV; QPMYGMESQVE; PMYGMESQVEE;
MYGMESQVEEV; YGMESQVEEVR; GMESQVEEVRV; MESQVEEVRVF; ESQVEEVRVFD;
SQVEEVRVFDG; QVEEVRVFDGT; VEEVRVFDGTE; EEVRVFDGTER; EVRVFDGTERL;
VRVFDGTERLP; RVFDGTERLPG; VFDGTERLPGD; FDGTERLPGDP; DGTERLPGDPD;
GTERLPGDPDM; TERLPGDPDMI; ERLPGDPDMIR; RLPGDPDMIRY; LPGDPDMIRYI;
PGDPDMIRYID; GDPDMIRYIDK; DPDMIRYIDKQ; PDMIRYIDKQG; DMIRYIDKQGQ;
MIRYIDKQGQL; IRYIDKQGQLQ; RYIDKQGQLQT; YIDKQGQLQTK; IDKQGQLQTKM;
DKQGQLQTKML; TGAFIVIHLI; GAFIVIHLIN; AFIVIHLINA; FIVIHLINAA;
IVIHLINAAF; VIHLINAAFV; ATFKLVLFWGW; TFKLVLFWGWC; FKLVLFWGWCF;
KLVLFWGWCFR; LVLFWGWCFRP; VLFWGWCFRPF; LFWGWCFRPFK; FWGWCFRPFKT;
WGWCFRPFKTL; GWCFRPFKTLK; WCFRPFKTLKA; CFRPFKTLKAF; FRPFKTLKAFT;
RPFKTLKAFTQ; PFKTLKAFTQM; FKTLKAFTQMQ; KTLKAFTQMQL; TLKAFTQMQLL;
LKAFTQMQLLT; KAFTQMQLLTM; AFTQMQLLTMG; FTQMQLLTMGV; ILFSCNIKNTF;
LFSCNIKNTFP; FSCNIKNTFPH; SCNIKNTFPHA; CNIKNTFPHAY; NIKNTFPHAYI;
IKNTFPHAYII; KNTFPHAYIIF; NTFPHAYIIPH; TFPHAYIIFHP; KSIHTYLRIQP;
SIHTYLRIQPF; IHTYLRIQPFL; HTYLRIQPFLP; TYLRIQPFLPF; YLRIQPFLPFN;
LRIQPFLPFNN; RIQPFLPFNNS; IQPFLPFNNSR; QPFLPFNNSRL; PFLPFNNSRLY;
FLPFNNSRLYI; LPFNNSRLYIS; PFNNSRLYISC; FNNSRLYISCK; NNSRLYISCKI;
NSRLYISCKIS; SRLYISCKISY; RLYISCKISYR; LYISCKISYRP; YISCKISYRPK;
ISCKISYRPKP; SCKISYRPKPN; IYFGPKIYLSY; YFGPKIYLSYK; FGPKIYLSYKS;
GPKIYLSYKSS; PKIYLSYKSSL; KIYLSYKSSLQ; IYLSYKSSLQG; YLSYKSSLQGF;
LSYKSSLQGFR; SYKSSLQGFRD; YKSSLQGFRDR; KSSLQGFRDRI; SSLQGFRDRIL;
SLQGFRDRILI; LQGFRDRILIH; QGFRDRILIHC; GFRDRILIHCN; FRDRILIHCNQ;
RDRILIHCNQA; DRILIHCNQAW; RILIHCNQAWW; ILIHCNQAWWK; LIHCNQAWWKY;
IHCNQAWWKYL; HCNQAWWKYLG; CNQAWWKYLGS; NQAWWKYLGSF; QAWWKYLGSFV;
FSSCPFYIFKN; SSCPFYIFKNN; SCPFYIFKNNH; CPFYIFKNNHV; PFYIFKNNHVL;
FYIFKNNHVLI; YIFKNNHVLIY; IFKNNHVLIYS; FKNNHVLIYST; KNNHVLIYSYT;
CCFSTINGTFK; PVSSFRYIENN; VSSFRYIENNT; SSFRYIENNTV; SFRYIENNTVQ;
FRYIENNTVQK; RYIENNTVQKI; YIENNTVQKIK; IENNTVQKIKY; ENNTVQKIKYY;
NNTVQKIKYYR; NTVQKIKYYRI; TVQKIKYYRIH; VQKIKYYRIHF; QKIKYYRIHFR;
QTVQPSNTCHI; TVQPSNTCHIL; VQPSNTCHILF; HFFPGHMKGIY; FFPGHMKGIYS;
FPGHMKGIYSF; PGHMKGIYSFF; GHMKGIYSFFS; NCIYCLLTNTF; CIYCLLTNTFL;
IYCLLTNTFLI; YCLLTNTFLIF; CLLTNTFLIFT; LLTNTFLIFTF; LTNTFLIFTFC;
TNTFLIFTFCK; NTFLIFTFCKN; TFLIFTFCKNS; FLIFTFCKNNS; LIFTFCKNNSI;
IFTFCKNNSIC; FTFCKNNSICK; TFCKNNSICKV; FCKNNSICKVL; CKNNSICKVLF;
KNNSICKVLFM; NNSICKVLFMI; NSICKVLFMIL; SICKVLFMILK; ICKVLFMILKV;
CKVLFMILKVI; KVLFMILKVIR; VLFMILKVIRL; LFMILKVIRLV; FMILKVIRLVF;
MILKVIRLVFF; ILKVIRLVFFL; LKVIRLVFFLT; KVIRLVFFLTL; VIRLVFFLTLF;
IRLVFFLTLFT; RLVFFLTLFTL; LVFFLTLFTLL; VFFLTLFTLLY; FFLTLFTLLYI;
FLTLFTLLYIV; LTLFTLLYIVL; TLFTLLYIVLK; LFTLLYIVLKF; KHILTLCLYCI;
HILTLCLYCIL; ILTLCLYCILS; LTLCLYCILSN; FPRHLLCFFRL; PRHLLCFFRLF;
RHLLCFFRLFW; HLLCFFRLFWA; LLCFFRLFWAK; LCFFRLFWAKI; CFFRLFWAKIM;
FFRLFWAKIML; FRLFWAKIMLL; APLNAFFYSMV; PLNAFFYSMVW; LNAFFYSMVWI;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

NAFFYSMVWIS; AFFYSMVWISS; KTKGTQLLTEI; TKGTQLLTEII; KGTQLLTEIIN;
GTQLLTEIINC; TQLLTEIINCR; QLLTEIINCRN; LLTEIINCRNS; LTEIINCRNSM;
TEIINCRNSMS; EIINCRNSMSM; IINCRNSMSMW; INCRNSMSMWS; KEYNIMPSTHV;
EYNIMPSTHVS; YNIMPSTHVST; NIMPSTHVSTN; IMPSTHVSTNK; MPSTHVSTNKS;
PSTHVSTNKSY; STHVSTNKSYR; THVSTNKSYRI; HVSTNKSYRIF; VSTNKSYRIFF;
STNKSYRIFFH; TNKSYRIFFHK; NKSYRIFFHKF; KSYRIFFHKFF; SYRIFFHKFFI;
YRIFFHKFFIQ; RIFFHKFFIQN; IFFHKFFIQNL; FFHKFFIQNLS; FHKFFIQNLSF;
HKFFIQNLSFF; KFFIQNLSFFF; FFIQNLSFFFS; FIQNLSFFFSS; IQNLSFFFSSI;
QNLSFFFSSIH; NLSFFFSSIHS; LSFFFSSIHSK; SFFFSSIHSKA; FFFSSIHSKAG;
FFSSIHSKAGK; FSSIHSKAGKG; SSIHSKAGKGS; SIHSKAGKGSI; IHSKAGKGSIT;
HSKAGKGSITK; SKAGKGSITKY; KAGKGSITKYS; AGKGSITKYSL; GKGSITKYSLT;
KGSITKYSLTK; GSITKYSLTKK; SITKYSLTKKL; ITKYSLTKKLV; IRGKVFRVFYL;
RGKVFRVFYLS; GKVFRVFYLSF; KVFRVFYLSFF; VFRVFYLSFFF; FRVFYLSFFFG;
RVFYLSFFFGW; VFYLSFFFGWC; VLRICCCFFIT; LRICCCFFITG; RICCCFFITGK;
ICCCFFITGKH; CCCFFITGKHI; CCFFITGKHIF; CFFITGKHIFM; FFITGKHIFMA;
FITGKHIFMAK; IFIPFFIKGTP; FIPFFIKGTPP; IPFFIKGTPPG; PFFIKGTPPGL;
FFIKGTPPGLP; FIKGTPPGLPL; IKGTPPGLPLF; KGTPPGLPLFC; GTPPGLPLFCS;
TPPGLPLFCSI; PPGLPLFCSIG; PGLPLFCSIGW; GLPLFCSIGWH; LPLFCSIGWHL;
SFRSLKGVSPI; FRSLKGVSPII; RSLKGVSPIIW; SLKGVSPIIWT; LKGVSPIIWTH;
KGVSPIIWTHH; GVSPIIWTHHC; VSPIIWTHHCR; SPIIWTHHCRV; PIIWTHHCRVS;
IIWTHHCRVSS; IWTHHCRVSSV; WTHHCRVSSVR; THHCRVSSVRS; HHCRVSSVRSK;
HCRVSSVRSKP; CRVSSVRSKPN; RVSSVRSKPNH; VSSVRSKPNHC; SSVRSKPNHCV;
SVRSKPNHCVK; VRSKPNHCVKQ; RSKPNHCVKQS; SKPNHCVKQSM; KPNHCVKQSMQ;
QSIQTKGSFLK; SIQTKGSFLKN; IQTKGSFLKNF; QTKGSFLKNFL; TKGSFLKNFLF;
KGSFLKNFLFK; GSFLKNFLFKC; SFLKNFLFKCL; FLKNFLFKCLN; LKNFLFKCLNL;
KNFLFKCLNLS; HSMQGQCTEGF; SMQGQCTEGFL; MQGQCTEGFLE; QGQCTEGFLEQ;
GQCTEGFLEQI; QCTEGFLEQIG; CTEGFLEQIGH; TEGFLEQIGHS; EGFLEQIGHSL;
GFLEQIGHSLQ; FLEQIGHSLQY; LEQIGHSLQYR; EQIGHSLQYRV; QIGHSLQYRVS;
IGHSLQYRVSG; GHSLQYRVSGQ; HSLQYRVSGQR; SLQYRVSGQRG; LQYRVSGQRGK;
QYRVSGQRGKS; YRVSGQRGKSA; RVSGQRGKSAQ; VSGQRGKSAQT; SGQRGKSAQTS;
GQRGKSAQTSE; QRGKSAQTSEL; RGKSAQTSELL; GKSAQTSELLQ; KSAQTSELLQV;
SAQTSELLQVP; AQTSELLQVPK; QTSELLQVPKS; TSELLQVPKSG; ATFTSCSIFLY;
TFTSCSIFLYK; FTSCSIFLYKV; TSCSIFLYKVF; SCSIFLYKVFI; CSIFLYKVFIL;
SIFLYKVFILF; IFLYKVFILFI; FLYKVFILFIL; LYKVFILFILS; YKVFILFILSS;
KVFILFILSSS; VFILFILSSSP; FILFILSSSPP; ILFILSSSPPL; LFILSSSPPLS;
FILSSSPPLSG; AFLIKGRFPQA; FLIKGRFPQAA; LIKGRFPQAAL; IKGRFPQAALS;
KGRFPQAALSR; GRFPQAALSRP; RFPQAALSRPK; FPQAALSRPKR; PQAALSRPKRS;
QAALSRPKRSM; AALSRPKRSMS; ALSRPKRSMSS; LSRPKRSMSSM; SRPKRSMSSMD;
RPKRSMSSMDS; PKRSMSSMDSS; KRSMSSMDSSL; RSMSSMDSSLL; SMSSMDSSLLR;
MSSMDSSLLRT; SSMDSSLLRTL; SMDSSLLRTLS

| BK virus reading frame 2 |
|---|

8 mers:

GFPQIVLL; FPQIVLLG; PQIVLLGL; QIVLLGLR; IVLLGLRK; VLLGLRKS; LLGLRKSL;
LGLRKSLH; GLRKSLHT; LRKSLHTL; RKSLHTLT; KSLHTLTT; EKGWRQRR; KGWRQRRP;
GWRQRRPR; WRQRRPRP; RQRRPRPL; QRRPRPLI; RRPRPLIY; RPRPLIYY; PRPLIYYK;
RPLIYYKK; PLIYYKKK; LIYYKKKG; IYYKKKGH; YYKKKGHR; YKKKGHRE; KKKGHREE;
KKGHREEL; KGHREELL; GHREELLT; HREELLTH; REELLTHG; EELLTHGM; ELLTHGMQ;
LLTHGMQP; LTHGMQPN; THGMQPNH; HGMQPNHD; GMQPNHDL; MQPNHDLR; QPNHDLRK;
PNHDLRKE; NHDLRKES; HDLRKESA; LTGECSQT; TGECSQTM; GECSQTMT; ECSQTMTS;
CSQTMTSG; SQTMTSGR; QTMTSGRK; TMTSGRKV; MTSGRKVH; TSGRKVHD; SGRKVHDS;
GRKVHDSQ; RKVHDSQG; KVHDSQGG; VHDSQGGA; HDSQGGAA; DSQGGAAY; SQGGAAYP;
QGGAAYPW; GGAAYPWN; GAAYPWNA; AAYPWNAA; AYPWNAAK; YPWNAAKP; PQEGKCMT;
QEGKCMTD; EGKCMTDM; GKCMTDMF; KCMTDMFC; CMTDMFCE; MTDMFCEP; TDMFCEPR;
DMFCEPRN; MFCEPRNL; FCEPRNLG; CEPRNLGL; EPRNLGLV; PRNLGLVP; RNLGLVPS;
TGQRPWFC; GQRPWFCA; QRPWFCAS; RPWFCASC; PWFCASCH; WFCASCHD; FCASCHDK;
CASCHDKL; ASCHDKLQ; KLVKPGLE; LVKPGLEQ; VKPGLEQK; KPGLEQKK; PGLEQKKE;
GLEQKKEL; LEQKKELR; EQKKELRG; QKKELRGF; KKELRGFL; KELRGFLF; ELRGFLFL;
LRGFLFLF; SFCWNFVE; FCWNFVEV; CWNFVEVK; WNFVEVKT; NFVEVKTV; TGKTKVPL;
GKTKVPLL; KTKVPLLY; TKVPLLYL; KVPLLYLL; VPLLYLLQ; PLLYLLQF; LLYLLQFF;
FFLYFQVH; FLYFQVHG; LYFQVHGC; YFQVHGCC; FQVHGCCS; QVHGCCSS; VHGCCSST;
HGCCSSTF; GCCSSTFG; CCSSTFGG; CSSTFGGP; SSTFGGPS; STFGGPSC; TFGGPSCQ;
FGGPSCQC; GGPSCQCI; GCCCHRIF; CCCHRIFS; CCHRIFSG; NCCWGGCC; CCWGGCCC;
CWGGCCCY; WGGCCCYR; GGCCCYRS; GCCCYRSS; CCCYRSSN; CCYRSSNC; CYRSSNCI;
YRSSNCIP; RSSNCIPC; SSNCIPCY; SNCIPCYC; NCIPCYCR; CIPCYCRG; IPCYCRGH;
PCYCRGHN; CYCRGHNK; YCRGHNKY; CRGHNKYL; RGHNKYLR; GHNKYLRG; HNKYLRGY;
NKYLRGYS; KYLRGYSC; YLRGYSCY; LRGYSCYR; RGYSCYRP; GYSCYRPN; YSCYRPNS;
SCYRPNSS; CYRPNSSN; YRPNSSNI; RPNSSNIC; PNSSNICC; NSSNICCN; SSNICCNC;
SNICCNCW; NICCNCWC; ICCNCWCS; CCNCWCSW; CNCWCSWG; NCWCSWGY; CWCSWGYC;
WCSWGYCW; CSWGYCWV; SWGYCWVC; WGYCWVCC; GYCWVCCF; YCWVCCFN; CWVCCFNS;
WVCCFNSN; VCCFNSNC; LGSQSFHC; GSQSFHCR; SQSFHCRP; QSFHCRPL; SFHCRPLS;
FHCRPLSA; HCRPLSAI; CRPLSAIR; RPLSAIRH; PLSAIRHG; LSAIRHGF; SAIRHGFG;
AIRHGFGI; IRHGFGIV; YSVSWCKY; SVSWCKYF; VSWCKYFC; ALGSFFVC; LGSFFVCY;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

GSFFVCYY; SFFVCYYF; FFVCYYFP; FVCYYFPG; VCYYFPGF; CYYFPGFV; YYFPGFVA;
YFPGFVAC; FPGFVACY; YTFYNLTG; TFYNLTGI; FYNLTGIA; YNLTGIAE; NLTGIAEK;
LTGIAEKN; TGIAEKNR; GIAEKNRK; IAEKNRKI; AEKNRKIF; IFGGNYLD; FGGNYLDN;
GGNYLDNC; GNYLDNCK; NYLDNCKC; YLDNCKCP; LDNCKCPY; DNCKCPYK; NCKCPYKL;
CKCPYKLL; KGRYPCTF; GRYPCTFW; RYPCTFWP; YPCTFWPY; PCTFWPYL; QYRRSYTK;
YRRSYTKN; RRSYTKNG; RSYTKNGL; SYTKNGLK; YTKNGLKK; TKNGLKKS; KNGLKKST;
NGLKKSTK; GLKKSTKC; LKKSTKCT; KKSTKCTF; KSTKCTFR; STKCTFRR; TKCTFRRV;
KCTFRRVY; CTFRRVYR; TFRRVYRK; FRRVYRKN; RRVYRKNY; RVYRKNYC; VYRKNYCP;
YRKNYCPR; RKNYCPRR; KNYCPRRC; SKNCSSMD; KNCSSMDV; NCSSMDVA; CSSMDVAF;
SSMDVAFT; SMDVAFTS; MDVAFTSR; DVAFTSRP; VAFTSRPV; AFTSRPVR; FTSRPVRD;
TSRPVRDC; SRPVRDCN; RPVRDCNT; PVRDCNTC; VRDCNTCS; RWPQPKEK; WPQPKEKE;
PQPKEKES; QPKEKESV; PKEKESVQ; KEKESVQG; EKESVQGQ; KESVQGQL; ESVQGQLP;
SVQGQLPK; VQGQLPKS; QGQLPKSQ; GQLPKSQR; QLPKSQRN; LPKSQRNP; PKSQRNPC;
KSQRNPCK; SQRNPCKC; QRNPCKCQ; RNPCKCQN; NPCKCQNY; TQKWGIQM; QKWGIQMK;
KWGIQMKT; WGIQMKTL; GIQMKTLG; IQMKTLGA; QMKTLGAL; MKTLGALV; VLKMTLAV;
LKMTLAVI; KMTLAVIA; MTLAVIAQ; TLAVIAQR; LAVIAQRE; AVIAQREK; VIAQREKC;
IAQREKCF; AQREKCFP; QREKCFPV; REKCFPVT; EKCFPVTA; KCFPVTAQ; CFPVTAQQ;
FPVTAQQE; PVTAQQEF; VTAQQEFP; TAQQEFPS; AQQEFPSP; QQEFPSPI; LYKQRLLE;
LACLTFMQ; ACLTFMQG; CLTFMQGH; LTFMQGHK; TFMQGHKK; FMQGHKKC; MQGHKKCM;
QGHKKCMS; GHKKCMSM; HKKCMSMV; KKCMSMVE; KCMSMVEE; CMSMVEEN; MSMVEENL;
SMVEENLF; MVEENLFK; VEENLFKA; EENLFKAV; ENLFKAVI; LFKAVIST; FKAVISTS;
FKAVISTS; KAVISTSL; AVISTSLL; VENPWKCR; ENPWKCRE; NPWKCREC; ITGQSTLM;
TGQSTLMV; GQSTLMVL; PLKTQQPS; LKTQQPSP; KTQQPSPR; ILTIRPIW; LTIRPIWT;
TIRPIWTK; IRPIWTKT; RPIWTKTM; PIWTKTML; IWTKTMLI; WTKTMLIQ; TKTMLIQL;
KTMLIQLS; TMLIQLSA; MLIQLSAG; LIQLSAGY; IQLSAGYL; QLSAGYLI; LSAGYLIP;
SAGYLIPV; AGYLIPVE; GYLIPVEM; YLIPVEMK; LIPVEMKM; IPVEMKML; PVEMKMLG;
VEMKMLGI; EMKMLGIL; MKMLGILG; KMLGILGL; MLGILGLS; LGILGLSQ; GILGLSQE;
ILGLSQEG; LGLSQEGK; GLSQEGKM; LSQEGKMF; SQEGKMFP; QEGKMFPQ; EGKMFPQY;
GKMFPQYF; KMFPQYFM; PTQLPQCC; MNRVWGLF; NRVWGLFV; RVWGLFVK; VWGLFVKL;
WGLFVKLI; GLFVKLIA; LFVKLIAC; FVKLIACM; VKLIACMF; KLIACMFQ; LIACMFQL;
IACMFQLL; ACMFQLLI; CMFQLLIF; MFQLLIFV; FQLLIFVA; QLLIFVAC; LLIFVACL;
LIFVACLL; IFVACLLT; FVACLLTA; VACLLTAL; ACLLTALE; CLLTALEH; LLTALEHN;
LTALEHNS; TALEHNSG; ALEHNSGE; LEHNSGEA; EHNSGEAL; HNSGEALQ; NSGEALQD;
SGEALQDI; GEALQDIL; EALQDILR; ALQDILRS; LQDILRSA; RILTQFPF; ILTQFPFC;
TGEPREWM; GEPREWMG; EPREWMGS; PREWMGSL; REWMGSLC; EWMGSLCM; WMGSLCMV;
MGSLCMVW; GSLCMVWN; SLCMVWNP; LCMVWNPR; KRLGCLMA; RLGCLMAQ; LGCLMAQK;
GCLMAQKD; CLMAQKDF; LMAQKDFQ; MAQKDFQG; AQKDFQGT; QKDFQGTQ; KDFQGTQI;
DILTNRDN; ILTNRDNC; LTNRDNCK; TNRDNCKP; NRDNCKPK; RDNCKPKC; DNCKPKCF;
NCKPKCFK; CKPKCFKQ; KPKCFKQV; PKCFKQVL; KCFKQVLL; CFKQVLLL; FKQVLLLY;
KQVLLLYI; QVLLLYIY; VLLLYIYI; MLLLYKPL; LLLYKPLL; LLYKPLLS; LYKPLLSL;
YKPLLSLC; KPLLSLCY; PLLSLCYF; LLSLCYFG; LSLCYFGG; SLCYFGGG; LCYFGGGV;
CYFGGGVL; YFGGGVLG; FGGGVLGL; GGGVLGLL; GGVLGLLK; GVLGLLKH; KPLHKCNS;
LWGSDLWE; WGSDLWES; GSDLWESS; SDLWESSA; DLWESSAG; LWESSAGA; WESSAGAE;
ESSAGAEV; SSAGAEVS; SAGAEVSE; AGAEVSET; GAEVSETW; AEVSETWE; EVSETWEE;
VSETWEEH; SETWEEHC; ETWEEHCD; TWEEHCDW; WEEHCDWD; EEHCDWDS; EHCDWDSV;
HCDWDSVL; CDWDSVLD; DWDSVLDP; WDSVLDPC; DSVLDPCP; SVLDPCPE; VLDPCPES;
LDPCPESS; DPCPESSV; PCPESSVS; CPESSVSE; PESSVSES; ESSVSESS; SSVSESSS;
SVSESSSL; VSESSSLV; SESSSLVI; ESSSLVIS; SSSLVISR; SSLVISRI; SLVISRIH;
LVISRIHF; VISRIHFP; ISRIHFPM; SRIHFPMH; RIHFPMHI; IHFPMHIL; HFPMHILY;
FPMHILYF; PMHILYFI; MHILYFIL; HILYFILE; ILYFILEK; LYFILEKV; YFILEKVY;
FILEKVYI; ILEKVYIL; LEKVYILI; EKVYILIS; KVYILISE; VYILISES; YILISESS;
ILISESSL; LISESSLS; ISESSLSF; SESSLSPH; ESSLSPHS; SSLSFHST; SLSFHSTI;
LSFHSTIL; SFHSTILD; FHSTILDC; HSTILDCI; STILDCIS; TILDCISV; ILDCISVA;
LDCISVAK; DCISVAKS; CISVAKSA; ISVAKSAT; SVAKSATG; VAKSATGL; AKSATGLN;
KSATGLNQ; SATGLNQI; ATGLNQIS; TGLNQISS; GLNQISSS; LNQISSSN; NQISSSNK;
QISSSNKV; ISSSNKVI; SSSNKVIP; SSNKVIPL; SNKVIPLC; NKVIPLCK; KVIPLCKI;
VIPLCKIL; IPLCKILF; PLCKILFS; LCKILFSS; CKILFSSK; KILFSSKN; ILFSSKNS;
LFSSKNSE; FSSKNSEF; SSKNSEFC; SKNSEFCK; KNSEFCKD; NSEFCKDF; SEFCKDPL;
EFCKDFLK; FCKDFLKY; CKDFLKYI; KDFLKYIL; DFLKYILG; FLKYILGL; LKYILGLK;
KYILGLKS; YILGLKSI; ILGLKSIC; LGLKSICL; GLKSICLT; LKSICLTN; KSICLTNL;
SICLTNLA; ICLTNLAC; CLTNLACR; LTNLACRV; TNLACRVL; NLACRVLG; LACRVLGT;
ACRVLGTG; CRVLGTGY; RVLGTGYS; VLGTGYSF; LGTGYSFI; GTGYSFIV; TGYSFIVT;
GYSFIVTK; YSFIVTKP; SFIVTKPG; FIVTKPGG; IVTKPGGN; VTKPGGNI; TKPGGNIW;
KPGGNIWV; PGGNIWVL; GGNIWVLL; GNIWVLLF; NIWVLLFK; IWVLLFKC; WVLLFKCF;
VLLFKCFF; LLFKCFFS; LFKCFFSK; FKCFFSKF; KCFFSKFT; CFFSKFTL; FFSKFTLT;
FSKFTLTL; SKFTLTLP; KFTLTLPS; FTLTLPSK; SLKLSKLF; LKLSKLFI; KLSKLFIP;
LSKLFIPC; SKLFIPCP; KLFIPCPE; LFIPCPEG; FIPCPEGK; IPCPEGKS; PCPEGKSF;
CPEGKSFD; PEGKSFDS; EGKSFDSA; GKSFDSAP; KSFDSAPV; SFDSAPVP; FDSAPVPF;
DSAPVPFT; SAPVPFTS; APVPFTSS; PVPFTSSK; VPFTSSKT; PFTSSKTT; FTSSKTTM;
TSSKTTMY; SIATPSSK; IATPSSKV; ATPSSKVS; TPSSKVSL; PSSKVSLS; SSKVSLSM;
SKVSLSMG; KVSLSMGR; VSLSMGRF; SLSMGRFT; LSMGRFTF; SMGRFTFK; MGRFTFKA;
GRFTFKAL; RFTFKALP; FTFKALPP; TFKALPPH; FKALPPHK; KALPPHKS; ALPPHKSN;
LPPHKSNN; PPHKSNNP; PHKSNNPA; HKSNNPAA; KSNNPAAS; SNNPAASV; NNPAASVV;
NPAASVVF; PAASVVFP; AASVVFPL; ASVVFPLS; SVVFPLSM; VVFPLSMG; VFPLSMGP;
FPLSMGPL; PLSMGPLN; LSMGPLNN; SMGPLNNQ; MGPLNNQY; GPLNNQYL; PLNNQYLL;
LNNQYLLL; NNQYLLLG; NQYLLLGT; QYLLLGTL; YLLLGTLK; LLLGTLKT; LLGTLKTI;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

LGTLKTIQ; GTLKTIQC; TLKTIQCK; LKTIQCKK; KTIQCKKS; TIQCKKSN; IQCKKSNI;
QCKKSNIT; CKKSNITE; KKSNITES; KSNITESI; SNITESIL; NITESILG; ITESILGS;
TESILGSK; ESILGSKQ; SILGSKQC; ILGSKQCS; LGSKQCSQ; GSKQCSQA; SKQCSQAT;
KQCSQATP; QCSQATPA; CSQATPAI; SQATPAIY; QATPAIYC; ATPAIYCS; TPAIYCSS;
PAIYCSST; AIYCSSTA; IYCSSTAF; YCSSTAFP; APNIKSIL; PNIKSILS; NIKSILSN;
IKSILSNI; LNLSVSIS; NLSVSISS; LSVSISSL; SVSISSLV; VSISSLVI; RVSTLFLA;
VSTLFLAK; STLFLAKT; TLFLAKTV; LFLAKTVS; FLAKTVST; LAKTVSTA; AKTVSTAC;
FLLSAKII; LLSAKIIA; LSAKIIAF; SAKIIAFA; AKIIAFAK; KIIAFAKC; IIAFAKCF;
IAFAKCFS; HPFLHSSTL; FLHSSTLY; NSKYIPNN; SKYIPNNK; KYIPNNKN; YIPNNKNT;
IPNNKNTS; PNNKNTSS; NNKNTSSH; NKNTSSHF; KNTSSHFV; NTSSHFVS; TSSHFVST;
SSHFVSTA; SHFVSTAY; HFVSTAYS; FVSTAYSV; VSTAYSVI; STAYSVIN; TAYSVINF;
AYSVINFQ; YSVINFQD; SVINFQDT; VINFQDTC; INFQDTCF; NFQDTCFV; FQDTCFVS;
QDTCFVSS; DTCFVSSG; TCFVSSGS; CFVSSGSS; VSSGSSGL; SSGSSGLK;
SGSSGLKS; GSSGLKSC; SSGLKSCS; SGLKSCSF; GLKSCSFK; LKSCSFKP; KSCSFKPP;
MLSSIVWY; LSSIVWYG; SSIVWYGS; SIVWYGSL; IVWYGSLV; VWYGSLVK; WYGSLVKA;
YGSLVKAL; GSLVKALY; SLVKALYS; LVKALYSK; VKALYSKY; KALYSKYS; ALYSKYSL;
LYSKYSLL; YSKYSLLT; SKYSLLTP; KYSLLTPL; YSLLTPLQ; SLLTPLQI; LLTPLQIK;
LTPLQIKK; TPLQIKKL; PLQIKKLK; LQIKKLKV; QIKKLKVH; IKKLKVHS; KKLKVHSF;
QKLLIAET; KLLIAETL; LLIAETLC; LIAETLCL; IAETLCLC; AETLCLCG; ETLCLCGV;
TLCLCGVK; LCLCGVKK; CLCGVKKN; LCGVKKNI; CGVKKNII; GVKKNIIL; VKKNIILC;
KNIILCP; KNIILCPA; NIILCPAH; IILCPAHM; ILCPAHMC; LCPAHMCL; CPAHMCLL;
PAHMCLLI; AHMCLLIK; HMCLLIKV; MCLLIKVT; CLLIKVTE; LLIKVTEY; LIKVTEYF;
IKVTEYFS; KVTEYFSI; VTEYFSIS; TEYFSISF; EYFSISFL; YFSISFLY; FSISFLYR;
SISFLYRI; AFSLVVYT; FSLVVYTA; SLVVYTAK; LVVYTAKQ; VVYTAKQA; VYTAKQAR;
YTAKQARV; TAKQARVL; AKQARVLL; KQARVLLL; QARVLLLN; ARVLLLNT; RVLLLNTA;
LRNWCRSE; RNWCRSEG; NWCRSEGK; WCRSEGKS; CRSEGKSL; RSEGKSLG; SEGKSLGS;
EGKSLGSS; GKSLGSST; KSLGSSTF; SLGSSTFL; LGSSTFLF; GSSTFLFF; SSTFLFFL;
STFLFFLG; TFLFFLGG; FLFFLGGV; LFFLGGVE; FFLGGVEC; ESAVASSS; SAVASSSL;
AVASSSLA; VASSSLAN; ASSSLANI; SSSLANIS; SSLANISS; SLANISSW; LANISSWQ;
ANISSWQN; NISSWQNK; ISSWQNKS; SSWQNKSS; SWQNKSSH; WQNKSSHF; QNKSSHF;
NKSSSHFS; KSSSHFSL; SSSHFSLK; SSHFSLKE; SHFSLKEL; HFSLKELH; FSLKELHQ;
SLKELHQD; LKELHQDS; KELHQDSH; ELHQDSHS; LHQDSHSS; HQDSHSSV; QDSHSSVP;
VGTYKKNN; GTYKKNNY; TYKKNNYL; YKKNNYLG; KKNNYLGP; KNNYLGPF; NNYLGPFN;
NYLGPFNI; YLGPFNIL; LGPFNILL; GPFNILLF; PFNILLFI; VSYLKALD; SYLKALDL;
REFLQLFG; EFLQLFGP; FLQLFGPT; LQLFGPTI; QLFGPTIA; LFGPTIAE; FGPTIAEF;
GPTIAEFL; PTIAEFLQ; TIAEFLQL; IAEFLQLG; AEFLQLGL; EFLQLGLS; FLQLGLSQ;
LQLGLSQT; QLGLSQTT; LGLSQTTV; SSQCSSNL; SQCSSNLS; QCSSNLSK; CSSNLSKP;
SSNLSKPR; SNLSKPRA; NLSKPRAL; LSKPRALF; SKPRALFL; KPRALFLK; PRALFLKI;
RALFLKIF; ALFLKIFY; LFLKIFYL; FLKIFYLN; LKIFYLNA; KIFYLNAL; IFYLNALI;
ADIACKGS; DIACKGSA; IACKGSAQ; ACKGSAQK; CKGSAQKA; KGSAQKAF; GSAQKAFW;
SAQKAFWN; AQKAFWNK; AIPCSTGY; IPCSTGYL; PCSTGYLG; CSTGYLGK; STGYLGKE;
TGYLGKEE; GYLGKEEN; YLGKEENQ; LGKEENQH; GKEENQHK; KEENQHKP; EENQHKPL;
ENQHKPLS; NQHKPLSY; QHKPLSYS; HKPLSYSR; KPLSYSRF; PLSYSRFQ; LSYSRFQN;
SYSRFQNQ; YSRFQNQA; SRFQNQAD; RFQNQADE; FQNQADEL; QNQADELP; NQADELPL;
QADELPLH; ADELPLHP; DELPLHPA; ELPLHPAP; LPLHPAPF; PLHPAPFF; LHPAPFFY;
HPAPFFYT; PAPFFYTK; APFFYTKY; PFFYTKYS; FFYTKYSF; FTKYSFS; YTKYSFSS;
TKYSFSSF; KYSFSSFY; YSFSSFYP; SFSSFYPR; FSSFYPRR; SSFYPRRP; SFYPRRPL;
FYPRRPLC; YPRRPLCQ; PRRPLCQG; RRPLCQGE; RPLCQGEI; PLCQGEIP; LCQGEIPY;
CQGEIPYT; QGEIPYTS; GEIPYTSL; EIPYTSLN; IPYTSLNK; PYTSLNKL; YTSLNKLF;
TSLNKLFS; SLNKLFSL; LNKLFSLR; NKLFSLRE; KLFSLRED; LFSLREDF; FSLREDFP;
SLREDFPR; LREDFPRQ; REDFPRQL; EDFPRQLF; DFPRQLFQ; FPRQLFQG; PRQLFQGL;
RQLFQGLK; QLFQGLKG; LFQGLKGP 9 mers:

GFPQIVLLG; FPQIVLLGL; PQIVLLGLR; QIVLLGLRK; IVLLGLRKS; VLLGLRKSL;
LLGLRKSLH; LGLRKSLHT; GLRKSLHTL; LRKSLHTLT; RKSLHTLTT; EKGWRQRRP;
KGWRQRRPR; GWRQRRPRP; WRQRRPRPL; RQRRPRPLI; QRRPRPLIY; RRPRPLIYY;
RPRPLIYYK; PRPLIYYKK; RPLIYYKKG; PLIYYKKKG; LIYYKKKGH; IYYKKKGHR;
YYKKKGHRE; YKKKGHREE; KKKGHREEL; KKGHREELL; KGHREELLT; GHREELLTH;
HREELLTHG; REELLTHGM; EELLTHGMQ; ELLTHGMQP; LLTHGMQPN; LTHGMQPNH;
THGMQPNHD; HGMQPNHDL; GMQPNHDLR; MQPNHDLRK; QPNHDLRKE; PNHDLRKES;
NHDLRKESA; LTGECSQTM; TGECSQTMT; GECSQTMTS; ECSQTMTSG; CSQTMTSGR;
SQTMTSGRK; QTMTSGRKV; TMTSGRKVH; MTSGRKVHD; TSGRKVHDS; SGRKVHDSQ;
GRKVHDSQG; RKVHDSQGG; KVHDSQGGA; VHDSQGGAA; HDSQGGAAY; DSQGGAAYP;
SQGGAAYPW; QGGAAYPWN; GGAAYPWNA; GAAYPWNAA; AAYPWNAAK; AYPWNAAKP;
PQEGKCMTD; QEGKCMTDM; EGKCMTDMF; GKCMTDMFC; KCMTDMFCE; CMTDMFCEP;
MTDMFCEPR; TDMFCEPRN; DMFCEPRNL; MFCEPRNLG; FCEPRNLGL; CEPRNLGLV;
EPRNLGLVP; PRNLGLVPS; TGQRPWFCA; GQRPWFCAS; QRPWFCASC; RPWFCASCH;
PWFCASCHD; WFCASCHDK; FCASCHDKL; CASCHDKLQ; KLVKPGLEQ; LVKPGLEQK;
VKPGLEQKK; KPGLEQKKE; PGLEQKKEL; GLEQKKELR; LEQKKELRG; EQKKELRGF;
QKKELRGFL; KKELRGFLF; KELRGFLFL; ELRGFLFLF; SFCWNFVEV; FCWNFVEVK;
CWNFVEVKT; WNFVEVKTV; TGKTKVPLL; GKTKVPLLY; KTKVPLLYL; TKVPLLYLL;
VIPFFLYFQ; IPFFLYFQV; PFFLYFQVH; FFLYFQVHG; FLYFQVHGC; LYFQVHGCC;
YFQVHGCCS; FQVHGCCSS; QVHGCCSST; VHGCCSSTF; HGCCSSTFG; GCCSSTFGG;
CCSSTFGGP; CSSTFGGPS; SSTFGGPSC; STFGGPSCQ; TFGGPSCQC; FGGPSCQCI;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

GCCCHRIFS; CCCHRIFSG; NCCWGGCCC; CCWGGCCCY; CWGGCCCYR; WGGCCCYRS;
GGCCCYRSS; GCCCYRSSN; CCCYRSSNC; CCYRSSNCI; CYRSSNCIP; YRSSNCIPC;
RSSNCIPCY; SSNCIPCYC; SNCIPCYCR; NCIPCYCRG; CIPCYCRGH; IPCYCRGHN;
PCYCRGHNK; CYCRGHNKY; YCRGHNKYL; CRGHNKYLR; RGHNKYLRG; GHNKYLRGY;
HNKYLRGYS; NKYLRGYSC; KYLRGYSCY; YLRGYSCYR; LRGYSCYRP; RGYSCYRPN;
GYSCYRPNS; YSCYRPNSS; SCYRPNSSN; CYRPNSSNI; YRPNSSNIC; RPNSSNICC;
PNSSNICCN; NSSNICCNC; SSNICCNCW; SNICCNCWC; NICCNCWCS; ICCNCWCSW;
CCNCWCSWG; CNCWCSWGY; NCWCSWGYC; CWCSWGYCW; WCSWGYCWV; CSWGYCWVC;
SWGYCWVCC; WGYCWVCCF; GYCWVCCFN; YCWVCCFNS; CWVCCFNSN; WVCCFNSNC;
LGSQSFHCR; GSQSFHCRP; SQSFHCRPL; QSFHCRPLS; SFHCRPLSA; FHCRPLSAI;
HCRPLSAIR; CRPLSAIRH; RPLSAIRHG; PLSAIRHGF; LSAIRHGFG; SAIRHGFGI;
AIRHGFGIV; YSVSWCKYF; SVSWCKYFC; ALGSFFVCY; LGSFFVCYY; GSFFVCYYF;
SFFVCYYFP; FFVCYYFPG; FVCYYFPGF; VCYYFPGFV; CYYFPGFVA; YYFPGFVAC;
YFPGFVACY; YTFYNLTGI; TFYNLTGIA; FYNLTGIAE; YNLTGIAEK; NLTGIAEKN;
LTGIAEKNR; TGIAEKNRK; GIAEKNRKI; IAEKNRKIF; IFGGNYLDN; FGGNYLDNC;
GGNYLDNCK; GNYLDNCKC; NYLDNCKCP; YLDNCKCPY; LDNCKCPYK; DNCKCPYKL;
NCKCPYKLL; KGRYPCTFW; GRYPCTFWP; RYPCTFWPY; YPCTFWPYL; QYRRSYTKN;
YRRSYTKNG; RRSYTKNGL; RSYTKNGLK; SYTKNGLKK; YTKNGLKKS; TKNGLKKST;
KNGLKKSTK; NGLKKSTKC; GLKKSTKCT; LKKSTKCTF; KKSTKCTFR; KSTKCTFRR;
STKCTFRRV; TKCTFRRVY; KCTFRRVYR; CTFRRVYRK; TFRRVYRKN; FRRVYRKNY;
RRVYRKNYC; RVYRKNYCP; VYRKNYCPR; YRKNYCPRR; RKNYCPRRC; SKNCSSMDV;
KNCSSMDVA; NCSSMDVAF; CSSMDVAFT; SSMDVAFTS; SMDVAFTSR; MDVAFTSRP;
DVAFTSRPV; VAFTSRPVR; AFTSRPVRD; FTSRPVRDC; TSRPVRDCN; SRPVRDCNT;
RPVRDCNTC; PVRDCNTCS; RWPQPKEKE; WPQPKEKES; PQPKEKESV; QPKEKESVQ;
PKEKESVQG; KEKESVQGQ; EKESVQGQL; KESVQGQLP; ESVQGQLPK; SVQGQLPKS;
VQGQLPKSQ; QGQLPKSQR; GQLPKSQRN; QLPKSQRNP; LPKSQRNPC; PKSQRNPCK;
KSQRNPCKC; SQRNPCKCQ; QRNPCKCQN; RNPCKCQNY; TQKWGIQMK; QKWGIQMKT;
KWGIQMKTL; WGIQMKTLG; GIQMKTLGA; IQMKTLGAL; QMKTLGALV; VLKMTLAVI;
LKMTLAVIA; KMTLAVIAQ; MTLAVIAQR; TLAVIAQRE; LAVIAQREK; AVIAQREKC;
VIAQREKCF; IAQREKCFP; AQREKCFPV; QREKCFPVT; REKCFPVTA; EKCFPVTAQ;
KCFPVTAQQ; CFPVTAQQE; FPVTAQQEF; PVTAQQEFP; VTAQQEFPS; TAQQEFPSP;
AQQEFPSPI; LACLTFMQG; ACLTFMQGH; CLTFMQGHK; LTFMQGHKK; TFMQGHKKC;
FMQGHKKCM; MQGHKKCMS; QGHKKCMSM; GHKKCMSMV; HKKCMSMVE; KKCMSMVEE;
KCMSMVEEN; CMSMVEENL; MSMVEENLF; SMVEENLFK; MVEENLFKA; VEENLFKAV;
EENLFKAVI; ENLFKAVIS; NLFKAVIST; LFKAVISTS; FKAVISTSL; KAVISTSLL;
VENPWKCRE; ENPWKCREC; ITGQSTLMV; TGQSTLMVL; PLKTQQPSP; LKTQQPSPR;
ILTIRPIWT; LTIRPIWTK; TIRPIWTKT; IRPIWTKTM; RPIWTKTML; PIWTKTMLI;
IWTKTMLIQ; WTKTMLIQL; TKTMLIQLS; KTMLIQLSA; TMLIQLSAG; MLIQLSAGY;
LIQLSAGYL; IQLSAGYLI; QLSAGYLIP; LSAGYLIPV; SAGYLIPVE; AGYLIPVEM;
GYLIPVEMK; YLIPVEMKM; LIPVEMKML; IPVEMKMLG; PVEMKMLGI; VEMKMLGIL;
EMKMLGILG; MKMLGILGL; KMLGILGLS; MLGILGLSQ; LGILGLSQE; GILGLSQEG;
ILGLSQEGK; LGLSQEGKM; GLSQEGKMF; LSQEGKMFP; SQEGKMFPQ; QEGKMFPQY;
EGKMFPQYF; GKMFPQYFM; MNRVWGLFV; NRVWGLFVK; RVWGLFVKL; VWGLFVKLI;
WGLFVKLIA; GLFVKLIAC; LFVKLIACM; FVKLIACMF; VKLIACMFQ; KLIACMFQL;
LIACMFQLL; IACMFQLLI; ACMFQLLIF; CMFQLLIFV; MFQLLIFVA; FQLLIFVAC;
QLLIFVACL; LLIFVACLL; LIFVACLLT; IFVACLLTA; FVACLLTAL; VACLLTALE;
ACLLTALEH; CLLTALEHN; LLTALEHNS; LTALEHNSG; TALEHNSGE; ALEHNSGEA;
LEHNSGEAL; EHNSGEALQ; HNSGEALQD; NSGEALQDI; SGEALQDIL; GEALQDILR;
EALQDILRS; ALQDILRSA; RILTQFPFC; TGEPREWMG; GEPREWMGS; EPREWMGSL;
PREWMGSLC; REWMGSLCM; EWMGSLCMV; WMGSLCMVW; MGSLCMVWN; GSLCMVWNP;
SLCMVWNPR; KRLGCLMAQ; RLGCLMAQK; LGCLMAQKD; GCLMAQKDF; CLMAQKDFQ;
LMAQKDFQG; MAQKDFQGT; AQKDFQGTQ; QKDFQGTQI; DILTNRDNC; ILTNRDNCK;
LTNRDNCKP; TNRDNCKPK; NRDNCKPKC; RDNCKPKCF; DNCKPKCFK; NCKPKCFKQ;
CKPKCFKQV; KPKCFKQVL; PKCFKQVLL; KCFKQVLLL; CFKQVLLLY; FKQVLLLYI;
KQVLLLYIY; QVLLLYIYI; MLLLYKPLL; LLLYKPLLS; LLYKPLLSL; LYKPLLSLC;
YKPLLSLCY; KPLLSLCYF; PLLSLCYFG; LLSLCYFGG; LSLCYFGGG; SLCYFGGGV;
LCYFGGGVL; CYFGGGVLG; YFGGGVLGL; FGGGVLGLL; GGGVLGLLK; GGVLGLLKH;
LWGSDLWES; WGSDLWESS; GSDLWESSA; SDLWESSAG; DLWESSAGA; LWESSAGAE;
WESSAGAEV; ESSAGAEVS; SSAGAEVSE; SAGAEVSET; AGAEVSETW; GAEVSETWE;
AEVSETWEE; EVSETWEEH; VSETWEEHC; SETWEEHCD; ETWEEHCDW; TWEEHCDWD;
WEEHCDWDS; EEHCDWDSV; EHCDWDSVL; HCDWDSVLD; CDWDSVLDP; DWDSVLDPC;
WDSVLDPCP; DSVLDPCPE; SVLDPCPES; VLDPCPESS; LDPCPESSV; DPCPESSVS;
PCPESSVSE; CPESSVSES; PESSVSESS; ESSVSESSS; SSVSESSSL; SVSESSSLV;
VSESSSLVI; SESSSLVIS; ESSSLVISR; SSSLVISRI; SSLVISRIH; SLVISRIHF;
LVISRIHFP; VISRIHFPM; ISRIHFPMH; SRIHFPMHI; RIHFPMHIL; IHFPMHILY;
HFPMHILYF; FPMHILYFI; PMHILYFIL; MHILYFILE; HILYFILEK; ILYFILEKV;
LYFILEKVY; YFILEKVYI; FILEKVYIL; ILEKVYILI; LEKVYILIS; EKVYILISE;
KVYILISES; VYILISESS; YILISESSL; ILISESSLS; LISESSLSF; ISESSLSFH;
SESSLSFHS; ESSLSFHST; SSLSFHSTI; SLSFHSTIL; LSFHSTILD; SFHSTILDC;
FHSTILDCI; HSTILDCIS; STILDCISV; TILDCISVA; ILDCISVAK; LDCISVAKS;
DCISVAKSA; CISVAKSAT; ISVAKSATG; SVAKSATGL; VAKSATGLN; AKSATGLNQ;
KSATGLNQI; SATGLNQIS; ATGLNQISS; TGLNQISSS; GLNQISSSN; LNQISSSNK;
NQISSSNKV; QISSSNKVI; ISSSNKVIP; SSSNKVIPL; SSNKVIPLC; SNKVIPLCK;
NKVIPLCKI; KVIPLCKIL; VIPLCKILF; IPLCKILFS; PLCKILFSS; LCKILFSSK;
CKILFSSKN; KILFSSKNS; ILFSSKNSE; LFSSKNSEF; FSSKNSEFC; SSKNSEFCK;
SKNSEFCKD; KNSEFCKDF; NSEFCKDFL; SEFCKDFLK; EFCKDFLKY; FCKDFLKYI;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

CKDFLKYIL; KDFLKYILG; DFLKYILGL; FLKYILGLK; LKYILGLKS; KYILGLKSI;
YILGLKSIC; ILGLKSICL; LGLKSICLT; GLKSICLTN; LKSICLTNL; KSICLTNLA;
SICLTNLAC; ICLTNLACR; CLTNLACRV; LTNLACRVL; TNLACRVLG; NLACRVLGT;
LACRVLGTG; ACRVLGTGY; CRVLGTGYS; RVLGTGYSF; VLGTGYSFI; LGTGYSFIV;
GTGYSFIVT; TGYSFIVTK; GYSFIVTKP; YSFIVTKPG; SFIVTKPGG; FIVTKPGGN;
IVTKPGGNI; VTKPGGNIW; TKPGGNIWV; KPGGNIWVL; PGGNIWVLL; GGNIWVLLF;
GNIWVLLFK; NIWVLLFKC; IWVLLFKCF; WVLLFKCFF; VLLFKCFFS; LLFKCFFSK;
LFKCFFSKF; FKCFFSKFT; KCFFSKFTL; CFFSKFTLT; FFSKFTLTL; FSKFTLTLP;
SKFTLTLPS; KFTLTLPSK; SLKLSKLFI; LKLSKLFIP; KLSKLFIPC; LSKLFIPCP;
SKLFIPCPE; KLFIPCPEG; LFIPCPEGK; FIPCPEGKS; IPCPEGKSF; PCPEGKSFD;
CPEGKSFDS; PEGKSFDSA; EGKSFDSAP; GKSFDSAPV; KSFDSAPVP; SFDSAPVPF;
FDSAPVPFT; DSAPVPFTS; SAPVPFTSS; APVPFTSSK; PVPFTSSKT; VPFTSSKTT;
PFTSSKTTM; FTSSKTTMY; SIATPSSKV; IATPSSKVS; ATPSSKVSL; TPSSKVSLS;
PSSKVSLSM; SSKVSLSMG; SKVSLSMGR; KVSLSMGRF; VSLSMGRFT; SLSMGRFTF;
LSMGRFTFK; SMGRFTFKA; MGRFTFKAL; GRFTFKALP; RFTFKALPP; FTFKALPPH;
TFKALPPHK; FKALPPHKS; KALPPHKSN; ALPPHKSNN; LPPHKSNNP; PPHKSNNPA;
PHKSNNPAA; HKSNNPAAS; KSNNPAASV; SNNPAASVV; NNPAASVVF; NPAASVVFP;
PAASVVFPL; AASVVFPLS; ASVVFPLSM; SVVFPLSMG; VVFPLSMGP; VFPLSMGPL;
FPLSMGPLN; PLSMGPLNN; LSMGPLNNQ; SMGPLNNQY; MGPLNNQYL; GPLNNQYLL;
PLNNQYLLL; LNNQYLLLG; NNQYLLLGT; NQYLLLGTL; QYLLLGTLK; YLLLGTLKT;
LLLGTLKTI; LLGTLKTIQ; LGTLKTIQC; GTLKTIQCK; TLKTIQCKK; LKTIQCKKS;
KTIQCKKSN; TIQCKKSNI; IQCKKSNIT; QCKKSNITE; CKKSNITES; KKSNITESI;
KSNITESIL; SNITESILG; NITESILGS; ITESILGSK; TESILGSKQ; ESILGSKQC;
SILGSKQCS; ILGSKQCSQ; LGSKQCSQA; GSKQCSQAT; SKQCSQATP; KQCSQATPA;
QCSQATPAI; CSQATPAIY; SQATPAIYC; QATPAIYCS; ATPAIYCSS; TPAIYCSST;
PAIYCSSTA; AIYCSSTAF; IYCSSTAFP; APNIKSILS; PNIKSILSN; NIKSILSNI;
LNLSVSISS; NLSVSISSL; LSVSISSLV; SVSISSLVI; RVSTLFLAK; VSTLFLAKT;
STLFLAKTV; TLFLAKTVS; LFLAKTVST; FLAKTVSTA; LAKTVSTAC; FLLSAKIIA;
LLSAKIIAF; LSAKIIAFA; SAKIIAFAK; AKIIAFAKC; KIIAFAKCF; IIAFAKCFS;
HFLHSSTLY; NSKYIPNNK; SKYIPNNKN; KYIPNNKNT; YIPNNKNTS; IPNNKNTSS;
PNNKNTSSH; NNKNTSSHF; NKNTSSHFV; KNTSSHFVS; NTSSHFVST; TSSHFVSTA;
SSHFVSTAY; SHFVSTAYS; HFVSTAYSV; FVSTAYSVI; VSTAYSVIN; STAYSVINF;
TAYSVINFQ; AYSVINFQD; YSVINFQDT; SVINFQDTC; VINFQDTCF; INFQDTCFV;
NFQDTCFVS; FQDTCFVSS; QDTCFVSSG; DTCFVSSGS; TCFVSSGSS; CFVSSGSSG;
FVSSGSSGL; VSSGSSGLK; SSGSSGLKS; SGSSGLKSC; GSSGLKSCS; SSGLKSCSF;
SGLKSCSFK; GLKSCSFKP; LKSCSFKPP; MLSSIVWYG; LSSIVWYGS; SSIVWYGSL;
SIVWYGSLV; IVWYGSLVK; VWYGSLVKA; WYGSLVKAL; YGSLVKALY; GSLVKALYS;
SLVKALYSK; LVKALYSKY; VKALYSKYS; KALYSKYSL; ALYSKYSLL; LYSKYSLLT;
YSKYSLLTP; SKYSLLTPL; KYSLLTPLQ; YSLLTPLQI; SLLTPLQIK; LLTPLQIKK;
LTPLQIKKL; TPLQIKKLK; PLQIKKLKV; LQIKKLKVH; QIKKLKVHS; IKKLKVHSF;
QKLLIAETL; KLLIAETLC; LLIAETLCL; LIAETLCLC; IAETLCLCG; AETLCLCGV;
ETLCLCGVK; TLCLCGVKK; LCLCGVKKN; CLCGVKKNI; LCGVKKNII; CGVKKNIIL;
GVKKNIILC; VKKNIILCP; KKNIILCPA; KNIILCPAH; NIILCPAHM; IILCPAHMC;
ILCPAHMCL; LCPAHMCLL; CPAHMCLLI; PAHMCLLIK; AHMCLLIKV; HMCLLIKVT;
MCLLIKVTE; CLLIKVTEY; LLIKVTEYF; LIKVTEYFS; IKVTEYFSI; KVTEYFSIS;
VTEYFSISF; TEYFSISFL; EYFSISFLY; YFSISFLYR; FSISFLYRI; APSLVVYTA;
FSLVVYTAK; SLVVYTAKQ; LVVYTAKQA; VVYTAKQAR; VYTAKQARV; YTAKQARVL;
TAKQARVLL; AKQARVLLL; KQARVLLLN; QARVLLLNT; ARVLLLNTA; LRNWCRSEG;
RNWCRSEGK; NWCRSEGKS; WCRSEGKSL; CRSEGKSLG; RSEGKSLGS; SEGKSLGSS;
EGKSLGSST; GKSLGSSTF; KSLGSSTFL; SLGSSTFLF; LGSSTFLFF; GSSTFLFFL;
SSTFLFFLG; STFLFFLGG; TFLFFLGGV; FLFFLGGVE; LFFLGGVEC; ESAVASSSL;
SAVASSSLA; AVASSSLAN; VASSSLANI; ASSSLANIS; SSSLANISS; SSLANISSW;
SLANISSWQ; LANISSWQN; ANISSWQNK; NISSWQNKS; ISSWQNKSS; SSWQNKSSS;
SWQNKSSSH; WQNKSSSHF; QNKSSSHFS; NKSSSHFSL; KSSSHFSLK; SSSHFSLKE;
SSHFSLKEL; SHFSLKELH; HFSLKELHQ; FSLKELHQD; SLKELHQDS; LKELHQDSH;
KELHQDSHS; ELHQDSHSS; LHQDSHSSV; HQDSHSSVP; VGTYKKNNY; GTYKKNNYL;
TYKKNNYLG; YKKNNYLGP; KKNNYLGPF; KNNYLGPFN; NNYLGPFNI; NYLGPFNIL;
YLGPFNILL; LGPFNILLF; GPFNILLFI; VSYLKALDL; REFLQLFGP; EFLQLFGPT;
FLQLFGPTI; LQLFGPTIA; QLFGPTIAE; LFGPTIAEF; FGPTIAEFL; GPTIAEFLQ;
PTIAEFLQL; TIAEFLQLG; IAEFLQLGL; AEFLQLGLS; EFLQLGLSQ; FLQLGLSQT;
LQLGLSQTT; QLGLSQTTV; SSQCSSNLS; SQCSSNLSK; QCSSNLSKP; CSSNLSKPR;
SSNLSKPRA; SNLSKPRAL; NLSKPRALF; LSKPRALFL; SKPRALFLK; KPRALFLKI;
PRALFLKIF; RALFLKIFY; ALFLKIFYL; LFLKIFYLN; FLKIFYLNA; LKIFYLNAL;
KIFYLNALI; ADIACKGSA; DIACKGSAQ; IACKGSAQK; ACKGSAQKA; CKGSAQKAF;
KGSAQKAFW; GSAQKAFWN; SAQKAFWNK; AIPCSTGYL; IPCSTGYLG; PCSTGYLGK;
CSTGYLGKE; STGYLGKEE; TGYLGKEEN; GYLGKEENQ; YLGKEENQH; LGKEENQHK;
GKEENQHKP; KEENQHKPL; EENQHKPLS; ENQHKPLSY; NQHKPLSYS; QHKPLSYSR;
HKPLSYSRF; KPLSYSRFQ; PLSYSRFQN; LSYSRFQNQ; SYSRFQNQA; YSRFQNQAD;
SRFQNQADE; RFQNQADEL; FQNQADELP; QNQADELPL; NQADELPLH; QADELPLHP;
ADELPLHPA; DELPLHPAP; ELPLHPAPF; LPLHPAPFF; PLHPAPFFY; LHPAPFFYT;
HPAPFFYTK; PAPFFYTKY; APFFYTKYS; PFFYTKYSF; FFYTKYSFS; FYTKYSFSS;
YTKYSFSSF; TKYSFSSFY; KYSFSSFYP; YSFSSFYPR; SFSSFYPRR; FSSFYPRRP;
SSFYPRRPL; SFYPRRPLC; FYPRRPLCQ; YPRRPLCQG; PRRPLCQGE; RRPLCQGEI;
RPLCQGEIP; PLCQGEIPY; LCQGEIPYT; CQGEIPYTS; QGEIPYTSL; GEIPYTSLN;
EIPYTSLNK; IPYTSLNKL; PYTSLNKLF; YTSLNKLFS; TSLNKLFSL; SLNKLFSLR;
LNKLFSLRE; NKLFSLRED; KLFSLREDF; LFSLREDFP; FSLREDFPR; SLREDFPRQ;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

LREDFPRQL; REDFPRQLF; EDFPRQLFQ; DFPRQLFQG; FPRQLFQGL; PRQLFQGLK; RQLFQGLKG; QLFQGLKGP 10 mers:

GFPQIVLLGL; FPQIVLLGLR; PQIVLLGLRK; QIVLLGLRKS; IVLLGLRKSL; VLLGLRKSLH; LLGLRKSLHT; LGLRKSLHTL; GLRKSLHTLT; LRKSLHTLTT; EKGWRQRRPR; KGWRQRRPRP; GWRQRRPRPL; WRQRRPRPLI; RQRRPRPLIY; QRRPRPLIYY; RRPRPLIYYK; RPRPLIYYKK; PRPLIYYKKG; RPLIYYKKKG; PLIYYKKKGH; LIYYKKKGHR; IYYKKKGHRE; YYKKKGHREE; YKKKGHREEL; KKKGHREELL; KKGHREELLT; KGHREELLTH; GHREELLTHG; HREELLTHGM; REELLTHGMQ; EELLTHGMQP; ELLTHGMQPN; LLTHGMQPNH; LTHGMQPNHD; THGMQPNHDL; HGMQPNHDLR; GMQPNHDLRK; MQPNHDLRKE; QPNHDLRKES; PNHDLRKESA; LTGECSQTMT; TGECSQTMTS; GECSQTMTSG; ECSQTMTSGR; CSQTMTSGRK; SQTMTSGRKV; QTMTSGRKVH; TMTSGRKVHD; MTSGRKVHDS; TSGRKVHDSQ; SGRKVHDSQG; GRKVHDSQGG; RKVHDSQGGA; KVHDSQGGAA; VHDSQGGAAY; HDSQGGAAYP; DSQGGAAYPW; SQGGAAYPWN; QGGAAYPWNA; GGAAYPWNAA; GAAYPWNAAK; AAYPWNAAKP; PQEGKCMTDM; QEGKCMTDMF; EGKCMTDMFC; GKCMTDMFCE; KCMTDMFCEP; CMTDMFCEPR; MTDMFCEPRN; TDMFCEPRNL; DMFCEPRNLG; MFCEPRNLGL; FCEPRNLGLV; CEPRNLGLVP; EPRNLGLVPS; TGQRPWFCAS; GQRPWFCASC; QRPWFCASCH; RPWFCASCHD; PWFCASCHDK; WFCASCHDKL; FCASCHDKLQ; KLVKPGLEQK; LVKPGLEQKK; VKPGLEQKKE; KPGLEQKKEL; PGLEQKKELR; GLEQKKELRG; LEQKKELRGF; EQKKELRGFL; QKKELRGFLF; KKELRGFLFL; KELRGFLFLF; SFCWNFVEVK; FCWNFVEVKT; CWNFVEVKTV; TGKTKVPLLY; GKTKVPLLYL; KTKVPLLYLL; VIPFFLYFQV; IPFFLYFQVH; PFFLYFQVHG; FFLYFQVHGC; FLYFQVHGCC; LYFQVHGCCS; YFQVHGCCSS; FQVHGCCSST; QVHGCCSSTF; VHGCCSSTFG; HGCCSSTFGG; GCCSSTFGGP; CCSSTFGGPS; CSSTFGGPSC; SSTFGGPSCQ; STFGGPSCQC; TFGGPSCQCI; GCCCHRIFSG; NCCWGGCCCY; CCWGGCCCYR; CWGGCCCYRS; WGGCCCYRSS; GGCCCYRSSN; GCCCYRSSNC; CCCYRSSNCI; CCYRSSNCIP; CYRSSNCIPC; YRSSNCIPCY; RSSNCIPCYC; SSNCIPCYCR; SNCIPCYCRG; NCIPCYCRGH; CIPCYCRGHN; IPCYCRGHNK; PCYCRGHNKY; CYCRGHNKYL; YCRGHNKYLR; CRGHNKYLRG; RGHNKYLRGY; GHNKYLRGYS; HNKYLRGYSC; NKYLRGYSCY; KYLRGYSCYR; YLRGYSCYRP; LRGYSCYRPN; RGYSCYRPNS; GYSCYRPNSS; YSCYRPNSSN; SCYRPNSSNI; CYRPNSSNIC; YRPNSSNICC; RPNSSNICCN; PNSSNICCNC; NSSNICCNCW; SSNICCNCWC; SNICCNCWCS; NICCNCWCSW; ICCNCWCSWG; CCNCWCSWGY; CNCWCSWGYC; NCWCSWGYCW; CWCSWGYCWV; WCSWGYCWVC; CSWGYCWVCC; SWGYCWVCCF; WGYCWVCCFN; GYCWVCCFNS; YCWVCCFNSN; CWVCCFNSNC; LGSQSFHCRP; GSQSFHCRPL; SQSFHCRPLS; QSFHCRPLSA; SFHCRPLSAI; FHCRPLSAIR; HCRPLSAIRH; CRPLSAIRHG; RPLSAIRHGF; PLSAIRHGFG; LSAIRHGFGI; SAIRHGFGIV; YSVSWCKYFC; ALGSFFVCYY; LGSFFVCYYF; GSFFVCYYFP; SFFVCYYFPG; FFVCYYFPGF; FVCYYFPGFV; VCYYFPGFVA; CYYFPGFVAC; YYFPGFVACY; YTFYNLTGIA; TFYNLTGIAE; FYNLTGIAEK; YNLTGIAEKN; NLTGIAEKNR; LTGIAEKNRK; TGIAEKNRKI; GIAEKNRKIF; IFGGNYLDNC; FGGNYLDNCK; GGNYLDNCKC; GNYLDNCKCP; NYLDNCKCPY; YLDNCKCPYK; LDNCKCPYKL; DNCKCPYKLL; KGRYPCTFWP; GRYPCTFWPY; RYPCTFWPYL; QYRRSYTKNG; YRRSYTKNGL; RRSYTKNGLK; RSYTKNGLKK; SYTKNGLKKS; YTKNGLKKST; TKNGLKKSTK; KNGLKKSTKC; NGLKKSTKCT; GLKKSTKCTF; LKKSTKCTFR; KKSTKCTFRR; KSTKCTFRRV; STKCTFRRVY; TKCTFRRVYR; KCTFRRVYRK; CTFRRVYRKN; TFRRVYRKNY; FRRVYRKNYC; RRVYRKNYCP; RVYRKNYCPR; VYRKNYCPRR; YRKNYCPRRC; SKNCSSMDVA; KNCSSMDVAF; NCSSMDVAFT; CSSMDVAFTS; SSMDVAFTSR; SMDVAFTSRP; MDVAFTSRPV; DVAFTSRPVR; VAFTSRPVRD; AFTSRPVRDC; FTSRPVRDCN; TSRPVRDCNT; SRPVRDCNTC; RPVRDCNTCS; RWPQPKEKES; WPQPKEKESV; PQPKEKESVQ; QPKEKESVQG; PKEKESVQGQ; KEKESVQGQL; EKESVQGQLP; KESVQGQLPK; ESVQGQLPKS; SVQGQLPKSQ; VQGQLPKSQR; QGQLPKSQRN; GQLPKSQRNP; QLPKSQRNPC; LPKSQRNPCK; PKSQRNPCKC; KSQRNPCKCQ; SQRNPCKCQN; QRNPCKCQNY; TQKWGIQMKT; QKWGIQMKTL; KWGIQMKTLG; WGIQMKTLGA; GIQMKTLGAL; IQMKTLGALV; VLKMTLAVIA; LKMTLAVIAQ; KMTLAVIAQR; MTLAVIAQRE; TLAVIAQREK; LAVIAQREKC; AVIAQREKCF; VIAQREKCFP; IAQREKCFPV; AQREKCFPVT; QREKCFPVTA; REKCFPVTAQ; EKCFPVTAQQ; KCFPVTAQQE; CFPVTAQQEF; FPVTAQQEFP; PVTAQQEFPS; VTAQQEFPSP; TAQQEFPSPI; LACLTFMQGH; ACLTFMQGHK; CLTFMQGHKK; LTFMQGHKKC; TFMQGHKKCM; FMQGHKKCMS; MQGHKKCMSM; QGHKKCMSMV; GHKKCMSMVE; HKKCMSMVEE; KKCMSMVEEN; KCMSMVEENL; CMSMVEENLF; MSMVEENLFK; SMVEENLFKA; MVEENLFKAV; VEENLFKAVI; EENLFKAVIS; ENLFKAVIST; NLFKAVISTS; LFKAVISTSL; FKAVISTSLL; VENPWKCREC; ITGQSTLMVL; PLKTQQPSPR; ILTIRPIWTK; LTIRPIWTKT; TIRPIWTKTM; IRPIWTKTML; RPIWTKTMLI; PIWTKTMLIQ; IWTKTMLIQL; WTKTMLIQLS; TKTMLIQLSA; KTMLIQLSAG; TMLIQLSAGY; MLIQLSAGYL; LIQLSAGYLI; IQLSAGYLIP; QLSAGYLIPV; LSAGYLIPVE; SAGYLIPVEM; AGYLIPVEMK; GYLIPVEMKM; YLIPVEMKML; LIPVEMKMLG; IPVEMKMLGI; PVEMKMLGIL; VEMKMLGILG; EMKMLGILGL; MKMLGILGLS; KMLGILGLSQ; MLGILGLSQE; LGILGLSQEG; GILGLSQEGK; ILGLSQEGKM; LGLSQEGKMF; GLSQEGKMFP; LSQEGKMFPQ; SQEGKMFPQY; QEGKMFPQYF; EGKMFPQYFM; MNRVWGLFVK; NRVWGLFVKL;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

RVWGLFVKLI; VWGLFVKLIA; WGLFVKLIAC; GLFVKLIACM; LFVKLIACMF;
FVKLIACMFQ; VKLIACMFQL; KLIACMFQLL; LIACMFQLLI; IACMFQLLIF;
ACMFQLLIFV; CMFQLLIFVA; MFQLLIFVAC; FQLLIFVACL; QLLIFVACLL;
LLIFVACLLT; LIFVACLLTA; IFVACLLTAL; FVACLLTALE; VACLLTALEH;
ACLLTALEHN; CLLTALEHNS; LLTALEHNSG; LTALEHNSGE; TALEHNSGEA;
ALEHNSGEAL; LEHNSGEALQ; EHNSGEALQD; HNSGEALQDI; NSGEALQDIL;
SGEALQDILR; GEALQDILRS; EALQDILRSA; TGEPREWMGS; GEPREWMGSL;
EPREWMGSLC; PREWMGSLCM; REWMGSLCMV; EWMGSLCMVW; WMGSLCMVWN;
MGSLCMVWNP; GSLCMVWNPR; KRLGCLMAQK; RLGCLMAQKD; LGCLMAQKDF;
GCLMAQKDFQ; CLMAQKDFQG; LMAQKDFQGT; MAQKDFQGTQ; AQKDFQGTQI;
DILTNRDNCK; ILTNRDNCKP; LTNRDNCKPK; TNRDNCKPKC; NRDNCKPKCF;
RDNCKPKCFK; DNCKPKCFKQ; NCKPKCFKQV; CKPKCFKQVL; KPKCFKQVLL;
PKCFKQVLLL; KCFKQVLLLY; CFKQVLLLYI; FKQVLLLYIY; KQVLLLYIYI;
MLLLYKPLLS; LLLYKPLLSL; LLYKPLLSLC; LYKPLLSLCY; YKPLLSLCYF;
KPLLSLCYFG; PLLSLCYFGG; LLSLCYFGGG; LSLCYFGGGV; SLCYFGGGVL;
LCYFGGGVLG; CYFGGGVLGL; YFGGGVLGLL; FGGGVLGLLK; GGGVLGLLKH;
LWGSDLWESS; WGSDLWESSA; GSDLWESSAG; SDLWESSAGA; DLWESSAGAE;
LWESSAGAEV; WESSAGAEVS; ESSAGAEVSE; SSAGAEVSET; SAGAEVSETW;
AGAEVSETWE; GAEVSETWEE; AEVSETWEEH; EVSETWEEHC; VSETWEEHCD;
SETWEEHCDW; ETWEEHCDWD; TWEEHCDWDS; WEEHCDWDSV; EEHCDWDSVL;
EHCDWDSVLD; HCDWDSVLDP; CDWDSVLDPC; DWDSVLDPCP; WDSVLDPCPE;
DSVLDPCPES; SVLDPCPESS; VLDPCPESSV; LDPCPESSVS; DPCPESSVSE;
PCPESSVSES; CPESSVSESS; PESSVSESSS; ESSVSESSSL; SSVSESSSLV;
SVSESSSLVI; VSESSSLVIS; SESSSLVISR; ESSSLVISRI; SSSLVISRIH;
SSLVISRIHF; SLVISRIHFP; LVISRIHFPM; VISRIHFPMH; ISRIHFPMHI;
SRIHFPMHIL; RIHFPMHILY; IHFPMHILYF; HFPMHILYFI; FPMHILYFIL;
PMHILYFILE; MHILYFILEK; HILYFILEKV; ILYFILEKVY; LYFILEKVYI;
YFILEKVYIL; FILEKVYILI; ILEKVYILIS; LEKVYILISE; EKVYILISES;
KVYILISESS; VYILISESSL; YILISESSLS; ILISESSLSF; LISESSLSFH;
ISESSLSFHS; SESSLSFHST; ESSLSFHSTI; SSLSFHSTIL; SLSFHSTILD;
LSFHSTILDC; SFHSTILDCI; FHSTILDCIS; HSTILDCISV; STILDCISVA;
TILDCISVAK; ILDCISVAKS; LDCISVAKSA; DCISVAKSAT; CISVAKSATG;
ISVAKSATGL; SVAKSATGLN; VAKSATGLNQ; AKSATGLNQI; KSATGLNQIS;
SATGLNQISS; ATGLNQISSS; TGLNQISSSN; GLNQISSSNK; LNQISSSNKV;
NQISSSNKVI; QISSSNKVIP; ISSSNKVIPL; SSSNKVIPLC; SSNKVIPLCK;
SNKVIPLCKI; NKVIPLCKIL; KVIPLCKILF; VIPLCKILFS; IPLCKILFSS;
PLCKILFSSK; LCKILFSSKN; CKILFSSKNS; KILFSSKNSE; ILFSSKNSEF;
LFSSKNSEFC; FSSKNSEFCK; SSKNSEFCKD; SKNSEFCKDF; KNSEFCKDFL;
NSEFCKDFLK; SEFCKDFLKY; EFCKDFLKYI; FCKDFLKYIL; CKDFLKYILG;
KDFLKYILGL; DFLKYILGLK; FLKYILGLKS; LKYILGLKSI; KYILGLKSIC;
YILGLKSICL; ILGLKSICLT; LGLKSICLTN; GLKSICLTNL; LKSICLTNLA;
KSICLTNLAC; SICLTNLACR; ICLTNLACRV; CLTNLACRVL; LTNLACRVLG;
TNLACRVLGT; NLACRVLGTG; LACRVLGTGY; ACRVLGTGYS; CRVLGTGYSF;
RVLGTGYSFI; VLGTGYSFIV; LGTGYSFIVT; GTGYSFIVTK; TGYSFIVTKP;
GYSFIVTKPG; YSFIVTKPGG; SFIVTKPGGN; FIVTKPGGNI; IVTKPGGNIW;
VTKPGGNIWV; TKPGGNIWVL; KPGGNIWVLL; PGGNIWVLLF; GGNIWVLLFK;
GNIWVLLFKC; NIWVLLFKCF; IWVLLFKCFF; WVLLFKCFFS; VLLFKCFFSK;
LLFKCFFSKF; LFKCFFSKFT; FKCFFSKFTL; KCFFSKFTLT; CFFSKFTLTL;
FFSKFTLTLP; FSKFTLTLPS; SKFTLTLPSK; SLKLSKLFIP; LKLSKLFIPC;
KLSKLFIPCP; LSKLFIPCPE; SKLFIPCPEG; KLFIPCPEGK; LFIPCPEGKS;
FIPCPEGKSF; IPCPEGKSFD; PCPEGKSFDS; CPEGKSFDSA; PEGKSFDSAP;
EGKSFDSAPV; GKSFDSAPVP; KSFDSAPVPF; SFDSAPVPFT; FDSAPVPFTS;
DSAPVPFTSS; SAPVPFTSSK; APVPFTSSKT; PVPFTSSKTT; VPFTSSKTTM;
PFTSSKTTMY; SIATPSSKVS; IATPSSKVSL; ATPSSKVSLS; TPSSKVSLSM;
PSSKVSLSMG; SSKVSLSMGR; SKVSLSMGRF; KVSLSMGRFT; VSLSMGRFTF;
SLSMGRFTFK; LSMGRFTFKA; SMGRFTFKAL; MGRFTFKALP; GRFTFKALPP;
RFTFKALPPH; FTFKALPPHK; TFKALPPHKS; FKALPPHKSN; KALPPHKSNN;
ALPPHKSNNP; LPPHKSNNPA; PPHKSNNPAA; PHKSNNPAAS; HKSNNPAASV;
KSNNPAASVV; SNNPAASVVF; NNPAASVVFP; NPAASVVFPL; PAASVVFPLS;
AASVVFPLSM; ASVVFPLSMG; SVVFPLSMGP; VVFPLSMGPL; VFPLSMGPLN;
FPLSMGPLNN; PLSMGPLNNQ; LSMGPLNNQY; SMGPLNNQYL; MGPLNNQYLL;
GPLNNQYLLL; PLNNQYLLLG; LNNQYLLLGT; NNQYLLLGTL; NQYLLLGTLK;
QYLLLGTLKT; YLLLGTLKTI; LLLGTLKTIQ; LLGTLKTIQC; LGTLKTIQCK;
GTLKTIQCKK; TLKTIQCKKS; LKTIQCKKSN; KTIQCKKSNI; TIQCKKSNIT;
IQCKKSNITE; QCKKSNITES; CKKSNITESI; KKSNITESIL; KSNITESILG;
SNITESILGS; NITESILGSK; ITESILGSKQ; TESILGSKQC; ESILGSKQCS;
SILGSKQCSQ; ILGSKQCSQA; LGSKQCSQAT; GSKQCSQATP; SKQCSQATPA;
KQCSQATPAI; QCSQATPAIY; CSQATPAIYC; SQATPAIYCS; QATPAIYCSS;
ATPAIYCSST; TPAIYCSSTA; PAIYCSSTAF; AIYCSSTAFP; APNIKSILSN;
PNIKSILSNI; LNLSVSISSL; NLSVSISSLV; LSVSISSLVI; RVSTLFLAKT;
VSTLFLAKTV; STLFLAKTVS; TLFLAKTVST; LFLAKTVSTA; FLAKTVSTAC;
FLLSAKIIAF; LLSAKIIAFA; LSAKIIAFAK; SAKIIAFAKC; AKIIAFAKCF;
KIIAFAKCFS; NSKYIPNNKN; SKYIPNNKNT; KYIPNNKNTS; YIPNNKNTSS;
IPNNKNTSSH; PNNKNTSSHF; NNKNTSSHFV; NKNTSSHFVS; KNTSSHFVST;
NTSSHFVSTA; TSSHFVSTAY; SSHFVSTAYS; SHFVSTAYSV; HFVSTAYSVI;
FVSTAYSVIN; VSTAYSVINF; STAYSVINFQ; TAYSVINFQD; AYSVINFQDT;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

YSVINFQDTC; SVINFQDTCF; VINFQDTCFV; INFQDTCFVS; NFQDTCFVSS;
FQDTCFVSSG; QDTCFVSSGS; DTCFVSSGSS; TCFVSSGSSG; CFVSSGSSGL;
FVSSGSSGLK; VSSGSSGLKS; SSGSSGLKSC; SGSSGLKSCS; GSSGLKSCSF;
SSGLKSCSFK; SGLKSCSFKP; GLKSCSFKPP; MLSSIVWYGS; LSSIVWYGSL;
SSIVWYGSLV; SIVWYGSLVK; IVWYGSLVKA; VWYGSLVKAL; WYGSLVKALY;
YGSLVKALYS; GSLVKALYSK; SLVKALYSKY; LVKALYSKYS; VKALYSKYSL;
KALYSKYSLL; ALYSKYSLLT; LYSKYSLLTP; YSKYSLLTPL; SKYSLLTPLQ;
KYSLLTPLQI; YSLLTPLQIK; SLLTPLQIKK; LLTPLQIKKL; LTPLQIKKLK;
TPLQIKKLKV; PLQIKKLKVH; LQIKKLKVHS; QIKKLKVHSF; QKLLIAETLC;
KLLIAETLCL; LLIAETLCLC; LIAETLCLCG; IAETLCLCGV; AETLCLCGVK;
ETLCLCGVKK; TLCLCGVKKN; LCLCGVKKNI; CLCGVKKNII; LCGVKKNIIL;
CGVKKNIILC; GVKKNIILCP; VKKNIILCPA; KKNIILCPAH; KNIILCPAHM;
NIILCPAHMC; IILCPAHMCL; ILCPAHMCLL; LCPAHMCLLI; CPAHMCLLIK;
PAHMCLLIKV; AHMCLLIKVT; HMCLLIKVTE; MCLLIKVTEY; CLLIKVTEYF;
LLIKVTEYFS; LIKVTEYFSI; IKVTEYFSIS; KVTEYFSISF; VTEYFSISFL;
TEYFSISFLY; EYFSISFLYR; YFSISFLYRI; AFSLVVYTAK; FSLVVYTAKQ;
SLVVYTAKQA; LVVYTAKQAR; VVYTAKQARV; VYTAKQARVL; YTAKQARVLL;
TAKQARVLLL; AKQARVLLLN; KQARVLLLNT; QARVLLLNTA; LRNWCRSEGK;
RNWCRSEGKS; NWCRSEGKSL; WCRSEGKSLG; CRSEGKSLGS; RSEGKSLGSS;
SEGKSLGSST; EGKSLGSSTF; GKSLGSSTFL; KSLGSSTFLF; SLGSSTFLFF;
LGSSTFLFFL; GSSTFLFFLG; SSTFLFFLGG; STFLFFLGGV; TFLFFLGGVE;
FLFFLGGVEC; ESAVASSSLA; SAVASSSLAN; AVASSSLANI; VASSSLANIS;
ASSSLANISS; SSSLANISSW; SSLANISSWQ; SLANISSWQN; LANISSWQNK;
ANISSWQNKS; NISSWQNKSS; ISSWQNKSSS; SSWQNKSSSH; SWQNKSSSHF;
WQNKSSSHFS; QNKSSSHFSL; NKSSSHFSLK; KSSSHFSLKE; SSSHFSLKEL;
SSHFSLKELH; SHFSLKELHQ; HFSLKELHQD; FSLKELHQDS; SLKELHQDSH;
LKELHQDSHS; KELHQDSHSS; ELHQDSHSSV; LHQDSHSSVP; VGTYKKNNYL;
GTYKKNNYLG; TYKKNNYLGP; YKKNNYLGPF; KKNNYLGPFN; KNNYLGPFNI;
NNYLGPFNIL; NYLGPFNILL; YLGPFNILLF; LGPFNILLFI; REFLQLFGPT;
EFLQLFGPTI; FLQLFGPTIA; LQLFGPTIAE; QLFGPTIAEF; LFGPTIAEFL;
FGPTIAEFLQ; GPTIAEFLQL; PTIAEFLQLG; TIAEFLQLGL; IAEFLQLGLS;
AEFLQLGLSQ; EFLQLGLSQT; FLQLGLSQTT; LQLGLSQTTV; SSQCSSNLSK;
SQCSSNLSKP; QCSSNLSKPR; CSSNLSKPRA; SSNLSKPRAL; SNLSKPRALF;
NLSKPRALFL; LSKPRALFLK; SKPRALFLKI; KPRALFLKIF; PRALFLKIFY;
RALFLKIFYL; ALFLKIFYLN; LFLKIFYLNA; FLKIFYLNAL; LKIFYLNALI;
ADIACKGSAQ; DIACKGSAQK; IACKGSAQKA; ACKGSAQKAF; CKGSAQKAFW;
KGSAQKAFWN; GSAQKAFWNK; AIPCSTGYLG; IPCSTGYLGK; PCSTGYLGKE;
CSTGYLGKEE; STGYLGKEEN; TGYLGKEENQ; GYLGKEENQH; YLGKEENQHK;
LGKEENQHKP; GKEENQHKPL; KEENQHKPLS; EENQHKPLSY; ENQHKPLSYS;
NQHKPLSYSR; QHKPLSYSRF; HKPLSYSRFQ; KPLSYSRFQN; PLSYSRFQNQ;
LSYSRFQNQA; SYSRFQNQAD; YSRFQNQADE; SRFQNQADEL; RFQNQADELP;
FQNQADELPL; QNQADELPLH; NQADELPLHP; QADELPLHPA; ADELPLHPAP;
DELPLHPAPF; ELPLHPAPFF; LPLHPAPFFY; PLHPAPFFYT; LHPAPFFYTK;
HPAPFFYTKY; PAPFFYTKYS; APFFYTKYSF; PFFYTKYSFS; FFYTKYSFSS;
FYTKYSFSSF; YTKYSFSSFY; TKYSFSSFYP; KYSFSSFYPR; YSFSSFYPRR;
SFSSFYPRRP; FSSFYPRRPL; SSFYPRRPLC; SFYPRRPLCQ; FYPRRPLCQG;
YPRRPLCQGE; PRRPLCQGEI; RRPLCQGEIP; RPLCQGEIPY; PLCQGEIPYT;
LCQGEIPYTS; CQGEIPYTSL; QGEIPYTSLN; GEIPYTSLNK; EIPYTSLNKL;
IPYTSLNKLF; PYTSLNKLFS; YTSLNKLFSL; TSLNKLFSLR; SLNKLFSLRE;
LNKLFSLRED; NKLFSLREDF; KLFSLREDFP; LFSLREDFPR; FSLREDFPRQ;
SLREDFPRQL; LREDFPRQLF; REDFPRQLFQ; EDFPRQLFQG; DFPRQLFQGL;
FPRQLFQGLK; PRQLFQGLKG; RQLFQGLKGP 11 mers:

GFPQIVLLGLR; FPQIVLLGLRK; PQIVLLGLRKS; QIVLLGLRKSL; IVLLGLRKSLH;
VLLGLRKSLHT; LLGLRKSLHTL; LGLRKSLHTLT; GLRKSLHTLTT; EKGWRQRRPRP;
KGWRQRRPRPL; GWRQRRPRPLI; WRQRRPRPLIY; RQRRPRPLIYY; QRRPRPLIYYK;
RRPRPLIYYKK; RPRPLIYYKKK; PRPLIYYKKKG; RPLIYYKKKGH; PLIYYKKKGHR;
LIYYKKKGHRE; IYYKKKGHREE; YYKKKGHREEL; YKKKGHREELL; KKKGHREELLT;
KKGHREELLTH; KGHREELLTHG; GHREELLTHGM; HREELLTHGMQ; REELLTHGMQP;
EELLTHGMQPN; ELLTHGMQPNH; LLTHGMQPNHD; LTHGMQPNHDL; THGMQPNHDLR;
HGMQPNHDLRK; GMQPNHDLRKE; MQPNHDLRKES; QPNHDLRKESA; LTGECSQTMTS;
TGECSQTMTSG; GECSQTMTSGR; ECSQTMTSGRK; CSQTMTSGRKV; SQTMTSGRKVH;
QTMTSGRKVHD; TMTSGRKVHDS; MTSGRKVHDSQ; TSGRKVHDSQG; SGRKVHDSQGG;
GRKVHDSQGGA; RKVHDSQGGAA; KVHDSQGGAAY; VHDSQGGAAYP; HDSQGGAAYPW;
DSQGGAAYPWN; SQGGAAYPWNA; QGGAAYPWNAA; GGAAYPWNAAK; GAAYPWNAAKP;
PQEGKCMTDMF; QEGKCMTDMFC; EGKCMTDMFCE; GKCMTDMFCEP; KCMTDMFCEPR;
CMTDMFCEPRN; MTDMFCEPRNL; TDMFCEPRNLG; DMFCEPRNLGL; MFCEPRNLGLV;
FCEPRNLGLVP; CEPRNLGLVPS; TGQRPWFCASC; GQRPWFCASCH; QRPWFCASCHD;
RPWFCASCHDK; PWFCASCHDKL; WFCASCHDKLQ; KLVKPGLEQKK; LVKPGLEQKKE;
VKPGLEQKKEL; KPGLEQKKELR; PGLEQKKELRG; GLEQKKELRGF; LEQKKELRGFL;
EQKKELRGFLF; QKKELRGFLFL; KKELRGFLFLF; SFCWNFVEVKT; FCWNFVEVKTV;
TGKTKVPLLYL; GKTKVPLLYLL; VIPFFLYFQVH; IPFFLYFQVHG; PFFLYFQVHGC;
FFLYFQVHGCC; FLYFQVHGCCS; LYFQVHGCCSS; YFQVHGCCSST; FQVHGCCSSTF;
QVHGCCSSTFG; VHGCCSSTFGG; HGCCSSTFGGP; GCCSSTFGGPS; CCSSTFGGPSC;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

CSSTFGGPSCQ; SSTFGGPSCQC; STFGGPSCQCI; NCCWGGCCCYR; CCWGGCCCYRS;
CWGGCCCYRSS; WGGCCCYRSSN; GGCCCYRSSNC; GCCCYRSSNCI; CCCYRSSNCIP;
CCYRSSNCIPC; CYRSSNCIPCY; YRSSNCIPCYC; RSSNCIPCYCR; SSNCIPCYCRG;
SNCIPCYCRGH; NCIPCYCRGHN; CIPCYCRGHNK; IPCYCRGHNKY; PCYCRGHNKYL;
CYCRGHNKYLR; YCRGHNKYLRG; CRGHNKYLRGY; RGHNKYLRGYS; GHNKYLRGYSC;
HNKYLRGYSCY; NKYLRGYSCYR; KYLRGYSCYRP; YLRGYSCYRPN; LRGYSCYRPNS;
RGYSCYRPNSS; GYSCYRPNSSN; YSCYRPNSSNI; SCYRPNSSNIC; CYRPNSSNICC;
YRPNSSNICCN; RPNSSNICCNC; PNSSNICCNCW; NSSNICCNCWC; SSNICCNCWCS;
SNICCNCWCSW; NICCNCWCSWG; ICCNCWCSWGY; CCNCWCSWGYC; CNCWCSWGYCW;
NCWCSWGYCWV; CWCSWGYCWVC; WCSWGYCWVCC; CSWGYCWVCCF; SWGYCWVCCFN;
WGYCWVCCFNS; GYCWVCCFNSN; YCWVCCFNSNC; LGSQSFHCRPL; GSQSFHCRPLS;
SQSFHCRPLSA; QSFHCRPLSAI; SFHCRPLSAIR; FHCRPLSAIRH; HCRPLSAIRHG;
CRPLSAIRHGF; RPLSAIRHGFG; PLSAIRHGFGI; LSAIRHGFGIV; ALGSFFVCYYF;
LGSFFVCYYFP; GSFFVCYYFPG; SFFVCYYFPGF; FFVCYYFPGFV; FVCYYFPGFVA;
VCYYFPGFVAC; CYYFPGFVACY; YTFYNLTGIAE; TFYNLTGIAEK; FYNLTGIAEKN;
YNLTGIAEKNR; NLTGIAEKNRK; LTGIAEKNRKI; TGIAEKNRKIF; IFGGNYLDNCK;
FGGNYLDNCKC; GGNYLDNCKCP; GNYLDNCKCPY; NYLDNCKCPYK; YLDNCKCPYKL;
LDNCKCPYKLL; KGRYPCTFWPY; GRYPCTFWPYL; QYRRSYTKNGL; YRRSYTKNGLK;
RRSYTKNGLKK; RSYTKNGLKKS; SYTKNGLKKST; YTKNGLKKSTK; TKNGLKKSTKC;
KNGLKKSTKCT; NGLKKSTKCTF; GLKKSTKCTFR; LKKSTKCTFRR; KKSTKCTFRRV;
KSTKCTFRRVY; STKCTFRRVYR; TKCTFRRVYRK; KCTFRRVYRKN; CTFRRVYRKNY;
TFRRVYRKNYC; FRRVYRKNYCP; RRVYRKNYCPR; RVYRKNYCPRR; VYRKNYCPRRC;
SKNCSSMDVAF; KNCSSMDVAFT; NCSSMDVAFTS; CSSMDVAFTSR; SSMDVAFTSRP;
SMDVAFTSRPV; MDVAFTSRPVR; DVAFTSRPVRD; VAFTSRPVRDC; AFTSRPVRDCN;
FTSRPVRDCNT; TSRPVRDCNTC; SRPVRDCNTCS; RWPQPKEKESV; WPQPKEKESVQ;
PQPKEKESVQG; QPKEKESVQGQ; PKEKESVQGQL; KEKESVQGQLP; EKESVQGQLPK;
KESVQGQLPKS; ESVQGQLPKSQ; SVQGQLPKSQR; VQGQLPKSQRN; QGQLPKSQRNP;
GQLPKSQRNPC; QLPKSQRNPCK; LPKSQRNPCKC; PKSQRNPCKCQ; KSQRNPCKCQN;
SQRNPCKCQNY; TQKWGIQMKTL; QKWGIQMKTLG; KWGIQMKTLGA; WGIQMKTLGAL;
GIQMKTLGALV; VLKMTLAVIAQ; LKMTLAVIAQR; KMTLAVIAQRE; MTLAVIAQREK;
TLAVIAQREKC; LAVIAQREKCF; AVIAQREKCFP; VIAQREKCFPV; IAQREKCFPVT;
AQREKCFPVTA; QREKCFPVTAQ; REKCFPVTAQQ; EKCFPVTAQQE; KCFPVTAQQEF;
CFPVTAQQEFP; FPVTAQQEFPS; PVTAQQEFPSP; VTAQQEFPSPI; LACLTFMQGHK;
ACLTFMQGHKK; CLTFMQGHKKC; LTFMQGHKKCM; TFMQGHKKCMS; FMQGHKKCMSM;
MQGHKKCMSMV; QGHKKCMSMVE; GHKKCMSMVEE; HKKCMSMVEEN; KKCMSMVEENL;
KCMSMVEENLF; CMSMVEENLFK; MSMVEENLFKA; SMVEENLFKAV; MVEENLFKAVI;
VEENLFKAVIS; EENLFKAVIST; ENLFKAVISTS; NLFKAVISTSL; LFKAVISTSLL;
ILTIRPIWTKT; LTIRPIWTKTM; TIRPIWTKTML; IRPIWTKTMLI; RPIWTKTMLIQ;
PIWTKTMLIQL; IWTKTMLIQLS; WTKTMLIQLSA; TKTMLIQLSAG; KTMLIQLSAGY;
TMLIQLSAGYL; MLIQLSAGYLI; LIQLSAGYLIP; IQLSAGYLIPV; QLSAGYLIPVE;
LSAGYLIPVEM; SAGYLIPVEMK; AGYLIPVEMKM; GYLIPVEMKML; YLIPVEMKMLG;
LIPVEMKMLGI; IPVEMKMLGIL; PVEMKMLGILG; VEMKMLGILGL; EMKMLGILGLS;
MKMLGILGLSQ; KMLGILGLSQE; MLGILGLSQEG; LGILGLSQEGK; GILGLSQEGKM;
ILGLSQEGKMF; LGLSQEGKMFP; GLSQEGKMFPQ; LSQEGKMFPQY; SQEGKMFPQYF;
QEGKMFPQYFM; MNRVWGLFVKL; NRVWGLFVKLI; RVWGLFVKLIA; VWGLFVKLIAC;
WGLFVKLIACM; GLFVKLIACMF; LFVKLIACMFQ; FVKLIACMFQL; VKLIACMFQLL;
KLIACMFQLLI; LIACMFQLLIF; IACMFQLLIFV; ACMFQLLIFVA; CMFQLLIFVAC;
MFQLLIFVACL; FQLLIFVACLL; QLLIFVACLLT; LLIFVACLLTA; LIFVACLLTAL;
IFVACLLTALE; FVACLLTALEH; VACLLTALEHN; ACLLTALEHNS; CLLTALEHNSG;
LLTALEHNSGE; LTALEHNSGEA; TALEHNSGEAL; ALEHNSGEALQ; LEHNSGEALQD;
EHNSGEALQDI; HNSGEALQDIL; NSGEALQDILR; SGEALQDILRS; GEALQDILRSA;
TGEPREWMGSL; GEPREWMGSLC; EPREWMGSLCM; PREWMGSLCMV; REWMGSLCMVW;
EWMGSLCMVWN; WMGSLCMVWNP; MGSLCMVWNPR; KRLGCLMAQKD; RLGCLMAQKDF;
LGCLMAQKDFQ; GCLMAQKDFQG; CLMAQKDFQGT; LMAQKDFQGTQ; MAQKDFQGTQI;
DILTNRDNCKP; ILTNRDNCKPK; LTNRDNCKPKC; TNRDNCKPKCF; NRDNCKPKCFK;
RDNCKPKCFKQ; DNCKPKCFKQV; NCKPKCFKQVL; CKPKCFKQVLL; KPKCFKQVLLL;
PKCFKQVLLLY; KCFKQVLLLYI; CFKQVLLLYIY; FKQVLLLYIYI; MLLLYKPLLSL;
LLLYKPLLSLC; LLYKPLLSLCY; LYKPLLSLCYF; YKPLLSLCYFG; KPLLSLCYFGG;
PLLSLCYFGGG; LLSLCYFGGGV; LSLCYFGGGVL; SLCYFGGGVLG; LCYFGGGVLGL;
CYFGGGVLGLL; YFGGGVLGLLK; FGGGVLGLLKH; LWGSDLWESSA; WGSDLWESSAG;
GSDLWESSAGA; SDLWESSAGAE; DLWESSAGAEV; LWESSAGAEVS; WESSAGAEVSE;
ESSAGAEVSET; SSAGAEVSETW; SAGAEVSETWE; AGAEVSETWEE; GAEVSETWEEH;
AEVSETWEEHC; EVSETWEEHCD; VSETWEEHCDW; SETWEEHCDWD; ETWEEHCDWDS;
TWEEHCDWDSV; WEEHCDWDSVL; EEHCDWDSVLD; EHCDWDSVLDP; HCDWDSVLDPC;
CDWDSVLDPCP; DWDSVLDPCPE; WDSVLDPCPES; DSVLDPCPESS; SVLDPCPESSV;
VLDPCPESSVS; LDPCPESSVSE; DPCPESSVSES; PCPESSVSESS; CPESSVSESSS;
PESSVSESSSL; ESSVSESSSLV; SSVSESSSLVI; SVSESSSLVIS; VSESSSLVISR;
SESSSLVISRI; ESSSLVISRIH; SSSLVISRIHF; SSLVISRIHFP; SLVISRIHFPM;
LVISRIHFPMH; VISRIHFPMHI; ISRIHFPMHIL; SRIHFPMHILY; RIHFPMHILYF;
IHFPMHILYFI; HFPMHILYFIL; FPMHILYFILE; PMHILYFILEK; MHILYFILEKV;
HILYFILEKVY; ILYFILEKVYI; LYFILEKVYIL; YFILEKVYILI; FILEKVYILIS;
ILEKVYILISE; LEKVYILISES; EKVYILISESS; KVYILISESSL; VYILISESSLS;
YILISESSLSF; ILISESSLSFH; LISESSLSFHS; ISESSLSFHST; SESSLSFHSTI;
ESSLSFHSTIL; SSLSFHSTILD; SLSFHSTILDC; LSFHSTILDCI; SFHSTILDCIS;
FHSTILDCISV; HSTILDCISVA; STILDCISVAK; TILDCISVAKS; ILDCISVAKSA;
LDCISVAKSAT; DCISVAKSATG; CISVAKSATGL; ISVAKSATGLN; SVAKSATGLNQ;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

VAKSATGLNQI; AKSATGLNQIS; KSATGLNQISS; SATGLNQISSS; ATGLNQISSSN;
TGLNQISSSNK; GLNQISSSNKV; LNQISSSNKVI; NQISSSNKVIP; QISSSNKVIPL;
ISSSNKVIPLC; SSSNKVIPLCK; SSNKVIPLCKI; SNKVIPLCKIL; NKVIPLCKILF;
KVIPLCKILFS; VIPLCKILFSS; IPLCKILFSSK; PLCKILFSSKN; LCKILFSSKNS;
CKILFSSKNSE; KILFSSKNSEF; ILFSSKNSEFC; LFSSKNSEFCK; FSSKNSEFCKD;
SSKNSEFCKDF; SKNSEFCKDFL; KNSEFCKDFLK; NSEFCKDFLKY; SEFCKDFLKYI;
EFCKDFLKYIL; FCKDFLKYILG; CKDFLKYILGL; KDFLKYILGLK; DFLKYILGLKS;
FLKYILGLKSI; LKYILGLKSIC; KYILGLKSICL; YILGLKSICLT; ILGLKSICLTN;
LGLKSICLTNL; GLKSICLTNLA; LKSICLTNLAC; KSICLTNLACR; SICLTNLACRV;
ICLTNLACRVL; CLTNLACRVLG; LTNLACRVLGT; TNLACRVLGTG; NLACRVLGTGY;
LACRVLGTGYS; ACRVLGTGYSF; CRVLGTGYSFI; RVLGTGYSFIV; VLGTGYSFIVT;
LGTGYSFIVTK; GTGYSFIVTKP; TGYSFIVTKPG; GYSFIVTKPGG; YSFIVTKPGGN;
SFIVTKPGGNI; FIVTKPGGNIW; IVTKPGGNIWV; VTKPGGNIWVL; TKPGGNIWVLL;
KPGGNIWVLLF; PGGNIWVLLFK; GGNIWVLLFKC; GNIWVLLFKCF; NIWVLLFKCFF;
IWVLLFKCFFS; WVLLFKCFFSK; VLLFKCFFSKF; LLFKCFFSKFT; LFKCFFSKFTL;
FKCFFSKFTLT; KCFFSKFTLTL; CFFSKFTLTLP; FFSKFTLTLPS; FSKFTLTLPSK;
SLKLSKLFIPC; LKLSKLFIPCP; KLSKLFIPCPE; LSKLFIPCPEG; SKLFIPCPEGK;
KLFIPCPEGKS; LFIPCPEGKSF; FIPCPEGKSFD; IPCPEGKSFDS; PCPEGKSFDSA;
CPEGKSFDSAP; PEGKSFDSAPV; EGKSFDSAPVP; GKSFDSAPVPF; KSFDSAPVPFT;
SFDSAPVPFTS; FDSAPVPFTSS; DSAPVPFTSSK; SAPVPFTSSKT; APVPFTSSKTT;
PVPFTSSKTTM; VPFTSSKTTMY; SIATPSSKVSL; IATPSSKVSLS; ATPSSKVSLSM;
TPSSKVSLSMG; PSSKVSLSMGR; SSKVSLSMGRF; SKVSLSMGRFT; KVSLSMGRFTF;
VSLSMGRFTFK; SLSMGRFTFKA; LSMGRFTFKAL; SMGRFTFKALP; MGRFTFKALPP;
GRFTFKALPPH; RFTFKALPPHK; FTFKALPPHKS; TFKALPPHKSN; FKALPPHKSNN;
KALPPHKSNNP; ALPPHKSNNPA; LPPHKSNNPAA; PPHKSNNPAAS; PHKSNNPAASV;
HKSNNPAASVV; KSNNPAASVVF; SNNPAASVVFP; NNPAASVVFPL; NPAASVVFPLS;
PAASVVFPLSM; AASVVFPLSMG; ASVVFPLSMGP; SVVFPLSMGPL; VVFPLSMGPLN;
VFPLSMGPLNN; FPLSMGPLNNQ; PLSMGPLNNQY; LSMGPLNNQYL; SMGPLNNQYLL;
MGPLNNQYLLL; GPLNNQYLLLG; PLNNQYLLLGT; LNNQYLLLGTL; NNQYLLLGTLK;
NQYLLLGTLKT; QYLLLGTLKTI; YLLLGTLKTIQ; LLLGTLKTIQC; LLGTLKTIQCK;
LGTLKTIQCKK; GTLKTIQCKKS; TLKTIQCKKSN; LKTIQCKKSNI; KTIQCKKSNIT;
TIQCKKSNITE; IQCKKSNITES; QCKKSNITESI; CKKSNITESIL; KKSNITESILG;
KSNITESILGS; SNITESILGSK; NITESILGSKQ; ITESILGSKQC; TESILGSKQCS;
ESILGSKQCSQ; SILGSKQCSQA; ILGSKQCSQAT; LGSKQCSQATP; GSKQCSQATPA;
SKQCSQATPAI; KQCSQATPAIY; QCSQATPAIYC; CSQATPAIYCS; SQATPAIYCSS;
QATPAIYCSST; ATPAIYCSSTA; TPAIYCSSTAF; PAIYCSSTAFP; APNIKSILSNI;
LNLSVSISSLV; NLSVSISSLVI; RVSTLFLAKTV; VSTLFLAKTVS; STLFLAKTVST;
TLFLAKTVSTA; LFLAKTVSTAC; FLLSAKIIAFA; LLSAKIIAFAK; LSAKIIAFAKC;
SAKIIAFAKCF; AKIIAFAKCFS; NSKYIPNNKNT; SKYIPNNKNTS; KYIPNNKNTSS;
YIPNNKNTSSH; IPNNKNTSSHF; PNNKNTSSHFV; NNKNTSSHFVS; NKNTSSHFVST;
KNTSSHFVSTA; NTSSHFVSTAY; TSSHFVSTAYS; SSHFVSTAYSV; SHFVSTAYSVI;
HFVSTAYSVIN; FVSTAYSVINF; VSTAYSVINFQ; STAYSVINFQD; TAYSVINFQDT;
AYSVINFQDTC; YSVINFQDTCF; SVINFQDTCFV; VINFQDTCFVS; INFQDTCFVSS;
NFQDTCFVSSG; FQDTCFVSSGS; QDTCFVSSGSS; DTCFVSSGSSG; TCFVSSGSSGL;
CFVSSGSSGLK; FVSSGSSGLKS; VSSGSSGLKSC; SSGSSGLKSCS; SGSSGLKSCSF;
GSSGLKSCSFK; SSGLKSCSFKP; SGLKSCSFKPP; MLSSIVWYGSL; LSSIVWYGSLV;
SSIVWYGSLVK; SIVWYGSLVKA; IVWYGSLVKAL; VWYGSLVKALY; WYGSLVKALYS;
YGSLVKALYSK; GSLVKALYSKY; SLVKALYSKYS; LVKALYSKYSL; VKALYSKYSLL;
KALYSKYSLLT; ALYSKYSLLTP; LYSKYSLLTPL; YSKYSLLTPLQ; SKYSLLTPLQI;
KYSLLTPLQIK; YSLLTPLQIKK; SLLTPLQIKKL; LLTPLQIKKLK; LTPLQIKKLKV;
TPLQIKKLKVH; PLQIKKLKVHS; LQIKKLKVHSF; QKLLIAETLCL; KLLIAETLCLC;
LLIAETLCLCG; LIAETLCLCGV; IAETLCLCGVK; AETLCLCGVKK; ETLCLCGVKKN;
TLCLCGVKKNI; LCLCGVKKNII; CLCGVKKNIIL; LCGVKKNIILC; CGVKKNIILCP;
GVKKNIILCPA; VKKNIILCPAH; KKNIILCPAHM; KNIILCPAHMC; NIILCPAHMCL;
IILCPAHMCLL; ILCPAHMCLLI; LCPAHMCLLIK; CPAHMCLLIKV; PAHMCLLIKVT;
AHMCLLIKVTE; HMCLLIKVTEY; MCLLIKVTEYF; CLLIKVTEYFS; LLIKVTEYFSI;
LIKVTEYFSIS; IKVTEYFSISF; KVTEYFSISFL; VTEYFSISFLY; TEYFSISFLYR;
EYFSISFLYRI; AFSLVVYTAKQ; FSLVVYTAKQA; SLVVYTAKQAR; LVVYTAKQARV;
VVYTAKQARVL; VYTAKQARVLL; YTAKQARVLLL; TAKQARVLLLN; AKQARVLLLNT;
KQARVLLLNTA; LRNWCRSEGKS; RNWCRSEGKSL; NWCRSEGKSLG; WCRSEGKSLGS;
CRSEGKSLGSS; RSEGKSLGSST; SEGKSLGSSTF; EGKSLGSSTFL; GKSLGSSTFLF;
KSLGSSTFLFF; SLGSSTFLFFL; LGSSTFLFFLG; GSSTFLFFLGG; SSTFLFFLGGV;
STFLFFLGGVE; TFLFFLGGVEC; ESAVASSSLAN; SAVASSSLANI; AVASSSLANIS;
VASSSLANISS; ASSSLANISSW; SSSLANISSWQ; SSLANISSWQN; SLANISSWQNK;
LANISSWQNKS; ANISSWQNKSS; NISSWQNKSSS; ISSWQNKSSSH; SSWQNKSSSHF;
SWQNKSSSHFS; WQNKSSSHFSL; QNKSSSHFSLK; NKSSSHFSLKE; KSSSHFSLKEL;
SSSHFSLKELH; SSHFSLKELHQ; SHFSLKELHQD; HFSLKELHQDS; FSLKELHQDSH;
SLKELHQDSHS; LKELHQDSHSS; KELHQDSHSSV; ELHQDSHSSVP; VGTYKKNNYLG;
GTYKKNNYLGP; TYKKNNYLGPF; YKKNNYLGPFN; KKNNYLGPFNI; KNNYLGPFNIL;
NNYLGPFNILL; NYLGPFNILLF; YLGPFNILLFI; REFLQLFGPTI; EFLQLFGPTIA;
FLQLFGPTIAE; LQLFGPTIAEF; QLFGPTIAEFL; LFGPTIAEFLQ; FGPTIAEFLQL;
GPTIAEFLQLG; PTIAEFLQLGL; TIAEFLQLGLS; IAEFLQLGLSQ; AEFLQLGLSQT;
EFLQLGLSQTT; FLQLGLSQTTV; SSQCSSNLSKP; SQCSSNLSKPR; QCSSNLSKPRA;
CSSNLSKPRAL; SSNLSKPRALF; SNLSKPRALFL; NLSKPRALFLK; LSKPRALFLKI;
SKPRALFLKIF; KPRALFLKIFY; PRALFLKIFYL; RALFLKIFYLN; ALFLKIFYLNA;
LFLKIFYLNAL; FLKIFYLNALI; ADIACKGSAQK; DIACKGSAQKA; IACKGSAQKAF;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

ACKGSAQKAFW; CKGSAQKAFWN; KGSAQKAFWNK; AIPCSTGYLGK; IPCSTGYLGKE;
PCSTGYLGKEE; CSTGYLGKEEN; STGYLGKEENQ; TGYLGKEENQH; GYLGKEENQHK;
YLGKEENQHKP; LGKEENQHKPL; GKEENQHKPLS; KEENQHKPLSY; EENQHKPLSYS;
ENQHKPLSYSR; NQHKPLSYSRF; QHKPLSYSRFQ; HKPLSYSRFQN; KPLSYSRFQNQ;
PLSYSRFQNQA; LSYSRFQNQAD; SYSRFQNQADE; YSRFQNQADEL; SRFQNQADELP;
RFQNQADELPL; FQNQADELPLH; QNQADELPLHP; NQADELPLHPA; QADELPLHPAP;
ADELPLHPAPF; DELPLHPAPFF; ELPLHPAPFFY; LPLHPAPFFYT; PLHPAPFFYTK;
LHPAPFFYTKY; HPAPFFYTKYS; PAPFFYTKYSF; APFFYTKYSFS; PFFYTKYSFSS;
FFYTKYSFSSF; FYTKYSFSSFY; YTKYSFSSFYP; TKYSFSSFYPR; KYSFSSFYPRR;
YSFSSFYPRRP; SFSSFYPRRPL; FSSFYPRRPLC; SSFYPRRPLCQ; SFYPRRPLCQG;
FYPRRPLCQGE; YPRRPLCQGEI; PRRPLCQGEIP; RRPLCQGEIPY; RPLCQGEIPYT;
PLCQGEIPYTS; LCQGEIPYTSL; CQGEIPYTSLN; QGEIPYTSLNK; GEIPYTSLNKL;
EIPYTSLNKLF; IPYTSLNKLFS; PYTSLNKLFSL; YTSLNKLFSLR; TSLNKLFSLRE;
SLNKLFSLRED; LNKLFSLREDF; NKLFSLREDFP; KLFSLREDFPR; LFSLREDFPRQ;
FSLREDFPRQL; SLREDFPRQLF; LREDFPRQLFQ; REDFPRQLFQG; EDFPRQLFQGL;
DFPRQLFQGLK; FPRQLFQGLKG; PRQLFQGLKGP

BK reading frame 3

8 mers:

LQKLQKNR; QKLQKNRD; KLQKNRDF; LQKNRDFP; QKNRDFPK; ASEKASTP; SEKASTPL;
EKASTPLL; KASTPLLL; ASTPLLLE; STPLLLER; TPLLLERK; PLLLERKG; LLLERKGG;
LLERKGGR; LERKGGGR; ERKGGGRG; RKGGGRGG; KGGGRGGL; GGGRGGLG; GGRGGLGL;
GRGGLGLL; RGGLGLLY; GGLGLLYI; GLGLLYII; LGLLYIIK; GLLYIIKK; LLYIIKKK;
LYIIKKKA; YIIKKKAT; IIKKKATG; IKKKATGR; KKKATGRS; KKATGRSC; KATGRSCL;
ATGRSCLP; TGRSCLPM; GRSCLPME; RSCLPMEC; SCLPMECS; CLPMECSQ; LPMECSQT;
PMECSQTM; MECSQTMT; ECSQTMTS; CSQTMTSG; SQTMTSGR; QTMTSGRK; TMTSGRKV;
MTSGRKVH; TSGRKVHD; SGRKVHDS; GRKVHDSQ; RKVHDSQG; KVHDSQGN; VHDSQGNA;
HDSQGNAA; DSQGNAAK; SQGNAAKP; PQEGKCMT; QEGKCMTH; EGKCMTHR; GKCMTHRE;
KCMTHREE; CMTHREEL; MTHREELL; THREELLT; HREELLTH; REELLTHG; EELLTHGM;
ELLTHGMQ; LLTHGMQP; LTHGMQPN; THGMQPNH; HGMQPNHD; GMQPNHDL; MQPNHDLR;
QPNHDLRK; PNHDLRKE; NHDLRKES; HDLRKESA; DLRKESAL; LRKESALG; RKESALGI;
KESALGIL; ESALGILA; SALGILAL; ALGILALS; LGILALSP; GILALSPV; ILALSPVK; LALSPVKL;
ALSPVKLD; LSPVKLDK; SPVKLDKG; PVKLDKGH; VKLDKGHG; KLDKGHGS; LDKGHGSA;
DKGHGSAP; KGHGSAPA; GHGSAPAV; HGSAPAVT; GSAPAVTT; SAPAVTTS; APAVTTSF;
PAVTTSFS; AVTTSFSE; VTTSFSES; TTSFSESW; NLDWNKKK; LDWNKKKS; DWNKKKSS;
WNKKKSSE; NKKKSSED; KKKSSEDF; KKSSEDFY; KSSEDFYF; SSEDFYFY; SEDFYFYF;
EDFYFYFR; DFYFYFRA; FYFYFRAF; YFYFRAFA; FYFRAFAG; YFRAFAGI; FRAFAGIL;
RQCRREKQ; QCRREKQK; CRREKQKY; RREKQKYH; REKQKYHC; EKQKYHCF; KQKYHCFT;
QKYHCFTC; KYHCFTCC; YHCFTCCK; HCFTCCKR; CFTCCKRL; FTCCKRLC; TCCKRLCK;
CCKRLCKR; CKRLCKRL; KRLCKRLL; RLCKRLLG; LCKRLLGK; SLFFCISR; LFFCISRF;
FFCISRFM; FCISRFMG; CISRFMGA; ISRFMGAA; SRFMGAAL; RFMGAALA; FMGAALAL;
MGAALALL; GAALALLG; AALALLGD; ALALLGDL; LALLGDLV; ALLGDLVA; LLGDLVAS;
LGDLVASV; GDLVASVS; DLVASVSE; LVASVSEA; VASVSEAA; ASVSEAAA; SVSEAAAA;
VSEAAAAT; SEAAAATG; EAAAATGF; AAAATGFS; AAATGFSV; AATGFSVA; ATGFSVAE;
TGFSVAEI; GFSVAEIA; FSVAEIAA; SVAEIAAG; VAEIAAGE; AEIAAGEA; EIAAGEAA;
IAAGEAAA; AAGEAAAA; AGEAAAAI; GEAAAAIE; EAAAAIEV; AAAAIEVQ; AAAIEVQI;
AAIEVQIA; AIEVQIAS; IEVQIASL; EVQIASLA; VQIASLAT; QIASLATV; IASLATVE;
ASLATVEG; SLATVEGI; LATVEGIT; ATVEGITS; TVEGITST; VEGITSTS; EGITSTSE;
GITSTSEA; ITSTSEAI; TSTSEAIA; STSEAIAA; TSEAIAAI; SEAIAAIG; EAIAAIGL;
AIAAIGLT; IAAIGLTP; AAIGLTPQ; AIGLTPQT; IGLTPQTY; GLTPQTYA; LTPQTYAV;
TPQTYAVI; PQTYAVIA; QTYAVIAG; TYAVIAGA; YAVIAGAP; AVIAGAPG; VIAGAPGA;
IAGAPGAI; AGAPGAIA; GAPGAIAG; APGAIAGF; PGAIAGFA; GAIAGFAA; AIAGFAAL;
IAGFAALI; AGFAALIQ; GFAALIQT; FAALIQTV; AALIQTVS; ALIQTVSG; LIQTVSGI;
IQTVSGIS; QTVSGISS; TVSGISSL; VSGISSLA; SGISSLAQ; GISSLAQV; ISSLAQVG;
SSLAQVGY; SLAQVGYK; LAQVGYKF; AQVGYKFF; QVGYKFFD; VGYKFFDD; GYKFFDDW;
YKFFDDWD; KFFDDWDH; FFDDWDHK; FDDWDHKV; DDWDHKVS; DWDHKVST; WDHKVSTV;
DHKVSTVG; HKVSTVGL; KVSTVGLY; VSTVGLYQ; STVGLYQQ; TVGLYQQS; VGLYQQSG;
GLYQQSGM; LYQQSGMA; YQQSGMAL; QQSGMALE; QSGMALEL; SGMALELF; GMALELFN;
MALELFNP; ALELFNPD; LELFNPDE; ELFNPDEY; LFNPDEYY; FNPDEYYD; NPDEYYDI;
PDEYYDIL; DEYYDILF; EYYDILFP; YYDILFPG; YDILFPGV; DILFPGVN; ILFPGVNT;
LFPGVNTF; FPGVNTFV; PGVNTFVN; GVNTFVNN; VNTFVNNI; NTFVNNIQ; TFVNNIQY;
FVNNIQYL; VNNIQYLD; NNIQYLDP; NIQYLDPR; IQYLDPRH; QYLDPRHW; YLDPRHWG;
LDPRHWGP; DPRHWGPS; PRHWGPSL; RHWGPSLF; HWGPSLFA; WGPSLFAT; GPSLFATI;
PSLFATIS; SLFATISQ; LFATISQA; FATISQAL; ATISQALW; TISQALWH; ISQALWHV;
SQALWHVI; QALWHVIR; ALWHVIRD; LWHVIRDD; WHVIRDDI; HVIRDDIP; VIRDDIPS;
IRDDIPSI; RDDIPSIT; DDIPSITS; DIPSITSQ; IPSITSQE; PSITSQEL; SITSQELQ;
ITSQELQR; TSQELQRR; SQELQRRT; QELQRRTE; ELQRRTER; LQRRTERF; QRRTERFF;
RRTERFFR; RTERFFRD; TERFFRDS; ERFFRDSL; RFFRDSLA; FFRDSLAR; FRDSLARF;
RDSLARFL; DSLARFLE; SLARFLEE; LARFLEET; ARFLEETT; RFLEETTW; FLEETTWT;
LEETTWTI; EETTWTIV; ETTWTIVN; TTWTIVNA; TWTIVNAP; WTIVNAPI; TIVNAPIN;
IVNAPINF; VNAPINFY; NAPINFYN; APINFYNY; PINFYNYI; INFYNYIQ; NFYNYIQQ;
FYNYIQQY; YNYIQQYY; NYIQQYYS; YIQQYYSD; IQQYYSDL; QQYYSDLS; QYYSDLSP;
YYSDLSPI; YSDLSPIR; SDLSPIRP; DLSPIRPS; LSPIRPSM; SPIRPSMV; PIRPSMVR;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

IRPSMVRQ; RPSMVRQV; PSMVRQVA; SMVRQVAE; MVRQVAER; VRQVAERE; RQVAEREG; QVAEREGT; VAEREGTR; AEREGTRV; EREGTRVH; REGTRVHF; EGTRVHFG; GTRVHFGH; TRVHFGHT; RVHFGHTY; VHFGHTYS; HFGHTYSI; FGHTYSID; GHTYSIDD; HTYSIDDA; TYSIDDAD; YSIDDADS; SIDDADSI; IDDADSIE; DDADSIEE; DADSIEEV; ADSIEEVT; DSIEEVTQ; SIEEVTQR; IEEVTQRM; EEVTQRMD; EVTQRMDL; VTQRMDLR; TQRMDLRN; QRMDLRNQ; RMDLRNQQ; MDLRNQQS; DLRNQQSV; LRNQQSVH; RNQQSVHS; NQQSVHSG; QQSVHSGE; QSVHSGEF; SVHSGEFI; VHSGEFIE; HSGEFIEK; SGEFIEKT; GEFIEKTI; EFIEKTIA; FIEKTIAP; IEKTIAPG; EKTIAPGG; KTIAPGGA; TIAPGGAN; IAPGGANQ; APGGANQR; PGGANQRT; GGANQRTA; GANQRTAP; ANQRTAPQ; NQRTAPQW; QRTAPQWM; RTAPQWML; TAPQWMLP; APQWMLPL; PQWMLPLL; QWMLPLLL; WMLPLLLG; MLPLLLGL; LPLLLGLY; PLLLGLYG; LLLGLYGT; LLGLYGTV; LGLYGTVT; GLYGTVTP; LYGTVTPA; YGTVTPAL; GTVTPALE; TVTPALEA; VTPALEAY; TPALEAYE; PALEAYED; ALEAYEDG; LEAYEDGP; EAYEDGPN; AYEDGPNQ; YEDGPNQK; EDGPNQKK; DGPNQKKR; GPNQKKRR; PNQKKRRV; NQKKRRVS; QKKRRVSR; KKRRVSRG; KRRVSRGS; RRVSRGSS; RVSRGSSQ; VSRGSSQK; SRGSSQKA; RGSSQKAK; GSSQKAKG; SSQKAKGT; SQKAKGTR; QKAKGTRA; KAKGTRAS; AKGTRASA; KGTRASAK; GTRASAKT; TRASAKTT; RASAKTTN; ASAKTTNK; SAKTTNKR; AKTTNKRR; KTTNKRRS; TTNKRRSR; TNKRRSRS; NKRRSRSS; KRRSRSSR; RRSRSSRS; NWGRCYYR; WGRCYYRG; GRCYYRGR; RCYYRGRM; CYYRGRML; YYRGRMLP; YRGRMLPK; RGRMLPKP; GRMLPKPR; RMLPKPRN; MLPKPRNG; LPKPRNGG; PKPRNGGS; KPRNGGSR; PREKNASL; REKNASLL; EKNASLLQ; KNASLLQH; NASLLQHS; ASLLQHSK; SLLQHSKN; LLQHSKNS; LQHSKNSP; QHSKNSPP; HSKNSPPQ; SKNSPPQF; KNSPPQFK; GPNLWKST; PNLWKSTD; NLWKSTDV; LWKSTDVG; WKSTDVGG; KSTDVGGC; STDVGGCN; TDVGGCNC; DVGGCNCT; VGGCNCTN; GGCNCTNR; GCNCTNRG; CNCTNRGY; NCTNRGYW; CTNRGYWN; TNRGYWNN; PSCRVTKS; SCRVTKSA; AWWRKTYS; WWRKTYSR; WRKTYSRQ; FPLLCCRW; PLLCCRWR; LLCCRWRT; LCCRWRTL; CCRWRTLG; CRWRTLGN; RWRTLGNA; WRTLGNAG; RTLGNAGS; TLGNAGSA; LGNAGSAN; GNAGSANE; NAGSANEL; AGSANELQ; GSANELQV; SANELQVK; ANELQVKV; NELQVKVP; KPNSPVPG; PNSPVPGN; NSPVPGNE; SPVPGNEY; GLFGQKQC; LFGQKQCL; FGQKQCLS; GQKQCLSS; VFWDFHRR; FWDFHRRG; WDFHRRGK; DFHRRGKC; FHRRGKCS; HRRGKCSP; RRGKCSPS; RGKCSPST; GKCSPSTS; KCSPSTSC; CSPSTSCD; SPSTSCDQ; PSTSCDQH; STSCDQHS; TSCDQHSY; SCDQHSYH; CDQHSYHS; DQHSYHSV; QHSYHSVA; HSYHSVAR; QLWNTTVE; LWNTTVER; WNTTVERP; NTTVERPC; TTVERPCK; TVERPCKI; VERPCKIF; DPPEKKIC; PPEKKICK; PEKKICKE; EKKICKES; KKICKESL; KICKESLP; ICKESLPN; CKESLPNF; KESLPNFL; ESLPNFLF; SLPNFLFA; LPNFLFAK; PYKQENPE; YKQENPES; KQENPESG; QENPESGW; ENPESGWA; NPESGWAA; PESGWAAY; ESGWAAYV; SGWAAYVW; GWAAYVWY; WAAYVWYG; AAYVWYGI; AYVWYGIP; YVWYGIPG; VWYGIPGR; WYGIPGRR; YGIPGRRG; WHRKTSRG; HRKTSRGP; RKTSRGPR; KTSRGPRY; TSRGPRYD; SRGPRYDK; RGPRYDKI; GPRYDKIY; QTGTIANQ; TGTIANQN; GTIANQNA; TIANQNAL; IANQNALN; ANQNALNR; NQNALNRC; QNALNRCF; NALNRCFY; ALNRCFYC; LNRCFYCT; NRCFYCTY; RCFYCTYT; CFYCTYTF; FYCTYTFN; YCTYTFNK; CTYTFNKC; TYTFNKCC; YTFNKCCF; TFNKCCFC; FNKCCFCI; NKCCFCIS; KCCFCISH; CCFCISHF; ACVILGVV; CVILGVVF; NTESLYTN; TESLYTNA; ESLYTNAT; SLYTNATL; LYTNATLD; YTNATLDY; TNATLDYG; NATLDYGG; ATLDYGGL; TLDYGGLT; LDYGGLTF; DYGGLTFG; YGGLTFGN; GGLTFGNL; GLTFGNLQ; LTFGNLQQ; TFGNLQQG; FGNLQQGL; GNLQQGLK; NLQQGLKY; LQQGLKYL; QQGLKYLR; QGLKYLRL; GLKYLRLG; LKYLRLGK; KYLRLGKS; YLRLGKSI; LRLGKSIV; RLGKSIVI; LGKSIVIG; GKSIVIGI; KSIVIGIQ; SIVIGIQC; IVIGIQCL; VIGIQCLI; IGIQCLIH; GIQCLIHV; IQCLIHVQ; QCLIHVQS; CLIHVQSL; LIHVQSLQ; IHVQSLQF; HVQSLQFL; VQSLQFLN; QSLQFLNP; SLQFLNPL; LQFLNPLL; QFLNPLLL; YQEYISPC; QEYISPCI; EYISPCIY; YISPCIYY; ISPCIYYI; SPCIYYIS; PCIYYISS; CIYYISSL; IYYISSLK; YYISSLKK; YISSLKKY; ISSLKKYT; SSLKKYTY; SLKKYTYL; LKKYTYLS; KKYTYLSQ; KYTYLSQN; YTYLSQNP; TYLSQNPA; YLSQNPAF; LSQNPAFP; SQNPAFPS; QNPAFPSI; NPAFPSIQ; PAFPSIQQ; AFPSIQQF; IVYQLQNQ; VYQLQNQL; YQLQNQLQ; QLQNQLQA; TKLAVATR; KLAVATRS; LAVATRSF; AVATRSFH; VATRSFHF; ATRSFHFV; TRSFHFVK; RSFHFVKF; SFHFVKFF; FHFVKFFF; HFVKFFFQ; FVKFFFQV; VKFFFQVR; KFFFQVRT; FFFQVRTL; FFQVRTLS; FQVRTLSF; QVRTLSFV; VRTLSFVR; RTLSFVRI; TLSFVRIF; LSFVRIFL; SFVRIFLN; FVRIFLNI; VRIFLNIF; RIFLNIFW; IFLNIFWA; PSLVEIFG; SLVEIFGF; LVEIFGFF; VEIFGFFC; EIFGFFCL; IFGFFCLN; FGFFCLNV; GFFCLNVS; FFCLNVSF; FCLNVSFL; CLNVSFLN; LNVSFLNL; NVSFLNLP; HFHLNNLS; FHLNNLSN; HLNNLSNC; LNNLSNCL; NNLSNCLN; NLSNCLNC; LSNCLNCL; SNCLNCLF; NCLNCLFH; CLNCLFHV; LNCLFHVL; NCLFHVLK; CLFHVLKA; LFHVLKAN; FHVLKANP; HVLKANPL; VLKANPLI; LKANPLIQ; KANPLIQL; ANPLIQLL; NPLIQLLS; PLIQLLSL; LIQLLSLL; IQLLSLLH; QLLSLLHL; LLSLLHLQ; LSLLHLQK; SLLHLQKQ; LLHLQKQP; LHLQKQPC; HLQKQPCT; LQKQPCTD; QKQPCTDL; LHLAQRLA; HLAQRLAF; LAQRLAFP; AQRLAFPW; QRLAFPWV; RLAFPWVG; LAFPWVGL; AFPWVGLH; FPWVGLHL; PWVGLHLR; WVGLHLRL; VGLHLRLY; GLHLRLYH; LHLRLYHH; HLRLYHHT; LRLYHHTN; RLYHHTNL; LYHHTNLI; YHHTNLIT; HHTNLITL; HTNLITLQ; TNLITLQL; NLITLQLV; LITLQLVL; ITLQLVLF; TLQLVLFF; LQLVLFFH; QLVLFFHY; LVLFFHYQ; VLFFHYQW; LFFHYQWD; FFHYQWDK; KQYSAKNQ; QYSAKNQI; YSAKNQIL; SAKNQILQ; AKNQILQN; KNQILQNP; NQILQNPF; VANSAAKQ; ANSAAKQH; NSAAKQHL; SAAKQHLP; AAKQHLPY; AKQHLPYI; KQHLPYIV; QHLPYIVL; HLPYIVLV; LPYIVLVQ; PYIVLVQH; YIVLVQHF; IVLVQHFH; VLVQHFHE; LVQHFHEL; VQHFHELQ; QHFHELQI; HFHELQIL; FHELQILN; HELQILNP; ELQILNPF; LQILNPFY; QILNPFYL; ILNPFYLI; LNPFYLIY; NPFYLIYD; IFLLAFLP; FLLAFLPW; LLAFLPWS; LAFLPWSY; AFLPWSYE; FLPWSYEG; LPWSYEGY; PWSYEGYL; WSYEGYLL; SYEGYLLF; YEGYLLFF; LKLYLLLA; KLYLLLAD; LYLLLADK; YLLLADKY; LLLADKYF; LLADKYFF; LADKYFFD; ADKYFFDF; DKYFFDFY; KYFFDFYF; YFFDFYFL; FFDFYFLQ; FDFYFLQK; HLQSAFHD; LQSAFHDT; SDKAGLFS; DKAGLFSD; KAGLFSDT; AGLFSDTF; GLFSDTFY; LFSDTFYT;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

FSDTFYTP; SDTFYTPL; DTFYTPLH; TFYTPLHC; FYTPLHCI; YTPLHCIE; TPLHCIEI; PLHCIEIL; LHCIEILN; HCIEILNT; CIEILNTY; IEILNTYL; EILNTYLI; ILNTYLII; LNTYLIIK; NTYLIIKT; TYLIIKTH; YLIIKTHP; LIIKTHPH; IIKTHPHT; IKTHPHTL; KTHPHTLS; THPHTLSL; HPHTLSLL; PHTLSLLH; HTLSLLHT; TLSLLHTQ; LSLLHTQP (wait)

FSDTFYTP; SDTFYTPL; DTFYTPLH; TFYTPLHC; FYTPLHCI; YTPLHCIE; TPLHCIEI;
PLHCIEIL; LHCIEILN; HCIEILNT; CIEILNTY; IEILNTYL; EILNTYLI; ILNTYLII;
LNTYLIIK; NTYLIIKT; TYLIIKTH; YLIIKTHP; LIIKTHPH; IIKTHPHT; IKTHPHTL;
KTHPHTLS; THPHTLSL; HPHTLSLL; PHTLSLLH; HTLSLLHT; TLSLLHTQ; LISKTPAL;
ISKTPALF; SKTPALFL; KTPALFLQ; TPALFLQA; PALFLQAL; ALFLQALL; LFLQALLG;
NHAPLSPL; HAPLSPLE; APLSPLEC; PLSPLECF; LSPLECFL; SPLECFLL; LRHYIVSI;
RHYIVSIP; HYIVSIPY; RYTAFDRN; YTAFDRNY; LQKLYVYV; QKLYVYVE; KLYVYVEL;
LYVYVELK; YVYVELKR; VYVELKRI; YYAQHTCV; YAQHTCVY; VFYTEFEL; FYTEFELF;
YTEFELFL; YTQQSRQG; TQQSRQGF; QQSRQGFY; QSRQGFYY; ETGVDQRE; TGVDQRES;
GVDQRESL; GLLPFFFF; LLPFFFFW; LPFFFFWV; PFFFFWVV; FFFFWVVL; FFFWVVLS;
FFWVVLSV; FWVVLSVE; WVVLSVEN; VVLSVENL; VLSVENLL; LSVENLLL; SVENLLLL;
VENLLLLL; ENLLLLLH; NLLLLLHH; LLLLLHHW; LLLLHHWQ; LLLHHWQT; LLHHWQTY;
LHHWQTYL; HHWQTYLH; HWQTYLHG; WQTYLHGK; QTYLHGKI; TYLHGKIN; YLHGKINL;
LHGKINLH; HGKINLHP; GKINLHPI; KINLHPIF; INLHPIFH; RNSTRTPT; NSTRTPTL;
STRTPTLL; TRTPTLLF; RTPTLLFH; TPTLLFHR; PTLLFHRL; TLLFHRLA; LLFHRLAP;
LFHRLAPI; FHRLAPIK; HRLAPIKK; RLAPIKKI; LAPIKKII; APIKKIIT; GLLIFYYL;
LLIFYYLS; LIFYYLSK; IFYYLSKY; FYYLSKYK; YYLSKYKL; YLSKYKLV; LSKYKLVT;
SKYKLVTL; KYKLVTLK; YKLVTLKL; ISEGSFSN; SEGSFSNY; EGSFSNYL; GSFSNYLD;
SFSNYLDP; FSNYLDPP; SNYLDPPL; NYLDPPLQ; YLDPPLQS; LDPPLQSF; DPPLQSFF;
PPLQSFFS; AKPLCEAV; KPLCEAVN; PLCEAVNA; LCEAVNAV; CEAVNAVA; EAVNAVAI;
AVNAVAIY; VNAVAIYP; NAVAIYPN; AVAIYPNQ; VAIYPNQG; AIYPNQGL; IYPNQGLF;
YPNQGLFS; HARAVHRR; ARAVHRRL; RAVHRRLF; AVHRRLFG; VHRRLFGT; HRRLFGTN;
RRLFGTNR; RLFGTNRP; LFGTNRPF; FGTNRPFL; GTNRPFLA; TNRPFLAV; NRPFLAVQ;
RPFLAVQG; PFLAVQGI; FLAVQGIW; LAVQGIWA; AVQGIWAK; VQGIWAKR; QGIWAKRK;
GIWAKRKI; IWAKRKIS; WAKRKIST; AKRKISTN; KRKISTNL; ATPGSKIR; TPGSKIRL;
PGSKIRLM; GSKIRLMS; SKIRLMSY; KIRLMSYL; IRLMSYLY; RLMSYLYI; LMSYLYIL;
MSYLYILL; SYLYILLH; YLYILLHF; LYILLHFF; YILLHFFI; ILLHFFIQ; LLHFFIQS;
LHFFIQSI; HFFIQSIH; FFIQSIHS; FIQSIHSL; IQSIHSLH; QSIHSLHF; SIHSLHFI;
IHSLHFIL; HSLHFILV; SLHFILVA; LHFILVAP; HFILVAPF; FILVAPFV; ILVAPFVR;
LVAPFVRV; VAPFVRVK; APFVRVKF; PFVRVKFL; FVRVKFLT; VRVKFLTL; RVKFLTLP;
GKISPGSS; KISPGSSF; ISPGSSFK; SPGSSFKA; KVHELHGF; VHELHGFF; HELHGFFP;
ELHGFFPV; LHGFFPVK; HGFFPVKN; GFFPVKNF; FFPVKNFI; FPVKNFIH 9 mers:

LQKLQKNRD; QKLQKNRDF; KLQKNRDFP; LQKNRDFPK; ASEKASTPL; SEKASTPLL;
EKASTPLLL; KASTPLLLE; ASTPLLLER; STPLLLERK; TPLLLERKG; PLLLERKGG;
LLLERKGGG; LLERKGGGR; LERKGGGRG; ERKGGGRGG; RKGGGRGGL; KGGGRGGLG;
GGGRGGLGL; GGRGGLGLL; GRGGLGLLY; RGGLGLLYI; GGLGLLYII; GLGLLYIIK;
LGLLYIIKK; GLLYIIKKK; LLYIIKKKA; LYIIKKKAT; YIIKKKATG; IIKKKATGR;
IKKKATGRS; KKKATGRSC; KKATGRSCL; KATGRSCLP; ATGRSCLPM; TGRSCLPME;
GRSCLPMEC; RSCLPMECS; SCLPMECSQ; CLPMECSQT; LPMECSQTM; PMECSQTMT;
MECSQTMTS; ECSQTMTSG; CSQTMTSGR; SQTMTSGRK; QTMTSGRKV; TMTSGRKVH;
MTSGRKVHD; TSGRKVHDS; SGRKVHDSQ; GRKVHDSQG; RKVHDSQGN; KVHDSQGNA;
VHDSQGNAA; HDSQGNAAK; DSQGNAAKP; PQEGKCMTH; QEGKCMTHR; EGKCMTHRE;
GKCMTHREE; KCMTHREEL; CMTHREELL; MTHREELLT; THREELLTH; HREELLTHG;
REELLTHGM; EELLTHGMQ; ELLTHGMQP; LLTHGMQPN; LTHGMQPNH; THGMQPNHD;
HGMQPNHDL; GMQPNHDLR; MQPNHDLRK; QPNHDLRKE; PNHDLRKES; NHDLRKESA;
QTCFASLGI; TCFASLGIL; CFASLGILA; FASLGILAL; ASLGILALS; SLGILALSP;
LGILALSPV; GILALSPVK; ILALSPVKL; LALSPVKLD; ALSPVKLDK; LSPVKLDKG;
SPVKLDKGH; PVKLDKGHG; VKLDKGHGS; KLDKGHGSA; LDKGHGSAP; DKGHGSAPA;
KGHGSAPAV; GHGSAPAVT; HGSAPAVTT; GSAPAVTTS; SAPAVTTSF; APAVTTSFS;
PAVTTSFSE; AVTTSFSES; VTTSFSESW; NLDWNKKKS; LDWNKKKSS; DWNKKKSSE;
WNKKKSSED; NKKKSSEDF; KKKSSEDFY; KKSSEDFYF; KSSEDFYFY; SSEDFYFYF;
SEDFYFYFR; EDFYFYFRA; DFYFYFRAF; FYFYFRAFA; YFYFRAFAG; FYFRAFAGI;
YFRAFAGIL; RQCRREKQK; QCRREKQKY; CRREKQKYH; RREKQKYHC; REKQKYHCF;
EKQKYHCFT; KQKYHCFTC; QKYHCFTCC; KYHCFTCCK; YHCFTCCKR; HCFTCCKRL;
CFTCCKRLC; FTCCKRLCK; TCCKRLCKR; CCKRLCKRL; CKRLCKRLL; KRLCKRLLG;
RLCKRLLGK; SLFFCISRF; LFFCISRFM; FFCISRFMG; FCISRFMGA; CISRFMGAA;
ISRFMGAAL; SRFMGAALA; RFMGAALAL; FMGAALALL; MGAALALLG; GAALALLGD;
AALALLGDL; ALALLGDLV; LALLGDLVA; ALLGDLVAS; LLGDLVASV; LGDLVASVS;
GDLVASVSE; DLVASVSEA; LVASVSEAA; VASVSEAAA; ASVSEAAAA; SVSEAAAAT;
VSEAAAATG; SEAAAATGF; EAAAATGFS; AAAATGFSV; AAATGFSVA; AATGFSVAE;
ATGFSVAEI; TGFSVAEIA; GFSVAEIAA; FSVAEIAAG; SVAEIAAGE; VAEIAAGEA;
AEIAAGEAA; EIAAGEAAA; IAAGEAAAI; AAGEAAAIE; AGEAAAIEV; GEAAAIEVQ;
EAAAIEVQ; AAAAIEVQI; AAAIEVQIA; AAIEVQIAS; AIEVQIASL; IEVQIASLA;
EVQIASLAT; VQIASLATV; QIASLATVE; IASLATVEG; ASLATVEGI; SLATVEGIT;
LATVEGITS; ATVEGITST; TVEGITSTS; VEGITSTSE; EGITSTSEA; GITSTSEAI;
ITSTSEAIA; TSTSEAIAA; STSEAIAAI; TSEAIAAIG; SEAIAAIGL; EAIAAIGLT;
AIAAIGLTP; IAAIGLTPQ; AAIGLTPQT; AIGLTPQTY; IGLTPQTYA; GLTPQTYAV;
LTPQTYAVI; TPQTYAVIA; PQTYAVIAG; QTYAVIAGA; TYAVIAGAP; YAVIAGAPG;
AVIAGAPGA; VIAGAPGAI; IAGAPGAIA; AGAPGAIAG; GAPGAIAGF; APGAIAGFA;
PGAIAGFAA; GAIAGFAAL; AIAGFAALI; IAGFAALIQ; AGFAALIQT; GFAALIQTV;
FAALIQTVS; AALIQTVSG; ALIQTVSGI; LIQTVSGIS; IQTVSGISS; QTVSGISSL;
TVSGISSLA; VSGISSLAQ; SGISSLAQV; GISSLAQVG; ISSLAQVGY; SSLAQVGYK;
SLAQVGYKF; LAQVGYKFF; AQVGYKFFD; QVGYKFFDD; VGYKFFDDW; GYKFFDDWD;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

YKFFDDWDH; KFFDDWDHK; FFDDWDHKV; FDDWDHKVS; DDWDHKVST; DWDHKVSTV;
WDHKVSTVG; DHKVSTVGL; HKVSTVGLY; KVSTVGLYQ; VSTVGLYQQ; STVGLYQQS;
TVGLYQQSG; VGLYQQSGM; GLYQQSGMA; LYQQSGMAL; YQQSGMALE; QQSGMALEL;
QSGMALELF; SGMALELFN; GMALELFNP; MALELFNPD; ALELFNPDE; LELFNPDEY;
ELFNPDEYY; LFNPDEYYD; FNPDEYYDI; NPDEYYDIL; PDEYYDILF; DEYYDILFP;
EYYDILFPG; YYDILFPGV; YDILFPGVN; DILFPGVNT; ILFPGVNTF; LFPGVNTFV;
FPGVNTFVN; PGVNTFVNN; GVNTFVNNI; VNTFVNNIQ; NTFVNNIQY; TFVNNIQYL;
FVNNIQYLD; VNNIQYLDP; NNIQYLDPR; NIQYLDPRH; IQYLDPRHW; QYLDPRHWG;
YLDPRHWGP; LDPRHWGPS; DPRHWGPSL; PRHWGPSLF; RHWGPSLFA; HWGPSLFAT;
WGPSLFATI; GPSLFATIS; PSLFATISQ; SLFATISQA; LFATISQAL; FATISQALW;
ATISQALWH; TISQALWHV; ISQALWHVI; SQALWHVIR; QALWHVIRD; ALWHVIRDD;
LWHVIRDDI; WHVIRDDIP; HVIRDDIPS; VIRDDIPSI; IRDDIPSIT; RDDIPSITS;
DDIPSITSQ; DIPSITSQE; IPSITSQEL; PSITSQELQ; SITSQELQR; ITSQELQRR;
TSQELQRRT; SQELQRRTE; QELQRRTER; ELQRRTERF; LQRRTERFF; QRRTERFFR;
RRTERFFRD; RTERFFRDS; TERFFRDSL; ERFFRDSLA; RFFRDSLAR; FFRDSLARF;
FRDSLARFL; RDSLARFLE; DSLARFLEE; SLARFLEET; LARFLEETT; ARFLEETTW;
RFLEETTWT; FLEETTWTI; LEETTWTIV; EETTWTIVN; ETTWTIVNA; TTWTIVNAP;
TWTIVNAPI; WTIVNAPIN; TIVNAPINF; IVNAPINFY; VNAPINFYN; NAPINFYNY;
APINFYNYI; PINFYNYIQ; INFYNYIQQ; NFYNYIQQY; FYNYIQQYY; YNYIQQYYS;
NYIQQYYSD; YIQQYYSDL; IQQYYSDLS; QQYYSDLSP; QYYSDLSPI; YYSDLSPIR;
YSDLSPIRP; SDLSPIRPS; DLSPIRPSM; LSPIRPSMV; SPIRPSMVR; PIRPSMVRQ;
IRPSMVRQV; RPSMVRQVA; PSMVRQVAE; SMVRQVAER; MVRQVAERE; VRQVAEREG;
RQVAEREGT; QVAEREGTR; VAEREGTRV; AEREGTRVH; EREGTRVHF; REGTRVHFG;
EGTRVHFGH; GTRVHFGHT; TRVHFGHTY; RVHFGHTYS; VHFGHTYSI; HFGHTYSID;
FGHTYSIDD; GHTYSIDDA; HTYSIDDAD; TYSIDDADS; YSIDDADSI; SIDDADSIE;
IDDADSIEE; DDADSIEEV; DADSIEEVT; ADSIEEVTQ; DSIEEVTQR; SIEEVTQRM;
IEEVTQRMD; EEVTQRMDL; EVTQRMDLR; VTQRMDLRN; TQRMDLRNQ; QRMDLRNQQ;
RMDLRNQQS; MDLRNQQSV; DLRNQQSVH; LRNQQSVHS; RNQQSVHSG; NQQSVHSGE;
QQSVHSGEF; QSVHSGEFI; SVHSGEFIE; VHSGEFIEK; HSGEFIEKT; SGEFIEKTI;
GEFIEKTIA; EFIEKTIAP; FIEKTIAPG; IEKTIAPGG; EKTIAPGGA; KTIAPGGAN;
TIAPGGANQ; IAPGGANQR; APGGANQRT; PGGANQRTA; GGANQRTAP; GANQRTAPQ;
ANQRTAPQW; NQRTAPQWM; QRTAPQWML; RTAPQWMLP; TAPQWMLPL; APQWMLPLL;
PQWMLPLLL; QWMLPLLLG; WMLPLLLGL; MLPLLLGLY; LPLLLGLYG; PLLLGLYGT;
LLLGLYGTV; LLGLYGTVT; LGLYGTVTP; GLYGTVTPA; LYGTVTPAL; YGTVTPALE;
GTVTPALEA; TVTPALEAY; VTPALEAYE; TPALEAYED; PALEAYEDG; ALEAYEDGP;
LEAYEDGPN; EAYEDGPNQ; AYEDGPNQK; YEDGPNQKK; EDGPNQKKR; DGPNQKKRR;
GPNQKKRRV; PNQKKRRVS; NQKKRRVSR; QKKRRVSRG; KKRRVSRGS; KRRVSRGSS;
RRVSRGSSQ; RVSRGSSQK; VSRGSSQKA; SRGSSQKAK; RGSSQKAKG; GSSQKAKGT;
SSQKAKGTR; SQKAKGTRA; QKAKGTRAS; KAKGTRASA; AKGTRASAK; KGTRASAKT;
GTRASAKTT; TRASAKTTN; RASAKTTNK; ASAKTTNKR; SAKTTNKRR; AKTTNKRRS;
KTTNKRRSR; TTNKRRSRS; TNKRRSRSS; NKRRSRSSR; KRRSRSSRS; NWGRCYYRG;
WGRCYYRGR; GRCYYRGRM; RCYYRGRML; CYYRGRMLP; YYRGRMLPK; YRGRMLPKP;
RGRMLPKPR; GRMLPKPRN; RMLPKPRNG; MLPKPRNGG; LPKPRNGGS; PKPRNGGSR;
PREKNASLL; REKNASLLQ; EKNASLLQH; KNASLLQHS; NASLLQHSK; ASLLQHSKN;
SLLQHSKNS; LLQHSKNSP; LQHSKNSPP; QHSKNSPPQ; HSKNSPPQF; SKNSPPQFK;
GPNLWKSTD; PNLWKSTDV; NLWKSTDVG; LWKSTDVGG; WKSTDVGGC; KSTDVGGCN;
STDVGGCNC; TDVGGCNCT; DVGGCNCTN; VGGCNCTNR; GGCNCTNRG; GCNCTNRGY;
CNCTNRGYW; NCTNRGYWN; CTNRGYWNN; PSCRVTKSA; AWWRKTYSR; WWRKTYSRQ;
FPLLCCRWR; PLLCCRWRT; LLCCRWRTL; LCCRWRTLG; CCRWRTLGN; CRWRTLGNA;
RWRTLGNAG; WRTLGNAGS; RTLGNAGSA; TLGNAGSAN; LGNAGSANE; GNAGSANEL;
NAGSANELQ; AGSANELQV; GSANELQVK; SANELQVKV; ANELQVKVP; KPNSPVPGN;
PNSPVPGNE; NSPVPGNEY; GLFGQKQCL; LFGQKQCLS; FGQKQCLSS; VFWDFHRRG;
FWDFHRRGK; WDFHRRGKC; DFHRRGKCS; FHRRGKCSP; HRRGKCSPS; RRGKCSPST;
RGKCSPSTS; GKCSPSTSC; KCSPSTSCD; CSPSTSCDQ; SPSTSCDQH; PSTSCDQHS;
STSCDQHSY; TSCDQHSYH; SCDQHSYHS; CDQHSYHSV; DQHSYHSVA; QHSYHSVAR;
QLWNTTVER; LWNTTVERP; WNTTVERPC; NTTVERPCK; TTVERPCKI; TVERPCKIF;
DPPEKKICK; PPEKKICKE; PEKKICKES; EKKICKESL; KKICKESLP; KICKESLPN;
ICKESLPNF; CKESLPNFL; KESLPNFLF; ESLPNFLFA; SLPNFLFAK; PYKQENPES;
YKQENPESG; KQENPESGW; QENPESGWA; ENPESGWAA; NPESGWAAY; PESGWAAYV;
ESGWAAYVW; SGWAAYVWY; GWAAYVWYG; WAAYVWYGI; AAYVWYGIP; AYVWYGIPG;
YVWYGIPGR; VWYGIPGRR; WYGIPGRRG; WHRKTSRGP; HRKTSRGPR; RKTSRGPRY;
KTSRGPRYD; TSRGPRYDK; SRGPRYDKI; RGPRYDKIY; QTGTIANQN; TGTIANQNA;
GTIANQNAL; TIANQNALN; IANQNALNR; ANQNALNRC; NQNALNRCF; QNALNRCFY;
NALNRCFYC; ALNRCFYCT; LNRCFYCTY; NRCFYCTYT; RCFYCTYTF; CFYCTYTFN;
FYCTYTFNK; YCTYTFNKC; CTYTFNKCC; TYTFNKCCF; YTFNKCCFC; TFNKCCFCI;
FNKCCFCIS; NKCCFCISH; KCCFCISHF; ACVILGVVF; NTESLYTNA; TESLYTNAT;
ESLYTNATL; SLYTNATLD; LYTNATLDY; YTNATLDYG; TNATLDYGG; NATLDYGGL;
ATLDYGGLT; TLDYGGLTF; LDYGGLTFG; DYGGLTFGN; YGGLTFGNL; GGLTFGNLQ;
GLTFGNLQQ; LTFGNLQQG; TFGNLQQGL; FGNLQQGLK; GNLQQGLKY; NLQQGLKYL;
LQQGLKYLR; QQGLKYLRL; QGLKYLRLG; GLKYLRLGK; LKYLRLGKS; KYLRLGKSI;
YLRLGKSIV; LRLGKSIVI; RLGKSIVIG; LGKSIVIGI; GKSIVIGIQ; KSIVIGIQC;
SIVIGIQCL; IVIGIQCLI; VIGIQCLIH; IGIQCLIHV; GIQCLIHVQ; IQCLIHVQS;
QCLIHVQSL; CLIHVQSLQ; LIHVQSLQF; IHVQSLQFL; HVQSLQFLN; VQSLQFLNP;
QSLQFLNPL; SLQFLNPLL; LQFLNPLLL; YQEYISPCI; QEYISPCIY; EYISPCIYY;
YISPCIYYI; ISPCIYYIS; SPCIYYISS; PCIYYISSL; CIYYISSLK; IYYISSLKK;
YYISSLKKY; YISSLKKYT; ISSLKKYTY; SSLKKYTYL; SLKKYTYLS; LKKYTYLSQ;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

KKYTYLSQN; KYTYLSQNP; YTYLSQNPA; TYLSQNPAF; YLSQNPAFP; LSQNPAFPS;
SQNPAFPSI; QNPAFPSIQ; NPAFPSIQQ; PAFPSIQQF; IVYQLQNQL; VYQLQNQLQ;
YQLQNQLQA; TKLAVATRS; KLAVATRSF; LAVATRSFH; AVATRSFHF; VATRSFHFV;
ATRSFHFVK; TRSFHFVKF; RSFHFVKFF; SFHFVKFFF; FHFVKFFFQ; HFVKFFFQV;
FVKFFFQVR; VKFFFQVRT; KFFFQVRTL; FFFQVRTLS; FFQVRTLSF; FQVRTLSFV;
QVRTLSFVR; VRTLSFVRI; RTLSFVRIF; TLSFVRIFL; LSFVRIFLN; SFVRIFLNI;
FVRIFLNIF; VRIFLNIFW; RIFLNIFWA; PSLVEIFGF; SLVEIFGFF; LVEIFGFFC;
VEIFGFFCL; EIFGFFCLN; IFGFFCLNV; FGFFCLNVS; GFFCLNVSF; FFCLNVSFL;
FCLNVSFLN; CLNVSFLNL; LNVSFLNLP; HFHLNNLSN; FHLNNLSNC; HLNNLSNCL;
LNNLSNCLN; NNLSNCLNC; NLSNCLNCL; LSNCLNCLF; SNCLNCLFH; NCLNCLFHV;
CLNCLFHVL; LNCLFHVLK; NCLFHVLKA; CLFHVLKAN; LFHVLKANP; FHVLKANPL;
HVLKANPLI; VLKANPLIQ; LKANPLIQL; KANPLIQLL; ANPLIQLLS; NPLIQLLSL;
PLIQLLSLL; LIQLLSLLH; IQLLSLLHL; QLLSLLHLQ; LLSLLHLQK; LSLLHLQKQ;
SLLHLQKQP; LLHLQKQPC; LHLQKQPCT; HLQKQPCTD; LQKQPCTDL; LHLAQRLAF;
HLAQRLAFP; LAQRLAFPW; AQRLAFPWV; QRLAFPWVG; RLAFPWVGL; LAFPWVGLH;
AFPWVGLHL; FPWVGLHLR; PWVGLHLRL; WVGLHLRLY; VGLHLRLYH; GLHLRLYHH;
LHLRLYHHT; HLRLYHHTN; LRLYHHTNL; RLYHHTNLI; LYHHTNLIT; YHHTNLITL;
HHTNLITLQ; HTNLITLQL; TNLITLQLV; NLITLQLVL; LITLQLVLF; ITLQLVLFF;
TLQLVLFFH; LQLVLFFHY; QLVLFFHYQ; LVLFFHYQW; VLFFHYQWD; LFFHYQWDL;
KQYSAKNQI; QYSAKNQIL; YSAKNQILQ; SAKNQILQN; AKNQILQNP; KNQILQNPF;
VANSAAKQH; ANSAAKQHL; NSAAKQHLP; SAAKQHLPY; AAKQHLPYI; AKQHLPYIV;
KQHLPYIVL; QHLPYIVLV; HLPYIVLVQ; LPYIVLVQH; PYIVLVQHF; YIVLVQHFH;
IVLVQHFHE; VLVQHFHEL; LVQHFHELQ; VQHFHELQI; QHFHELQIL; HFHELQILN;
FHELQILNP; HELQILNPF; ELQILNPFY; LQILNPFYL; QILNPFYLI; ILNPFYLIY;
LNPFYLIYD; IFLLAFLPW; FLLAFLPWS; LLAFLPWSY; LAFLPWSYE; AFLPWSYEG;
FLPWSYEGY; LPWSYEGYL; PWSYEGYLL; WSYEGYLLF; SYEGYLLFF; LKLYLLLAD;
KLYLLLADK; LYLLLADKY; YLLLADKYF; LLLADKYFF; LLADKYFFD; LADKYFFDF;
ADKYFFDFY; DKYFFDFYF; KYFFDFYFL; YFFDFYFLQ; FFDFYFLQK; HLQSAFHDT;
SDKAGLFSD; DKAGLFSDT; KAGLFSDTF; AGLFSDTFY; GLFSDTFYT; LFSDTFYTP;
FSDTFYTPL; SDTFYTPLH; DTFYTPLHC; TFYTPLHCI; FYTPLHCIE; YTPLHCIEI;
TPLHCIEIL; PLHCIEILN; LHCIEILNT; HCIEILNTY; CIEILNTYL; IEILNTYLI;
EILNTYLII; ILNTYLIIK; LNTYLIIKT; NTYLIIKTH; TYLIIKTHP; YLIIKTHPH;
LIIKTHPHT; IIKTHPHTL; IKTHPHTLS; KTHPHTLSL; THPHTLSLL; HPHTLSLLH;
PHTLSLLHT; HTLSLLHTQ; LISKTPALF; ISKTPALFL; SKTPALFLQ; KTPALFLQA;
TPALFLQAL; PALFLQALL; ALFLQALLG; NHAPLSPLE; HAPLSPLEC; APLSPLECF;
PLSPLECFL; LSPLECFLL; LRHYIVSIP; RHYIVSIPY; RYTAFDRNY; LQKLYVYVE;
QKLYVYVEL; KLYVYVELK; LYVYVELKR; YVYVELKRI; YYAQHTCVY; VFYTEFELF;
FYTEFELFL; YTQQSRQGF; TQQSRQGFY; QQSRQGFYY; ETGVDQRES; TGVDQRESL;
GLLPFFFFW; LLPFFFFWV; LPFFFFWVV; PFFFFWVVL; FFFFWVVLS; FFFWVVLSV;
FFWVVLSVE; FWVVLSVEN; WVVLSVENL; VVLSVENLL; VLSVENLLL; LSVENLLLL;
SVENLLLLL; VENLLLLLH; ENLLLLLHH; NLLLLLHHW; LLLLLHHWQ; LLLLHHWQT;
LLLHHWQTY; LLHHWQTYL; LHHWQTYLH; HHWQTYLHG; HWQTYLHGK; WQTYLHGKI;
QTYLHGKIN; TYLHGKINL; YLHGKINLH; LHGKINLHP; HGKINLHPI; GKINLHPIF;
KINLHPIFH; RNSTRTPTL; NSTRTPTLL; STRTPTLLF; TRTPTLLFH; RTPTLLFHR;
TPTLLFHRL; PTLLFHRLA; TLLFHRLAP; LLFHRLAPI; LFHRLAPIK; FHRLAPIKK;
HRLAPIKKI; RLAPIKKII; LAPIKKIIT; GLLIFYYLS; LLIFYYLSK; LIFYYLSKY;
IFYYLSKYK; FYYLSKYKL; YYLSKYKLV; YLSKYKLVT; LSKYKLVTL; SKYKLVTLK;
KYKLVTLKL; ISEGSFSNY; SEGSFSNYL; EGSFSNYLD; GSFSNYLDP; SFSNYLDPP;
FSNYLDPPL; SNYLDPPLQ; NYLDPPLQS; YLDPPLQSF; LDPPLQSFF; DPPLQSFFS;
AKPLCEAVN; KPLCEAVNA; PLCEAVNAV; LCEAVNAVA; CEAVNAVAI; EAVNAVAIY;
AVNAVAIYP; VNAVAIYPN; NAVAIYPNQ; AVAIYPNQG; VAIYPNQGL; AIYPNQGLF;
IYPNQGLFS; HARAVHRRL; ARAVHRRLF; RAVHRRLFG; AVHRRLFGT; VHRRLFGTN;
HRRLFGTNR; RRLFGTNRP; RLFGTNRPF; LFGTNRPFL; FGTNRPFLA; GTNRPFLAV;
TNRPFLAVQ; NRPFLAVQG; RPFLAVQGI; PFLAVQGIW; FLAVQGIWA; LAVQGIWAK;
AVQGIWAKR; VQGIWAKRK; QGIWAKRKI; GIWAKRKIS; IWAKRKIST; WAKRKISTN;
AKRKISTNL; ATPGSKIRL; TPGSKIRLM; PGSKIRLMS; GSKIRLMSY; SKIRLMSYL;
KIRLMSYLY; IRLMSYLYI; RLMSYLYIL; LMSYLYILL; MSYLYILLH; SYLYILLHF;
YLYILLHFF; LYILLHFFI; YILLHFFIQ; ILLHFFIQS; LLHFFIQSI; LHFFIQSIH;
HFFIQSIHS; FFIQSIHSL; FIQSIHSLH; IQSIHSLHF; QSIHSLHFI; SIHSLHFIL;
IHSLHFILV; HSLHFILVA; SLHFILVAP; LHFILVAPF; HFILVAPFV; FILVAPFVR;
ILVAPFVRV; LVAPFVRVK; VAPFVRVKF; APFVRVKFL; PFVRVKFLT; FVRVKFLTL;
VRVKFLTLP; GKISPGSSF; KISPGSSFK; ISPGSSFKA; KVHELHGFF; VHELHGFFP;
HELHGFFPV; ELHGFFPVK; LHGFFPVKN; HGFFPVKNF; GFFPVKNFI; FFPVKNFIH 10 mers:

LQKLQKNRDF; QKLQKNRDFP; KLQKNRDFPK; ASEKASTPLL; SEKASTPLLL;
EKASTPLLLE; KASTPLLLER; ASTPLLLERK; STPLLLERKG; TPLLLERKGG;
PLLLERKGGG; LLLERKGGGR; LLERKGGGRG; LERKGGGRGG; ERKGGGRGGL;
RKGGGRGGLG; KGGGRGGLGL; GGGRGGLGLL; GGRGGLGLLY; GRGGLGLLYI;
RGGLGLLYII; GGLGLLYIIK; GLGLLYIIKK; LGLLYIIKKK; GLLYIIKKKA;
LLYIIKKKAT; LYIIKKKATG; YIIKKKATGR; IIKKKATGRS; IKKKATGRSC;
KKKATGRSCL; KKATGRSCLP; KATGRSCLPM; ATGRSCLPME; TGRSCLPMEC;
GRSCLPMECS; RSCLPMECSQ; SCLPMECSQT; CLPMECSQTM; LPMECSQTMT;
PMECSQTMTS; MECSQTMTSG; ECSQTMTSGR; CSQTMTSGRK; SQTMTSGRKV;
QTMTSGRKVH; TMTSGRKVHD; MTSGRKVHDS; TSGRKVHDSQ; SGRKVHDSQG;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

GRKVHDSQGN; RKVHDSQGNA; KVHDSQGNAA; VHDSQGNAAK; HDSQGNAAKP;
PQEGKCMTHR; QEGKCMTHRE; EGKCMTHREE; GKCMTHREEL; KCMTHREELL;
CMTHREELLT; MTHREELLTH; THREELLTHG; HREELLTHGM; REELLTHGMQ;
EELLTHGMQP; ELLTHGMQPN; LLTHGMQPNH; LTHGMQPNHD; THGMQPNHDL;
HGMQPNHDLR; GMQPNHDLRK; MQPNHDLRKE; QPNHDLRKES; PNHDLRKESA;
QTCFASLGIL; TCFASLGILA; CFASLGILAL; FASLGILALS; ASLGILALSP;
SLGILALSPV; LGILALSPVK; GILALSPVKL; ILALSPVKLD; LALSPVKLDK;
ALSPVKLDKG; LSPVKLDKGH; SPVKLDKGHG; PVKLDKGHGS; VKLDKGHGSA;
KLDKGHGSAP; LDKGHGSAPA; DKGHGSAPAV; KGHGSAPAVT; GHGSAPAVTT;
HGSAPAVTTS; GSAPAVTTSF; SAPAVTTSFS; APAVTTSFSE; PAVTTSFSES;
AVTTSFSESW; NLDWNKKKSS; LDWNKKKSSE; DWNKKKSSED; WNKKKSSEDF;
NKKKSSEDFY; KKKSSEDFYF; KKSSEDFYFY; KSSEDFYFYF; SSEDFYFYFR;
SEDFYFYFRA; EDFYFYFRAF; DFYFYFRAFA; FYFYFRAFAG; YFYFRAFAGI;
FYFRAFAGIL; RQCRREKQKY; QCRREKQKYH; CRREKQKYHC; RREKQKYHCF;
REKQKYHCFT; EKQKYHCFTC; KQKYHCFTCC; QKYHCFTCCK; KYHCFTCCKR;
YHCFTCCKRL; HCFTCCKRLC; CFTCCKRLCK; FTCCKRLCKR; TCCKRLCKRL;
CCKRLCKRLL; CKRLCKRLLG; KRLCKRLLGK; RLCKRLLGKS; LFFCISRFM;
FFCISRFMGA; FCISRFMGAA; CISRFMGAAL; ISRFMGAALA; SRFMGAALAL;
RFMGAALALL; FMGAALALLG; MGAALALLGD; GAALALLGDL; AALALLGDLV;
ALALLGDLVA; LALLGDLVAS; ALLGDLVASV; LLGDLVASVS; LGDLVASVSE;
GDLVASVSEA; DLVASVSEAA; LVASVSEAAA; VASVSEAAAA; ASVSEAAAAT;
SVSEAAAATG; VSEAAAATGF; SEAAAATGFS; EAAAATGFSV; AAAATGFSVA;
AAATGFSVAE; AATGFSVAEI; ATGFSVAEIA; TGFSVAEIAA; GFSVAEIAAG;
FSVAEIAAGE; SVAEIAAGEA; VAEIAAGEAA; AEIAAGEAAA; EIAAGEAAAA;
IAAGEAAAAI; AAGEAAAAIE; AGEAAAAIEV; GEAAAAIEVQ; EAAAAIEVQI;
AAAAIEVQIA; AAAIEVQIAS; AAIEVQIASL; AIEVQIASLA; IEVQIASLAT;
EVQIASLATV; VQIASLATVE; QIASLATVEG; IASLATVEGI; ASLATVEGIT;
SLATVEGITS; LATVEGITST; ATVEGITSTS; TVEGITSTSE; VEGITSTSEA;
EGITSTSEAI; GITSTSEAIA; ITSTSEAIAA; TSTSEAIAAI; STSEAIAAIG;
TSEAIAAIGL; SEAIAAIGLT; EAIAAIGLTP; AIAAIGLTPQ; IAAIGLTPQT;
AAIGLTPQTY; AIGLTPQTYA; IGLTPQTYAV; GLTPQTYAVI; LTPQTYAVIA;
TPQTYAVIAG; PQTYAVIAGA; QTYAVIAGAP; TYAVIAGAPG; YAVIAGAPGA;
AVIAGAPGAI; VIAGAPGAIA; IAGAPGAIAG; AGAPGAIAGF; GAPGAIAGFA;
APGAIAGFAA; PGAIAGFAAL; GAIAGFAALI; AIAGFAALIQ; IAGFAALIQT;
AGFAALIQTV; GFAALIQTVS; FAALIQTVSG; AALIQTVSGI; ALIQTVSGIS;
LIQTVSGISS; IQTVSGISSL; QTVSGISSLA; TVSGISSLAQ; VSGISSLAQV;
SGISSLAQVG; GISSLAQVGY; ISSLAQVGYK; SSLAQVGYKF; SLAQVGYKFF;
LAQVGYKFFD; AQVGYKFFDD; QVGYKFFDDW; VGYKFFDDWD; GYKFFDDWDH;
YKFFDDWDHK; KFFDDWDHKV; FFDDWDHKVS; FDDWDHKVST; DDWDHKVSTV;
DWDHKVSTVG; WDHKVSTVGL; DHKVSTVGLY; HKVSTVGLYQ; KVSTVGLYQQ;
VSTVGLYQQS; STVGLYQQSG; TVGLYQQSGM; VGLYQQSGMA; GLYQQSGMAL;
LYQQSGMALE; YQQSGMALEL; QQSGMALELF; QSGMALELFN; SGMALELFNP;
GMALELFNPD; MALELFNPDE; ALELFNPDEY; LELFNPDEYY; ELFNPDEYYD;
LFNPDEYYDI; FNPDEYYDIL; NPDEYYDILF; PDEYYDILFP; DEYYDILFPG;
EYYDILFPGV; YYDILFPGVN; YDILFPGVNT; DILFPGVNTF; ILFPGVNTFV;
LFPGVNTFVN; FPGVNTFVNN; PGVNTFVNNI; GVNTFVNNIQ; VNTFVNNIQY;
NTFVNNIQYL; TFVNNIQYLD; FVNNIQYLDP; VNNIQYLDPR; NNIQYLDPRH;
NIQYLDPRHW; IQYLDPRHWG; QYLDPRHWGP; YLDPRHWGPS; LDPRHWGPSL;
DPRHWGPSLF; PRHWGPSLFA; RHWGPSLFAT; HWGPSLFATI; WGPSLFATIS;
GPSLFATISQ; PSLFATISQA; SLFATISQAL; LFATISQALW; FATISQALWH;
ATISQALWHV; TISQALWHVI; ISQALWHVIR; SQALWHVIRD; QALWHVIRDD;
ALWHVIRDDI; LWHVIRDDIP; WHVIRDDIPS; HVIRDDIPSI; VIRDDIPSIT;
IRDDIPSITS; RDDIPSITSQ; DDIPSITSQE; DIPSITSQEL; IPSITSQELQ;
PSITSQELQR; SITSQELQRR; ITSQELQRRT; TSQELQRRTE; SQELQRRTEF;
QELQRRTERF; ELQRRTERFF; LQRRTERFFR; QRRTERFFRD; RRTERFFRDS;
RTERFFRDSL; TERFFRDSLA; ERFFRDSLAR; RFFRDSLARF; FFRDSLARFL;
FRDSLARFLE; RDSLARFLEE; DSLARFLEET; SLARFLEETT; LARFLEETTW;
ARFLEETTWT; RFLEETTWTI; FLEETTWTIV; LEETTWTIVN; EETTWTIVNA;
ETTWTIVNAP; TTWTIVNAPI; TWTIVNAPIN; WTIVNAPINF; TIVNAPINFY;
IVNAPINFYN; VNAPINFYNY; NAPINFYNYI; APINFYNYIQ; PINFYNYIQQ;
INFYNYIQQY; NFYNYIQQYY; FYNYIQQYYS; YNYIQQYYSD; NYIQQYYSDL;
YIQQYYSDLS; IQQYYSDLSP; QQYYSDLSPI; QYYSDLSPIR; YYSDLSPIRP;
YSDLSPIRPS; SDLSPIRPSM; DLSPIRPSMV; LSPIRPSMVR; SPIRPSMVRQ;
PIRPSMVRQV; IRPSMVRQVA; RPSMVRQVAE; PSMVRQVAER; SMVRQVAERE;
MVRQVAEREG; VRQVAEREGT; RQVAEREGTR; QVAEREGTRV; VAEREGTRVH;
AEREGTRVHF; EREGTRVHFG; REGTRVHFGH; EGTRVHFGHT; GTRVHFGHTY;
TRVHFGHTYS; RVHFGHTYSI; VHFGHTYSID; HFGHTYSIDD; FGHTYSIDDA;
GHTYSIDDAD; HTYSIDDADS; TYSIDDADSI; YSIDDADSIE; SIDDADSIEE;
IDDADSIEEV; DDADSIEEVT; DADSIEEVTQ; ADSIEEVTQR; DSIEEVTQRM;
SIEEVTQRMD; IEEVTQRMDL; EEVTQRMDLR; EVTQRMDLRN; VTQRMDLRNQ;
TQRMDLRNQQ; QRMDLRNQQS; RMDLRNQQSV; MDLRNQQSVH; DLRNQQSVHS;
LRNQQSVHSG; RNQQSVHSGE; NQQSVHSGEF; QQSVHSGEFI; QSVHSGEFIE;
SVHSGEFIEK; VHSGEFIEKT; HSGEFIEKTI; SGEFIEKTIA; GEFIEKTIAP;
EFIEKTIAPG; FIEKTIAPGG; IEKTIAPGGA; EKTIAPGGAN; KTIAPGGANQ;
TIAPGGANQR; IAPGGANQRT; APGGANQRTA; PGGANQRTAP; GGANQRTAPQ;
GANQRTAPQW; ANQRTAPQWM; NQRTAPQWML; QRTAPQWMLP; RTAPQWMLPL;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

TAPQWMLPLL; APQWMLPLLL; PQWMLPLLLG; QWMLPLLLGL; WMLPLLLGLY;
MLPLLLGLYG; LPLLLGLYGT; PLLLGLYGTV; LLLGLYGTVT; LLGLYGTVTP;
LGLYGTVTPA; GLYGTVTPAL; LYGTVTPALE; YGTVTPALEA; GTVTPALEAY;
TVTPALEAYE; VTPALEAYED; TPALEAYEDG; PALEAYEDGP; ALEAYEDGPN;
LEAYEDGPNQ; EAYEDGPNQK; AYEDGPNQKK; YEDGPNQKKR; EDGPNQKKRR;
DGPNQKKRRV; GPNQKKRRVS; PNQKKRRVSR; NQKKRRVSRG; QKKRRVSRGS;
KKRRVSRGSS; KRRVSRGSSQ; RRVSRGSSQK; RVSRGSSQKA; VSRGSSQKAK;
SRGSSQKAKG; RGSSQKAKGT; GSSQKAKGTR; SSQKAKGTRA; SQKAKGTRAS;
QKAKGTRASA; KAKGTRASAK; AKGTRASAKT; KGTRASAKTT; GTRASAKTTN;
TRASAKTTNK; RASAKTTNKR; ASAKTTNKRR; SAKTTNKRRS; AKTTNKRRSR;
KTTNKRRSRS; TTNKRRSRSS; TNKRRSRSSR; NKRRSRSSRS; NWGRCYYRGR;
WGRCYYRGRM; GRCYYRGRML; RCYYRGRMLP; CYYRGRMLPK; YYRGRMLPKP;
YRGRMLPKPR; RGRMLPKPRN; GRMLPKPRNG; RMLPKPRNGG; MLPKPRNGGS;
LPKPRNGGSR; PREKNASLLQ; REKNASLLQH; EKNASLLQHS; KNASLLQHSK;
NASLLQHSKN; ASLLQHSKNS; SLLQHSKNSP; LLQHSKNSPP; LQHSKNSPPQ;
QHSKNSPPQF; HSKNSPPQFK; GPNLWKSTDV; PNLWKSTDVG; NLWKSTDVGG;
LWKSTDVGGC; WKSTDVGGCN; KSTDVGGCNC; STDVGGCNCT; TDVGGCNCTN;
DVGGCNCTNR; VGGCNCTNRG; GGCNCTNRGY; GCNCTNRGYW; CNCTNRGYWN;
NCTNRGYWNN; AWWRKTYSRQ; FPLLCCRWRT; PLLCCRWRTL; LLCCRWRTLG;
LCCRWRTLGN; CCRWRTLGNA; CRWRTLGNAG; RWRTLGNAGS; WRTLGNAGSA;
RTLGNAGSAN; TLGNAGSANE; LGNAGSANEL; GNAGSANELQ; NAGSANELQV;
AGSANELQVK; GSANELQVKV; SANELQVKVP; KPNSPVPGNE; PNSPVPGNEY;
GLFGQKQCLS; LFGQKQCLSS; VFWDFHRRGK; FWDFHRRGKC; WDFHRRGKCS;
DFHRRGKCSP; FHRRGKCSPS; HRRGKCSPST; RRGKCSPSTS; RGKCSPSTSC;
GKCSPSTSCD; KCSPSTSCDQ; CSPSTSCDQH; SPSTSCDQHS; PSTSCDQHSY;
STSCDQHSYH; TSCDQHSYHS; SCDQHSYHSV; CDQHSYHSVA; DQHSYHSVAR;
QLWNTTVERP; LWNTTVERPC; WNTTVERPCK; NTTVERPCKI; TTVERPCKIF;
DPPEKKICKE; PPEKKICKES; PEKKICKESL; EKKICKESLP; KKICKESLPN;
KICKESLPNF; ICKESLPNFL; CKESLPNFLF; KESLPNFLFA; ESLPNFLFAK;
PYKQENPESG; YKQENPESGW; KQENPESGWA; QENPESGWAA; ENPESGWAAY;
NPESGWAAYV; PESGWAAYVW; ESGWAAYVWY; SGWAAYVWYG; GWAAYVWYGI;
WAAYVWYGIP; AAYVWYGIPG; AYVWYGIPGR; YVWYGIPGRR; VWYGIPGRRG;
WHRKTSRGPR; HRKTSRGPRY; RKTSRGPRYD; KTSRGPRYDK; TSRGPRYDKI;
SRGPRYDKIY; QTGTIANQNA; TGTIANQNAL; GTIANQNALN; TIANQNALNR;
IANQNALNRC; ANQNALNRCF; NQNALNRCFY; QNALNRCFYC; NALNRCFYCT;
ALNRCFYCTY; LNRCFYCTYT; NRCFYCTYTF; RCFYCTYTFN; CFYCTYTFNK;
FYCTYTFNKC; YCTYTFNKCC; CTYTFNKCCF; TYTFNKCCFC; YTFNKCCFCI;
TFNKCCFCIS; FNKCCFCISH; NKCCFCISHF; KCCFCISHFT; CCFCISHFTE;
ESLYTNATLD; SLYTNATLDY; LYTNATLDYG; YTNATLDYGG; TNATLDYGGL;
NATLDYGGLT; ATLDYGGLTF; TLDYGGLTFG; LDYGGLTFGN; DYGGLTFGNL;
YGGLTFGNLQ; GGLTFGNLQQ; GLTFGNLQQG; LTFGNLQQGL; TFGNLQQGLK;
FGNLQQGLKY; GNLQQGLKYL; NLQQGLKYLR; LQQGLKYLRL; QQGLKYLRLG;
QGLKYLRLGK; GLKYLRLGKS; LKYLRLGKSI; KYLRLGKSIV; YLRLGKSIVI;
LRLGKSIVIG; RLGKSIVIGI; LGKSIVIGIQ; GKSIVIGIQC; KSIVIGIQCL;
SIVIGIQCLI; IVIGIQCLIH; VIGIQCLIHV; IGIQCLIHVQ; GIQCLIHVQS;
IQCLIHVQSL; QCLIHVQSLQ; CLIHVQSLQF; LIHVQSLQFL; IHVQSLQFLN;
HVQSLQFLNP; VQSLQFLNPL; QSLQFLNPLL; SLQFLNPLLL; YQEYISPCIY;
QEYISPCIYY; EYISPCIYYI; YISPCIYYIS; ISPCIYYISS; SPCIYYISSL;
PCIYYISSLK; CIYYISSLKK; IYYISSLKKY; YYISSLKKYT; YISSLKKYTY;
ISSLKKYTYL; SSLKKYTYLS; SLKKYTYLSQ; LKKYTYLSQN; KKYTYLSQNP;
KYTYLSQNPA; YTYLSQNPAF; TYLSQNPAFP; YLSQNPAFPS; LSQNPAFPSI;
SQNPAFPSIQ; QNPAFPSIQQ; NPAFPSIQQF; IVYQLQNQLQ; VYQLQNQLQA;
TKLAVATRSF; KLAVATRSFH; LAVATRSFHF; AVATRSFHFV; VATRSFHFVK;
ATRSFHFVKF; TRSFHFVKFF; RSFHFVKFFF; SFHFVKFFFQ; FHFVKFFFQV;
HFVKFFFQVR; FVKFFFQVRT; VKFFFQVRTL; KFFFQVRTLS; FFFQVRTLSF;
FFQVRTLSFV; FQVRTLSFVR; QVRTLSFVRI; VRTLSFVRIF; RTLSFVRIFL;
TLSFVRIFLN; LSFVRIFLNI; SFVRIFLNIF; FVRIFLNIFW; VRIFLNIFWA;
PSLVEIFGFF; SLVEIFGFFC; LVEIFGFFCL; VEIFGFFCLN; EIFGFFCLNV;
IFGFFCLNVS; FGFFCLNVSF; GFFCLNVSFL; FFCLNVSFLN; FCLNVSFLNL;
CLNVSFLNLP; HFHLNNLSNC; FHLNNLSNCL; HLNNLSNCLN; LNNLSNCLNC;
NNLSNCLNCL; NLSNCLNCLF; LSNCLNCLFH; SNCLNCLFHV; NCLNCLFHVL;
CLNCLFHVLK; LNCLFHVLKA; NCLFHVLKAN; CLFHVLKANP; LFHVLKANPL;
FHVLKANPLI; HVLKANPLIQ; VLKANPLIQL; LKANPLIQLL; KANPLIQLLS;
ANPLIQLLSL; NPLIQLLSLL; PLIQLLSLLH; LIQLLSLLHL; IQLLSLLHLQ;
QLLSLLHLQK; LLSLLHLQKQ; LSLLHLQKQP; SLLHLQKQPC; LLHLQKQPCT;
LHLQKQPCTD; HLQKQPCTDL; LHLAQRLAFP; HLAQRLAFPW; LAQRLAFPWV;
AQRLAFPWVG; QRLAFPWVGL; RLAFPWVGLH; LAFPWVGLHL; AFPWVGLHLR;
FPWVGLHLRL; PWVGLHLRLY; WVGLHLRLYH; VGLHLRLYHH; GLHLRLYHHT;
LHLRLYHHTN; HLRLYHHTNL; LRLYHHTNLI; RLYHHTNLIT; LYHHTNLITL;
YHHTNLITLQ; HHTNLITLQL; HTNLITLQLV; TNLITLQLVL; NLITLQLVLF;
LITLQLVLFF; ITLQLVLFFH; TLQLVLFFHY; LQLVLFFHYQ; QLVLFFHYQW;
LVLFFHYQWD; VLFFHYQWDL; KQYSAKNQIL; QYSAKNQILQ; YSAKNQILQN;
SAKNQILQNP; AKNQILQNPF; VANSAAKQHL; ANSAAKQHLP; NSAAKQHLPY;
SAAKQHLPYI; AAKQHLPYIV; AKQHLPYIVL; KQHLPYIVLV; QHLPYIVLVQ;
HLPYIVLVQH; LPYIVLVQHF; PYIVLVQHFH; YIVLVQHFHE; IVLVQHFHEL;
VLVQHFHELQ; LVQHFHELQI; VQHFHELQIL; QHFHELQILN; HFHELQILNP;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

FHELQILNPF; HELQILNPFY; ELQILNPFYL; LQILNPFYLI; QILNPFYLIY;
ILNPFYLIYD; IFLLAFLPWS; FLLAFLPWSY; LLAFLPWSYE; LAFLPWSYEG;
AFLPWSYEGY; FLPWSYEGYL; LPWSYEGYLL; PWSYEGYLLF; WSYEGYLLFF;
LKLYLLLADK; KLYLLLADKY; LYLLLADKYF; YLLLADKYFF; LLLADKYFFD;
LLADKYFFDF; LADKYFFDFY; ADKYFFDFYF; DKYFFDFYFL; KYFFDFYFLQ;
YFFDFYFLQK; SDKAGLFSDT; DKAGLFSDTF; KAGLFSDTFY; AGLFSDTFYT;
GLFSDTFYTP; LFSDTFYTPL; FSDTFYTPLH; SDTFYTPLHC; DTFYTPLHCI;
TFYTPLHCIE; FYTPLHCIEI; YTPLHCIEIL; TPLHCIEILN; PLHCIEILNT;
LHCIEILNTY; HCIEILNTYL; CIEILNTYLI; IEILNTYLII; EILNTYLIIK;
ILNTYLIIKT; LNTYLIIKTH; NTYLIIKTHP; TYLIIKTHPH; YLIIKTHPHT;
LIIKTHPHTL; IIKTHPHTLS; IKTHPHTLSL; KTHPHTLSLL; THPHTLSLLH;
HPHTLSLLHT; PHTLSLLHTQ; LISKTPALFL; ISKTPALFLQ; SKTPALFLQA;
KTPALFLQAL; TPALFLQALL; PALFLQALLG; NHAPLSPLEC; HAPLSPLECF;
APLSPLECFL; PLSPLECFLL; LRHYIVSIPY; LQKLYVYVEL; QKLYVYVELK;
KLYVYVELKR; LYVYVELKRI; VFYTEFELFL; YTQQSRQGFY; TQQSRQGFYY;
ETGVDQRESL; GLLPFFFFWV; LLPFFFFWVV; LPFFFFWVVL; PFFFFWVVLS;
FFFFWVVLSV; FFFWVVLSVE; FFWVVLSVEN; FWVVLSVENL; WVVLSVENLL;
VVLSVENLLL; VLSVENLLLL; LSVENLLLLL; SVENLLLLLH; VENLLLLLHH;
ENLLLLLHHW; NLLLLLHHWQ; LLLLLHHWQT; LLLLHHWQTY; LLLHHWQTYL;
LLHHWQTYLH; LHHWQTYLHG; HHWQTYLHGK; HWQTYLHGKI; WQTYLHGKIN;
QTYLHGKINL; TYLHGKINLH; YLHGKINLHP; LHGKINLHPI; HGKINLHPIF;
GKINLHPIFH; RNSTRTPTLL; NSTRTPTLLF; STRTPTLLFH; TRTPTLLFHR;
RTPTLLFHRL; TPTLLFHRLA; PTLLFHRLAP; TLLFHRLAPI; LLFHRLAPIK;
LFHRLAPIKK; FHRLAPIKKI; HRLAPIKKII; RLAPIKKIIT; GLLIFYYLSK;
LLIFYYLSKY; LIFYYLSKYK; IFYYLSKYKL; FYYLSKYKLV; YYLSKYKLVT;
YLSKYKLVTL; LSKYKLVTLK; SKYKLVTLKL; ISEGSFSNYL; SEGSFSNYLD;
EGSFSNYLDP; GSFSNYLDPP; SFSNYLDPPL; FSNYLDPPLQ; SNYLDPPLQS;
NYLDPPLQSF; YLDPPLQSFF; LDPPLQSFFS; AKPLCEAVNA; KPLCEAVNAV;
PLCEAVNAVA; LCEAVNAVAI; CEAVNAVAIY; EAVNAVAIYP; AVNAVAIYPN;
VNAVAIYPNQ; NAVAIYPNQG; AVAIYPNQGL; VAIYPNQGLF; AIYPNQGLFS;
HARAVHRRLF; ARAVHRRLFG; RAVHRRLFGT; AVHRRLFGTN; VHRRLFGTNR;
HRRLFGTNRP; RRLFGTNRPF; RLFGTNRPFL; LFGTNRPFLA; FGTNRPFLAV;
GTNRPFLAVQ; TNRPFLAVQG; NRPFLAVQGI; RPFLAVQGIW; PFLAVQGIWA;
FLAVQGIWAK; LAVQGIWAKR; AVQGIWAKRK; VQGIWAKRKI; QGIWAKRKIS;
GIWAKRKIST; IWAKRKISTN; WAKRKISTNL; ATPGSKIRLM; TPGSKIRLMS;
PGSKIRLMSY; GSKIRLMSYL; SKIRLMSYLY; KIRLMSYLYI; IRLMSYLYIL;
RLMSYLYILL; LMSYLYILLH; MSYLYILLHF; SYLYILLHFF; YLYILLHFFI;
LYILLHFFIQ; YILLHFFIQS; ILLHFFIQSI; LLHFFIQSIH; LHFFIQSIHS;
HFFIQSIHSL; FFIQSIHSLH; FIQSIHSLHF; IQSIHSLHFI; QSIHSLHFIL;
SIHSLHFILV; IHSLHFILVA; HSLHFILVAP; SLHFILVAPF; LHFILVAPFV;
HFILVAPFVR; FILVAPFVRV; ILVAPFVRVK; LVAPFVRVKF; VAPFVRVKFL;
APFVRVKFLT; PFVRVKFLTL; FVRVKFLTLP; GKISPGSSFK; KISPGSSFKA;
KVHELHGFFP; VHELHGFFPV; HELHGFFPVK; ELHGFFPVKN; LHGFFPVKNF;
HGFFPVKNFI; GFFPVKNFIH 11 mers:

LQKLQKNRDFP; QKLQKNRDFPK; ASEKASTPLLL; SEKASTPLLLE; EKASTPLLLER;
KASTPLLLERK; ASTPLLLERKG; STPLLLERKGG; TPLLLERKGGG; PLLLERKGGGR;
LLLERKGGGRG; LLERKGGGRGG; LERKGGGRGGL; ERKGGGRGGLG; RKGGGRGGLGL;
KGGGRGGLGLL; GGGRGGLGLLY; GGRGGLGLLYI; GRGGLGLLYII; RGGLGLLYIIK;
GGLGLLYIIKK; GLGLLYIIKKK; LGLLYIIKKKA; GLLYIIKKKAT; LLYIIKKKATG;
LYIIKKKATGR; YIIKKKATGRS; IIKKKATGRSC; IKKKATGRSCL; KKKATGRSCLP;
KKATGRSCLPM; KATGRSCLPME; ATGRSCLPMEC; TGRSCLPMECS; GRSCLPMECSQ;
RSCLPMECSQT; SCLPMECSQTM; CLPMECSQTMT; LPMECSQTMTS; PMECSQTMTSG;
MECSQTMTSGR; ECSQTMTSGRK; CSQTMTSGRKV; SQTMTSGRKVH; QTMTSGRKVHD;
TMTSGRKVHDS; MTSGRKVHDSQ; TSGRKVHDSQG; SGRKVHDSQGN; GRKVHDSQGNA;
RKVHDSQGNAA; KVHDSQGNAAK; VHDSQGNAAKP; PQEGKCMTHRE; QEGKCMTHREE;
EGKCMTHREEL; GKCMTHREELL; KCMTHREELLT; CMTHREELLTH; MTHREELLTHG;
THREELLTHGM; HREELLTHGMQ; REELLTHGMQP; EELLTHGMQPN; ELLTHGMQPNH;
LLTHGMQPNHD; LTHGMQPNHDL; THGMQPNHDLR; HGMQPNHDLRK; GMQPNHDLRKE;
MQPNHDLRKES; QPNHDLRKESA; QTCFASLGILA; TCFASLGILAL; CFASLGILALS;
FASLGILALSP; ASLGILALSPV; SLGILALSPVK; LGILALSPVKL; GILALSPVKLD;
ILALSPVKLDK; LALSPVKLDKG; ALSPVKLDKGH; LSPVKLDKGHG; SPVKLDKGHGS;
PVKLDKGHGSA; VKLDKGHGSAP; KLDKGHGSAPA; LDKGHGSAPAV; DKGHGSAPAVT;
KGHGSAPAVTT; GHGSAPAVTTS; HGSAPAVTTSF; GSAPAVTTSFS; SAPAVTTSFSE;
APAVTTSFSES; PAVTTSFSESW; NLDWNKKKSSE; LDWNKKKSSED; DWNKKKSSEDF;
WNKKKSSEDFY; NKKKSSEDFYF; KKKSSEDFYFY; KKSSEDFYFYF; KSSEDFYFYFR;
SSEDFYFYFRA; SEDFYFYFRAF; EDFYFYFRAFA; DFYFYFRAFAG; FYFYFRAFAGI;
YFYFRAFAGIL; RQCRREKQKYH; QCRREKQKYHC; CRREKQKYHCF; RREKQKYHCFT;
REKQKYHCFTC; EKQKYHCFTCC; KQKYHCFTCCK; QKYHCFTCCKR; KYHCFTCCKRL;
YHCFTCCKRLC; HCFTCCKRLCK; CFTCCKRLCKR; FTCCKRLCKRL; TCCKRLCKRLL;
CCKRLCKRLLG; CKRLCKRLLGK; SLFFCISRFMG; LFFCISRFMGA; FFCISRFMGAA;
FCISRFMGAAL; CISRFMGAALA; ISRFMGAALAL; SRFMGAALALL; RFMGAALALLG;
FMGAALALLGD; MGAALALLGDL; GAALALLGDLV; AALALLGDLVA; ALALLGDLVAS;
LALLGDLVASV; ALLGDLVASVS; LLGDLVASVSE; LGDLVASVSEA; GDLVASVSEAA;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

DLVASVSEAAA; LVASVSEAAAA; VASVSEAAAAT; ASVSEAAAATG; SVSEAAAATGF;
VSEAAAATGFS; SEAAAATGFSV; EAAAATGFSVA; AAAATGFSVAE; AAATGFSVAEI;
AATGFSVAEIA; ATGFSVAEIAA; TGFSVAEIAAG; GFSVAEIAAGE; FSVAEIAAGEA;
SVAEIAAGEAA; VAEIAAGEAAA; AEIAAGEAAAA; EIAAGEAAAAI; IAAGEAAAAIE;
AAGEAAAAIEV; AGEAAAAIEVQ; GEAAAAIEVQI; EAAAAIEVQIA; AAAAIEVQIAS;
AAAIEVQIASL; AAIEVQIASLA; AIEVQIASLAT; IEVQIASLATV; EVQIASLATVE;
VQIASLATVEG; QIASLATVEGI; IASLATVEGIT; ASLATVEGITS; SLATVEGITST;
LATVEGITSTS; ATVEGITSTSE; TVEGITSTSEA; VEGITSTSEAI; EGITSTSEAIA;
GITSTSEAIAA; ITSTSEAIAAI; TSTSEAIAAIG; STSEAIAAIGL; TSEAIAAIGLT;
SEAIAAIGLTP; EAIAAIGLTPQ; AIAAIGLTPQT; IAAIGLTPQTY; AAIGLTPQTYA;
AIGLTPQTYAV; IGLTPQTYAVI; GLTPQTYAVIA; LTPQTYAVIAG; TPQTYAVIAGA;
PQTYAVIAGAP; QTYAVIAGAPG; TYAVIAGAPGA; YAVIAGAPGAI; AVIAGAPGAIA;
VIAGAPGAIAG; IAGAPGAIAGF; AGAPGAIAGFA; GAPGAIAGFAA; APGAIAGFAAL;
PGAIAGFAALI; GAIAGFAALIQ; AIAGFAALIQT; IAGFAALIQTV; AGFAALIQTVS;
GFAALIQTVSG; FAALIQTVSGI; AALIQTVSGIS; ALIQTVSGISS; LIQTVSGISSL;
IQTVSGISSLA; QTVSGISSLAQ; TVSGISSLAQV; VSGISSLAQVG; SGISSLAQVGY;
GISSLAQVGYK; ISSLAQVGYKF; SSLAQVGYKFF; SLAQVGYKFFD; LAQVGYKFFDD;
AQVGYKFFDDW; QVGYKFFDDWD; VGYKFFDDWDH; GYKFFDDWDHK; YKFFDDWDHKV;
KFFDDWDHKVS; FFDDWDHKVST; FDDWDHKVSTV; DDWDHKVSTVG; DWDHKVSTVGL;
WDHKVSTVGLY; DHKVSTVGLYQ; HKVSTVGLYQQ; KVSTVGLYQQS; VSTVGLYQQSG;
STVGLYQQSGM; TVGLYQQSGMA; VGLYQQSGMAL; GLYQQSGMALE; LYQQSGMALEL;
YQQSGMALELF; QQSGMALELFN; QSGMALELFNP; SGMALELFNPD; GMALELFNPDE;
MALELFNPDEY; ALELFNPDEYY; LELFNPDEYYD; ELFNPDEYYDI; LFNPDEYYDIL;
FNPDEYYDILF; NPDEYYDILFP; PDEYYDILFPG; DEYYDILFPGV; EYYDILFPGVN;
YYDILFPGVNT; YDILFPGVNTF; DILFPGVNTFV; ILFPGVNTFVN; LFPGVNTFVNN;
FPGVNTFVNNI; PGVNTFVNNIQ; GVNTFVNNIQY; VNTFVNNIQYL; NTFVNNIQYLD;
TFVNNIQYLDP; FVNNIQYLDPR; VNNIQYLDPRH; NNIQYLDPRHW; NIQYLDPRHWG;
IQYLDPRHWGP; QYLDPRHWGPS; YLDPRHWGPSL; LDPRHWGPSLF; DPRHWGPSLFA;
PRHWGPSLFAT; RHWGPSLFATI; HWGPSLFATIS; WGPSLFATISQ; GPSLFATISQA;
PSLFATISQAL; SLFATISQALW; LFATISQALWH; FATISQALWHV; ATISQALWHVI;
TISQALWHVIR; ISQALWHVIRD; SQALWHVIRDD; QALWHVIRDDI; ALWHVIRDDIP;
LWHVIRDDIPS; WHVIRDDIPSI; HVIRDDIPSIT; VIRDDIPSITS; IRDDIPSITSQ;
RDDIPSITSQE; DDIPSITSQEL; DIPSITSQELQ; IPSITSQELQR; PSITSQELQRR;
SITSQELQRRT; ITSQELQRRTE; TSQELQRRTER; SQELQRRTERF; QELQRRTERFF;
ELQRRTERFFR; LQRRTERFFRD; QRRTERFFRDS; RRTERFFRDSL; RTERFFRDSLA;
TERFFRDSLAR; ERFFRDSLARF; RFFRDSLARFL; FFRDSLARFLE; FRDSLARFLEE;
RDSLARFLEET; DSLARFLEETT; SLARFLEETTW; LARFLEETTWT; ARFLEETTWTI;
RFLEETTWTIV; FLEETTWTIVN; LEETTWTIVNA; EETTWTIVNAP; ETTWTIVNAPI;
TTWTIVNAPIN; TWTIVNAPINF; WTIVNAPINFY; TIVNAPINFYN; IVNAPINFYNY;
VNAPINFYNYI; NAPINFYNYIQ; APINFYNYIQQ; PINFYNYIQQY; INFYNYIQQYY;
NFYNYIQQYYS; FYNYIQQYYSD; YNYIQQYYSDL; NYIQQYYSDLS; YIQQYYSDLSP;
IQQYYSDLSPI; QQYYSDLSPIR; QYYSDLSPIRP; YYSDLSPIRPS; YSDLSPIRPSM;
SDLSPIRPSMV; DLSPIRPSMVR; LSPIRPSMVRQ; SPIRPSMVRQV; PIRPSMVRQVA;
IRPSMVRQVAE; RPSMVRQVAER; PSMVRQVAERE; SMVRQVAEREG; MVRQVAEREGT;
VRQVAEREGTR; RQVAEREGTRV; QVAEREGTRVH; VAEREGTRVHF; AEREGTRVHFG;
EREGTRVHFGH; REGTRVHFGHT; EGTRVHFGHTY; GTRVHFGHTYS; TRVHFGHTYSI;
RVHFGHTYSID; VHFGHTYSIDD; HFGHTYSIDDA; FGHTYSIDDAD; GHTYSIDDADS;
HTYSIDDADSI; TYSIDDADSIE; YSIDDADSIEE; SIDDADSIEEV; IDDADSIEEVT;
DDADSIEEVTQ; DADSIEEVTQR; ADSIEEVTQRM; DSIEEVTQRMD; SIEEVTQRMDL;
IEEVTQRMDLR; EEVTQRMDLRN; EVTQRMDLRNQ; VTQRMDLRNQQ; TQRMDLRNQQS;
QRMDLRNQQSV; RMDLRNQQSVH; MDLRNQQSVHS; DLRNQQSVHSG; LRNQQSVHSGE;
RNQQSVHSGEF; NQQSVHSGEFI; QQSVHSGEFIE; QSVHSGEFIEK; SVHSGEFIEKT;
VHSGEFIEKTI; HSGEFIEKTIA; SGEFIEKTIAP; GEFIEKTIAPG; EFIEKTIAPGG;
FIEKTIAPGGA; IEKTIAPGGAN; EKTIAPGGANQ; KTIAPGGANQR; TIAPGGANQRT;
IAPGGANQRTA; APGGANQRTAP; PGGANQRTAPQ; GGANQRTAPQW; GANQRTAPQWM;
ANQRTAPQWML; NQRTAPQWMLP; QRTAPQWMLPL; RTAPQWMLPLL; TAPQWMLPLLL;
APQWMLPLLLG; PQWMLPLLLGL; QWMLPLLLGLY; WMLPLLLGLYG; MLPLLLGLYGT;
LPLLLGLYGTV; PLLLGLYGTVT; LLLGLYGTVTP; LLGLYGTVTPA; LGLYGTVTPAL;
GLYGTVTPALE; LYGTVTPALEA; YGTVTPALEAY; GTVTPALEAYE; TVTPALEAYED;
VTPALEAYEDG; TPALEAYEDGP; PALEAYEDGPN; ALEAYEDGPNQ; LEAYEDGPNQK;
EAYEDGPNQKK; AYEDGPNQKKR; YEDGPNQKKRR; EDGPNQKKRRV; DGPNQKKRRVS;
GPNQKKRRVSR; PNQKKRRVSRG; NQKKRRVSRGS; QKKRRVSRGSS; KKRRVSRGSSQ;
KRRVSRGSSQK; RRVSRGSSQKA; RVSRGSSQKAK; VSRGSSQKAKG; SRGSSQKAKGT;
RGSSQKAKGTR; GSSQKAKGTRA; SSQKAKGTRAS; SQKAKGTRASA; QKAKGTRASAK;
KAKGTRASAKT; AKGTRASAKTT; KGTRASAKTTN; GTRASAKTTNK; TRASAKTTNKR;
RASAKTTNKRR; ASAKTTNKRRS; SAKTTNKRRSR; AKTTNKRRSRS; KTTNKRRSRSS;
TTNKRRSRSSR; TNKRRSRSSRS; NWGRCYYRGRM; WGRCYYRGRML; GRCYYRGRMLP;
RCYYRGRMLPK; CYYRGRMLPKP; YYRGRMLPKPR; YRGRMLPKPRN; RGRMLPKPRNG;
GRMLPKPRNGG; RMLPKPRNGGS; MLPKPRNGGSR; PREKNASLLQH; REKNASLLQHS;
EKNASLLQHSK; KNASLLQHSKN; NASLLQHSKNS; ASLLQHSKNSP; SLLQHSKNSPP;
LLQHSKNSPPQ; LQHSKNSPPQF; QHSKNSPPQFK; GPNLWKSTDVG; PNLWKSTDVGG;
NLWKSTDVGGC; LWKSTDVGGCN; WKSTDVGGCNC; KSTDVGGCNCT; STDVGGCNCTN;
TDVGGCNCTNR; DVGGCNCTNRG; VGGCNCTNRGY; GGCNCTNRGYW; GCNCTNRGYWN;
CNCTNRGYWNN; FPLLCCRWRTL; PLLCCRWRTLG; LLCCRWRTLGN; LCCRWRTLGNA;
CCRWRTLGNAG; CRWRTLGNAGS; RWRTLGNAGSA; WRTLGNAGSAN; RTLGNAGSANE;
TLGNAGSANEL; LGNAGSANELQ; GNAGSANELQV; NAGSANELQVK; AGSANELQVKV;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

GSANELQVKVP; KPNSPVPGNEY; GLFGQKQCLSS; VFWDFHRRGKC; FWDFHRRGKCS;
WDFHRRGKCSP; DFHRRGKCSPS; FHRRGKCSPST; HRRGKCSPSTS; RRGKCSPSTSC;
RGKCSPSTSCD; GKCSPSTSCDQ; KCSPSTSCDQH; CSPSTSCDQHS; SPSTSCDQHSY;
PSTSCDQHSYH; STSCDQHSYHS; TSCDQHSYHSV; SCDQHSYHSVA; CDQHSYHSVAR;
QLWNTTVERPC; LWNTTVERPCK; WNTTVERPCKI; NTTVERPCKIF; DPPEKKICKES;
PPEKKICKESL; PEKKICKESLP; EKKICKESLPN; KKICKESLPNF; KICKESLPNFL;
ICKESLPNFLF; CKESLPNFLFA; KESLPNFLFAK; PYKQENPESGW; YKQENPESGWA;
KQENPESGWAA; QENPESGWAAY; ENPESGWAAYV; NPESGWAAYVW; PESGWAAYVWY;
ESGWAAYVWYG; SGWAAYVWYGI; GWAAYVWYGIP; WAAYVWYGIPG; AAYVWYGIPGR;
AYVWYGIPGRR; YVWYGIPGRRG; WHRKTSRGPRY; HRKTSRGPRYD; RKTSRGPRYDK;
KTSRGPRYDKI; TSRGPRYDKIY; QTGTIANQNAL; TGTIANQNALN; GTIANQNALNR;
TIANQNALNRC; IANQNALNRCF; ANQNALNRCFY; NQNALNRCFYC; QNALNRCFYCT;
NALNRCFYCTY; ALNRCFYCTYT; LNRCFYCTYTF; NRCFYCTYTFN; RCFYCTYTFNK;
CFYCTYTFNKC; FYCTYTFNKCC; YCTYTFNKCCF; CTYTFNKCCFC; TYTFNKCCFCI;
YTFNKCCFCIS; TFNKCCFCISH; FNKCCFCISHF; NTESLYTNATL; TESLYTNATLD;
ESLYTNATLDY; SLYTNATLDYG; LYTNATLDYGG; YTNATLDYGGL; TNATLDYGGLT;
NATLDYGGLTF; ATLDYGGLTFG; TLDYGGLTFGN; LDYGGLTFGNL; DYGGLTFGNLQ;
YGGLTFGNLQQ; GGLTFGNLQQG; GLTFGNLQQGL; LTFGNLQQGLK; TFGNLQQGLKY;
FGNLQQGLKYL; GNLQQGLKYLR; NLQQGLKYLRL; LQQGLKYLRLG; QQGLKYLRLGK;
QGLKYLRLGKS; GLKYLRLGKSI; LKYLRLGKSIV; KYLRLGKSIVI; YLRLGKSIVIG;
LRLGKSIVIGI; RLGKSIVIGIQ; LGKSIVIGIQC; GKSIVIGIQCL; KSIVIGIQCLI;
SIVIGIQCLIH; IVIGIQCLIHV; VIGIQCLIHVQ; IGIQCLIHVQS; GIQCLIHVQSL;
IQCLIHVQSLQ; QCLIHVQSLQF; CLIHVQSLQFL; LIHVQSLQFLN; IHVQSLQFLNP;
HVQSLQFLNPL; VQSLQFLNPLL; QSLQFLNPLLL; YQEYISPCIYY; QEYISPCIYYI;
EYISPCIYYIS; YISPCIYYISS; ISPCIYYISSL; SPCIYYISSLK; PCIYYISSLKK;
CIYYISSLKKY; IYYISSLKKYT; YYISSLKKYTY; YISSLKKYTYL; ISSLKKYTYLS;
SSLKKYTYLSQ; SLKKYTYLSQN; LKKYTYLSQNP; KKYTYLSQNPA; KYTYLSQNPAF;
YTYLSQNPAFP; TYLSQNPAFPS; YLSQNPAFPSI; LSQNPAFPSIQ; SQNPAFPSIQQ;
QNPAFPSIQQF; IVYQLQNQLQA; TKLAVATRSFH; KLAVATRSFHF; LAVATRSFHFV;
AVATRSFHFVK; VATRSFHFVKF; ATRSFHFVKFF; TRSFHFVKFFF; RSFHFVKFFFQ;
SFHFVKFFFQV; FHFVKFFFQVR; HFVKFFFQVRT; FVKFFFQVRTL; VKFFFQVRTLS;
KFFFQVRTLSF; FFFQVRTLSFV; FFQVRTLSFVR; FQVRTLSFVRI; QVRTLSFVRIF;
VRTLSFVRIFL; RTLSFVRIFLN; TLSFVRIFLNI; LSFVRIFLNIF; SFVRIFLNIFW;
FVRIFLNIFWA; PSLVEIFGFFC; SLVEIFGFFCL; LVEIFGFFCLN; VEIFGFFCLNV;
EIFGFFCLNVS; IFGFFCLNVSF; FGFFCLNVSFL; GFFCLNVSFLN; FFCLNVSFLNL;
FCLNVSFLNLP; HFHLNNLSNCL; PHLNNLSNCLN; HLNNLSNCLNC; LNNLSNCLNCL;
NNLSNCLNCLF; NLSNCLNCLFH; LSNCLNCLFHV; SNCLNCLFHVL; NCLNCLFHVLK;
CLNCLFHVLKA; LNCLFHVLKAN; NCLFHVLKANP; CLFHVLKANPL; LFHVLKANPLI;
FHVLKANPLIQ; HVLKANPLIQL; VLKANPLIQLL; LKANPLIQLLS; KANPLIQLLSL;
ANPLIQLLSLL; NPLIQLLSLLH; PLIQLLSLLHL; LIQLLSLLHLQ; IQLLSLLHLQK;
QLLSLLHLQKQ; LLSLLHLQKQP; LSLLHLQKQPC; SLLHLQKQPCT; LLHLQKQPCTD;
LHLQKQPCTDL; HLAQRLAFPW; HLAQRLAFPWV; LAQRLAFPWVG; AQRLAFPWVGL;
QRLAFPWVGLH; RLAFPWVGLHL; LAFPWVGLHLR; AFPWVGLHLRL; FPWVGLHLRLY;
PWVGLHLRLYH; WVGLHLRLYHH; VGLHLRLYHHT; GLHLRLYHHTN; LHLRLYHHTNL;
HLRLYHHTNLI; LRLYHHTNLIT; RLYHHTNLITL; LYHHTNLITLQ; YHHTNLITLQL;
HHTNLITLQLV; HTNLITLQLVL; TNLITLQLVLF; NLITLQLVLFF; LITLQLVLFFH;
ITLQLVLFFHY; TLQLVLFFHYQ; LQLVLFFHYQW; QLVLFFHYQWD; LVLFFHYQWDL;
KQYSAKNQILQ; QYSAKNQILQN; YSAKNQILQNP; SAKNQILQNPF; VANSAAKQHLP;
ANSAAKQHLPY; NSAAKQHLPYI; SAAKQHLPYIV; AAKQHLPYIVL; AKQHLPYIVLV;
KQHLPYIVLVQ; QHLPYIVLVQH; HLPYIVLVQHF; LPYIVLVQHFE; PYIVLVQHFEL;
YIVLVQHFHEL; IVLVQHFHELQ; VLVQHFHELQI; LVQHFHELQIL; VQHFHELQILN;
QHFHELQILNP; HFHELQILNPF; FHELQILNPFY; HELQILNPFYL; ELQILNPFYLI;
LQILNPFYLIY; QILNPFYLIYD; IFLLAFLPWSY; FLLAFLPWSYE; LLAFLPWSYEG;
LAFLPWSYEGY; AFLPWSYEGYL; FLPWSYEGYLL; LPWSYEGYLLF; PWSYEGYLLFF;
LKLYLLLADKY; KLYLLLADKYF; LYLLLADKYFF; YLLLADKYFFD; LLLADKYFFDF;
LLADKYFFDFY; LADKYFFDFYF; ADKYFFDFYFL; DKYFFDFYFLQ; KYFFDFYFLQK;
SDKAGLFSDTF; DKAGLFSDTFY; KAGLFSDTFYT; AGLFSDTFYTP; GLFSDTFYTPL;
LFSDTFYTPLH; FSDTFYTPLHC; SDTFYTPLHCI; DTFYTPLHCIE; TFYTPLHCIEI;
FYTPLHCIEIL; YTPLHCIEILN; TPLHCIEILNT; PLHCIEILNTY; LHCIEILNTYL;
HCIEILNTYLI; CIEILNTYLII; IEILNTYLIIK; EILNTYLIIKT; ILNTYLIIKTH;
LNTYLIIKTHP; NTYLIIKTHPH; TYLIIKTHPHT; YLIIKTHPHTL; LIIKTHPHTLS;
IIKTHPHTLSL; IKTHPHTLSLL; KTHPHTLSLLH; THPHTLSLLHT; HPHTLSLLHTQ;
LISKTPALFLQ; ISKTPALFLQA; SKTPALFLQAL; KTPALFLQALL; TPALFLQALLG;
NHAPLSPLECF; HAPLSPLECFL; APLSPLECFLL; LQKLYVYVELK; QKLYVYVELKR;
KLYVYVELKRI; YTQQSRQGFYY; GLLPFFFFWVV; LLPFFFFWVVL; LPFFFFWVVLS;
PFFFFWVVLSV; FFFFWVVLSVE; FFFWVVLSVEN; FFWVVLSVENL; FWVVLSVENLL;
WVVLSVENLLL; VVLSVENLLLL; VLSVENLLLLL; LSVENLLLLLH; SVENLLLLLHH;
VENLLLLLHHW; ENLLLLLHHWQ; NLLLLLHHWQT; LLLLLHHWQTY; LLLLHHWQTYL;
LLLHHWQTYLH; LLHHWQTYLHG; LHHWQTYLHGK; HHWQTYLHGKI; HWQTYLHGKIN;
WQTYLHGKINL; QTYLHGKINLH; TYLHGKINLHP; YLHGKINLHPI; LHGKINLHPIF;
HGKINLHPIFH; RNSTRTPTLLF; NSTRTPTLLFH; STRTPTLLFHR; TRTPTLLFHRL;
RTPTLLFHRLA; TPTLLFHRLAP; PTLLFHRLAPI; TLLFHRLAPIK; LLFHRLAPIKK;
LFHRLAPIKKI; FHRLAPIKKII; HRLAPIKKIIT; GLLIFYYLSKY; LLIFYYLSKYK;
LIFYYLSKYKL; IFYYLSKYKLV; FYYLSKYKLVT; YYLSKYKLVTL; YLSKYKLVTLK;
LSKYKLVTLKL; ISEGSFSNYLD; SEGSFSNYLDP; EGSFSNYLDPP; GSFSNYLDPPL;
SFSNYLDPPLQ; FSNYLDPPLQS; SNYLDPPLQSF; NYLDPPLQSFF; YLDPPLQSFFS;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

AKPLCEAVNAV; KPLCEAVNAVA; PLCEAVNAVAI; LCEAVNAVAIY; CEAVNAVAIYP;
EAVNAVAIYPN; AVNAVAIYPNQ; VNAVAIYPNQG; NAVAIYPNQGL; AVAIYPNQGLF;
VAIYPNQGLFS; HARAVHRRLFG; ARAVHRRLFGT; RAVHRRLFGTN; AVHRRLFGTNR;
VHRRLFGTNRP; HRRLFGTNRPF; RRLFGTNRPFL; RLFGTNRPFLA; LFGTNRPFLAV;
FGTNRPFLAVQ; GTNRPFLAVQG; TNRPFLAVQGI; NRPFLAVQGIW; RPFLAVQGIWA;
PFLAVQGIWAK; FLAVQGIWAKR; LAVQGIWAKRK; AVQGIWAKRKI; VQGIWAKRKIS;
QGIWAKRKIST; GIWAKRKISTN; IWAKRKISTNL; ATPGSKIRLMS; TPGSKIRLMSY;
PGSKIRLMSYL; GSKIRLMSYLY; SKIRLMSYLYI; KIRLMSYLYIL; IRLMSYLYILL;
RLMSYLYILLH; LMSYLYILLHF; MSYLYILLHFF; SYLYILLHFFI; YLYILLHFFIQ;
LYILLHFFIQS; YILLHFFIQSI; ILLHFFIQSIH; LLHFFIQSIHS; LHFFIQSIHSL;
HFFIQSIHSLH; FFIQSIHSLHF; FIQSIHSLHFI; IQSIHSLHFIL; QSIHSLHFILV;
SIHSLHFILVA; IHSLHFILVAP; HSLHFILVAPF; SLHFILVAPFV; LHFILVAPFVR;
HFILVAPFVRV; FILVAPFVRVK; ILVAPFVRVKF; LVAPFVRVKFL; VAPFVRVKFLT;
APFVRVKFLTL; PFVRVKFLTLP; GKISPGSSFKA; KVHELHGFFPV; VHELHGFFPVK;
HELHGFFPVKN; ELHGFFPVKNF; LHGFFPVKNFI; HGFFPVKNFIH

BK virus complementary reading frame 1

8 mers:

MDKVLNRE; DKVLNREE; KVLNREES; VLNREESM; LNREESME; NREESMEL; REESMELM;
EESMELMD; ESMELMDL; SMELMDLL; MELMDLLG; ELMDLLGL; LMDLLGLE; MDLLGLER;
DLLGLERA; LLGLERAA; LGLERAAW; GLERAAWG; LERAAWGN; ERAAWGNL; RAAWGNLP;
AAWGNLPL; AWGNLPLM; WGNLPLMR; GNLPLMRK; NLPLMRKA; LPLMRKAY; PLMRKAYL;
LMRKAYLR; MRKAYLRK; RKAYLRKC; KAYLRKCK; AYLRKCKE; YLRKCKEF; LRKCKEFH;
RKCKEFHP; KCKEFHPD; CKEFHPDK; KEFHPDKG; EFHPDKGG; FHPDKGGD; HPDKGGDE;
PDKGGDED; DKGGDEDK; KGGDEDKM; GGDEDKMK; GDEDKMKR; DEDKMKRM; EDKMKRMN;
DKMKRMNT; KMKRMNTL; MKRMNTLY; KRMNTLYK; RMNTLYKK; MNTLYKKM; NTLYKKME;
TLYKKMEQ; LYKKMEQD; YKKMEQDV; KKMEQDVK; KMEQDVKV; MEQDVKVA; EQDVKVAH;
QDVKVAHQ; DVKVAHQP; VKVAHQPD; KVAHQPDF; VAHQPDFG; AHQPDFGT; HQPDFGTW;
QPDFGTWS; PDFGTWSS; DFGTWSSS; FGTWSSSE; GTWSSSEV; TWSSSEVC; WSSSEVCA;
SSSEVCAD; SSEVCADF; SEVCADFP; EVCADFPL; VCADFPLC; CADFPLCP; ADFPLCPD;
DFPLCPDT; FPLCPDTL; PLCPDTLY; LCPDTLYC; CPDTLYCK; PDTLYCKE; DTLYCKEW;
TLYCKEWP; LYCKEWPI; YCKEWPIC; CKEWPICS; KEWPICSK; EWPICSKK; WPICSKKP;
PICSKKPS; ICSKKPSV; CSKKPSVH; SKKPSVHC; KKPSVHCP; KPSVHCPC; PSVHCPCM;
SVHCPCML; VHCPCMLC; HCPCMLCQ; CPCMLCQL; PCMLCQLR; CMLCQLRL; MLCQLRLR;
LCQLRLRH; CQLRLRHL; QLRLRHLN; LRLRHLNR; RLRHLNRK; LRHLNRKF; RHLNRKFL;
HLNRKFLR; LNRKFLRK; NRKFLRKE; RKFLRKEP; KFLRKEPL; FLRKEPLV; LRKEPLVW;
RKEPLVWI; KEPLVWID; EPLVWIDC; PLVWIDCY; LVWIDCYC; VWIDCYCI; WIDCYCID;
IDCYCIDC; DCYCIDCF; CYCIDCFT; YCIDCFTQ; CIDCFTQW; IDCFTQWF; DCFTQWFG;
CFTQWFGL; FTQWFGLD; TQWFGLDL; QWFGLDLT; WFGLDLTE; FGLDLTEE; GLDLTEET;
LDLTEETL; DLTEETLQ; LTEETLQW; TEETLQWW; EETLQWWV; ETLQWWVQ; TLQWWVQI;
LQWWVQII; QWWVQIIG; WWVQIIGE; WVQIIGET; VQIIGETP; QIIGETPF; IIGETPFR;
IGETPFRD; GETPFRDL; ETPFRDLK; TPFRDLKL; KALSNYFF; ALSNYFFY; LSNYFFYR;
SNYFFYRC; NYFFYRCQ; YFFYRCQP; FFYRCQPM; FYRCQPME; YRCQPMEQ; RCQPMEQK;
CQPMEQKS; QPMEQKSG; PMEQKSGS; MEQKSGSP; EQKSGSPG; QKSGSPGG; KSGSPGGV;
SGSPGGVP; GSPGGVPL; SPGGVPLM; PGGVPLMK; GGVPLMKN; GVPLMKNG; VPLMKNGM;
PLMKNGMK; LMKNGMKI; MKNGMKIY; KNGMKIYF; NGMKIYFA; GMKIYFAM; MKIYFAMK;
KIYFAMKI; IYFAMKIC; YFAMKICL; FAMKICLP; AMKICLPV; MKICLPVM; KICLPVMK;
ICLPVMKK; CLPVMKKQ; LPVMKKQQ; PVMKKQQQ; VMKKQQQI; MKKQQQIL; KKQQQILN;
KQQQILNT; QQQILNTQ; QQILNTQH; QILNTQHH; ILNTQHHP; LNTQHHPK; NTQHHPKK;
TQHHPKKK; QHHPKKKE; HHPKKKER; KTLKTFPL; TLKTFPLI; LKTFPLIY; KTFPLIYT;
TFPLIYTS; FPLIYTSF; PLIYTSFL; LIYTSFLV; IYTSFLVK; YTSFLVKL; TSFLVKLY;
SFLVKLYL; FLVKLYLV; LVKLYLVI; VKLYLVIE; KLYLVIEP; LYLVIEPL; YLVIEPLP;
LVIEPLPA; VIEPLPAL; IEPLPALL; EPLPALLC; PLPALLCI; LPALLCIL; PALLCILL;
ALLCILLK; LLCILLKK; LCILLKKK; CILLKKKL; ILLKKKLK; LLKKKLKF; LKKKLKFC;
KKKLKFCI; KKLKFCIK; KLKFCIKN; LKFCIKNL; KFCIKNLW; FCIKNLWK; CIKNLWKN;
IKNLWKNI; KNLWKNIL; LLLVDTCV; LLVDTCVL; LVDTCVLG; VDTCVLGI; DTCVLGII;
TCVLGIIL; CVLGIILY; VLGIILYS; LGIILYSF; LHIDIEFL; HIDIEFLQ; IDIEFLQL;
DIEFLQLI; IEFLQLII; EFLQLIIS; FLQLIISV; LQLIISVK; QLIISVKS; LIISVKSC;
IISVKSCV; ISVKSCVP; SVKSCVPL; VKSCVPLV; KSCVPLVF; FVRVLIRN; VRVLIRNT;
RVLIRNTY; VLIRNTYY; LIRNTYYI; IRNTYYIV; RNTYYIVP; RSMILAQK; SMILAQKS;
MILAQKSL; ILAQKSLK; LAQKSLKK; AQKSLKKQ; QKSLKKQS; KSLKKQSR; SLKKQSRC;
LKKQSRCL; KKQSRCLG; KQSRCLGN; RQSVRMCF; QSVRMCFY; SVRMCFYY; RSVKSVRK;
SVKSVRKK; VKSVRKKT; KSVRKKTS; SVRKKTSL; VRKKTSLI; RKKTSLIT; KKTSLITL;
KTSLITLS; TSLITLSI; SLITLSIM; LITLSIMK; ITLSIMKS; TLSIMKST; LSIMKSTL;
SIMKSTLQ; IMKSTLQM; MKSTLQML; KSTLQMLL; STLQMLLF; TLQMLLFL; LQMLLFLQ;
QMLLFLQK; MLLFLQKV; LLFLQKVK; LFLQKVKI; FLQKVKIK; LQKVKIKK; QKVKIKKV;
KVKIKKVF; VKIKKVFV; KIKKVFVS; IKKVFVSK; KKVFVSKQ; YLELMEML; LELMEMLY;
NNIWQVLL; NIWQVLLG; IWQVLLGC; WQVLLGCT; QVLLGCTV; VLLGCTVC; LLGCTVCY;
LGCTVCYL; GCTVCYLK; CTVCYLKW; TVCYLKWI; VCYLKWIL; YLIFCTVL; LIFCTVLF;
IFCTVLFS; FCTVLFSM; CTVLFSMY; TVLFSMYL; VLFSMYLK; LFSMYLKE; FSMYLKED;
SMYLKEDT; MYLKEDTG; YLKEDTGY; LKEDTGYL; KEDTGYLK; EDTGYLKV; DTGYLKVP;
TGYLKVPL; GYLKVPLI; YLKVPLIV; LKVPLIVE; KVPLIVEK; VPLIVEKQ; PLIVEKQH;
ISTWLFLK; STWLFLKM; KGQELNQR; GQELNQRI; QELNQRIC; ELNQRICL; LNQRICLQ;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

NQRICLQD; QRICLQDM; RICLQDME; TKEPKYFH; KEPKYFHQ; EPKYFHQA; PKYFHQAW;
KYFHQAWL; YFHQAWLQ; MSILSLKP; SILSLKPC; ILSLKPCK; LSLKPCKL; SLKPCKLD;
LKPCKLDL; ENPYKTQS; NPYKTQSS; PYKTQSSY; YKTQSSYL; KTQSSYLK; TQSSYLKK;
QSSYLKKE; SSYLKKEF; SYLKKEFY; YLKKEFYK; LKKEFYKV; KKEFYKVE; LILQLIYN;
ILQLIYNL; LQLIYNLE; QLIYNLEL; LIYNLELL; IYNLELLN; YNLELLNG; NLELLNGR;
LELLNGRK; ELLNGRKG; LLNGRKGW; LNGRKGWI; NGRKGWIL; GRKGWILR; NIIYAWGN;
IIYAWGNV; IYAWGNVF; YAWGNVFL; AWGNVFLI; WGNVFLIL; GNVFLILQ; NVFLILQE;
VFLILQEK; FLILQEKR; LILQEKRI; ILQEKRIQ; LQEKRIQK; QEKRIQKL; EKRIQKLK;
KRIQKLKT; RIQKLKTL; IQKLKTLD; QKLKTLDM; KLKTLDMD; LKTLDMDQ; KTLDMDQA;
TLDMDQAL; LDMDQALN; DMDQALNP; MDQALNPN; DQALNPNH; QALNPNHN; ALNPNHNA;
LNPNHNAL; NPNHNALP; PNHNALPK; NHNALPKS; HNALPKSQ; NALPKSQI; ALPKSQIL;
LPKSQILQ; PKSQILQP; KSQILQPL; SQILQPLL; QILQPLLK; ILQPLLKI; LQPLLKIP;
QPLLKIPK; PLLKIPKG; LLKIPKGQ; LKIPKGQT; KIPKGQTP; IPKGQTPI; PKGQTPIV;
KGQTPIVK; GQTPIVKS; QTPIVKSC; TPIVKSCI; PIVKSCIC; IVKSCICV; VKSCICVK;
KSCICVKA; SCICVKAF; CICVKAFS; ICVKAFSV; CVKAFSVL; VKAFSVLK; KAFSVLKG;
AFSVLKGL; FSVLKGLK; SVLKGLKH; VLKGLKHH; LKGLKHHP; KGLKHHPQ; GLKHHPQN;
LKHHPQNN; KHHPQNNT; HHPQNNTS; HPQNNTSL; PQNNTSLK; QNNTSLKV; NNTSLKVA;
NTSLKVAY; TSLKVAYT; SLKVAYTK; LKVAYTKA; KVAYTKAA; VAYTKAAF; AYTKAAFI;
YTKAAFIK; TKAAFIKC; KAAFIKCI; AAFIKCIC; AFIKCICT; FIKCICTI; IKCICTIK;
KCICTIKA; CICTIKAP; ICTIKAPV; SILVCNCP; ILVCNCPC; LVCNCPCL; VCNCPCLS;
CNCPCLSI; NCPCLSIY; CPCLSIYL; PCLSIYLI; CLSIYLII; LSIYLIIS; SIYLIISG;
IYLIISGS; YLIISGSP; LIISGSPG; IISGSPGS; ISGSPGSL; SGSPGSLS; GSPGSLSV;
SPGSLSVP; PGSLSVPS; GSLSVPSN; SLSVPSNT; LSVPSNTL; SVPSNTLT; VPSNTLTS;
PSNTLTSS; SNTLTSST; NTLTSSTW; TLTSSTWD; LTSSTWDS; TSSTWDSI; SSTWDSIP;
STWDSIPY; TWDSIPYI; WDSIPYIG; DSIPYIGC; SIPYIGCP; IPYIGCPS; PYIGCPST;
YIGCPSTL; IGCPSTLW; GCPSTLWV; CPSTLWVL; PSTLWVLL; STLWVLLF; TLWVLLFI;
LWVLLFIR; WVLLFIRS; VLLFIRSL; LLFIRSLS; LFIRSLSK; FIRSLSKK; IRSLSKKE;
RSLSKKEI; SLSKKEIG; GFFTDLFL; FFTDLFLR; FTDLFLRR; TDLFLRRI; DLFLRRIL;
LFLRRILK; FLRRILKY; LRRILKYL; RRILKYLA; RILKYLAR; ILKYLARP; LKYLARPL;
KYLARPLH; YLARPLHC; LARPLHCC; ARPLHCCV; RPLHCCVP; PLHCCVPE; LHCCVPEL;
HCCVPELL; CCVPELLV; CVPELLVN; VPELLVNR; PELLVNRP; ELLVNRPQ; LLVNRPQI;
LVNRPQIS; VNRPQISA; NRPQISAA; RPQISAAE; PQISAAET; QISAAETY; ISAAETYR;
SAAETYRL; AAETYRLS; AETYRLSA; ETYRLSAL; TYRLSALQ; YRLSALQR; RLSALQRG;
LSALQRGP; SALQRGPT; ALQRGPTP; LQRGPTPC; QRGPTPCS; RGPTPCSS; GPTPCSSS;
PTPCSSSN; TPCSSSNT; PCSSSNTV; CSSSNTVV; SSSNTVVA; SSNTVVAV; SNTVVAVL;
NTVVAVLV; TVVAVLVT; STGGTFSP; TGGTFSPP; GGTFSPPV; GTFSPPVK; TFSPPVKV;
FSPPVKVP; SPPVKVPK; PPVKVPKY; PVKVPKYL; VKVPKYLA; KVPKYLAF; VPKYLAFS;
PKYLAFSF; KYLAFSFL; YLAFSFLL; LAFSFLLG; AFSFLLGS; FSFLLGSG; SFLLGSGT;
FLLGSGTQ; LLGSGTQH; LGSGTQHS; GSGTQHST; SGTQHSTG; ALWSVFIT; LWSVFITW;
WSVFITWD; SVFITWDW; VFITWDWA; FITWDWAV; ITWDWAVG; TWDWAVGF; WDWAVGFL;
DWAVGFLG; WAVGFLGV; AVGFLGVI; VGFLGVIV; GFLGVIVP; FLGVIVPS; LGVIVPSG;
GVIVPSGY; VIVPSGYF; IVPSGYFD; VPSGYFDL; FISTPCIS; ISTPCISK; STPCISKG;
TPCISKGS; PCISKGSP; CISKGSPP; ISKGSPPT; SKGSPPTA; KGSPPTAK; GSPPTAKK;
SPPTAKKW; PPTAKKWK; PTAKKWKL; TAKKWKLL; AKKWKLLP; IGFPPPCS; GFPPPCSC;
FPPPCSCT; PPPCSCTF; PPCSCTFC; PCSCTFCD; CSCTFCDP; SCTFCDPA; RLSMLVIP;
LSMLVIPI; SMLVIPIT; MLVIPITS; LVIPITSV; VIPITSVC; IPITSVCT; PITSVCTV;
ITSVCTVT; TSVCTVTA; SVCTVTAS; VCTVTASH; CTVTASHI; TVTASHIS; VTASHISR;
TASHISRF; ASHISRFP; SHISRFPQ; HISRFPQV; ISRFPQVR; SRFPQVRS; RFPQVRSS;
FPQVRSSF; PQVRSSFK; QVRSSFKL; VRSSFKLG; RSSFKLGR; SSFKLGRG; SFKLGRGI;
FKLGRGIL; KLGRGILA; LGRGILAV; GRGILAVL; QGSIFLSG; GSIFLSGL; SIFLSGLS;
IFLSGLSL; FLSGLSLL; LSGLSLLK; SGLSLLKS; GLSLLKSF; LSLLKSFS; SLLKSFSA;
LLKSFSAL; LKSFSALS; KSFSALSF; SFSALSFR; FSALSFRL; SALSFRLK; ALSFRLKP;
LSFRLKPL; SFRLKPLR; FRLKPLRF; RLKPLRFS; LKPLRFSS; KPLRFSSG; PLRFSSGS;
LRFSSGSP; RFSSGSPI; FSSGSPIS; SSGSPISG; SGSPISGF; GSPISGFR; SPISGFRK;
PISGFRKH; ISGFRKHS; SGFRKHST; GFRKHSTS; FRKHSTSV; RKHSTSVI; KHSTSVIA;
HSTSVIAS; STSVIAST; TSVIASTP; SVIASTPV; VIASTPVL; IASTPVLT; ASTPVLTS;
STPVLTSR; TPVLTSRT; PVLTSRTS; VLTSRTST; LTSRTSTP; TSRTSTPP; SRTSTPPF;
RTSTPPFI; TSTPPFIS; STPPFISS; TPPFISSF; PPFISSFG; PFISSFGT; FISSFGTC;
ISSFGTCT; SSFGTCTG; SFGTCTGS; FGTCTGSF; GTCTGSFG; TCTGSFGF; CTGSFGFL;
TGSFGFLG; GSFGFLGA; SFGFLGAA; FGFLGAAP; GFLGAAPG; FLGAAPGH; LGAAPGHS;
GAAPGHSP; AAPGHSPF; APGHSPFL; PGHSPFLL; GHSPFLLV; HSPFLLVG; SPFLLVGA;
PFLLVGAI; FLLVGAIF; LLVGAIFI; LVGAIFIC; VGAIFICF; GAIFICFK; AIFICFKS;
IFICFKSR; FICFKSRC; ICFKSRCY; CFKSRCYS; FKSRCYSP; KSRCYSPV; SRCYSPVQ;
RCYSPVQA; RQHPLRSS; QHPLRSSS; HPLRSSSL; PLRSSSLI; LRSSSLIS; RSSSLIST;
SSSLISTS; SSLISTSW; SLISTSWG; LISTSWGN; ISTSWGNS; STSWGNSF; TSWGNSFF;
SWGNSFFY; WGNSFFYK; GNSFFYKL; NSFFYKLS; VHSLCNFF; HSLCNFFY; SLCNFFYT;
LCNFFYTV; CNFFYTVS; NFFYTVSI; FFYTVSII; FYTVSIIY; YTVSIIYT; TVSIIYTI;
VSIIYTIS; SIIYTISM; IIYTISMA; IYTISMAK; YTISMAKM; TISMAKMY; ISMAKMYT;
SMAKMYTG; MAKMYTGT; AKMYTGTF; KMYTGTFP; MYTGTFPF; YTGTFPPS; TGTFPFSY;
GTFPFSYL; TFPFSYLS; FPFSYLSN; PFSYLSNH; GPNRGKIR; PNRGKIRI; NRGKIRII;
RGKIRIIL; GKIRIILL; KIRIILLN; IRIILLNI; RIILLNII; IILLNIII; ILLNIIIK;
LLNIIIKV; LNIIIKVY; NIIIKVYR; IIIKVYRG; IIKVYRGI; IKVYRGIY; KVYRGIYN;
VYRGIYNC; YRGIYNCP; RGIYNCPG; GIYNCPGS; IYNCPGSF; YNCPGSFL; NCPGSFLQ;
CPGSFLQK; PGSFLQKS; GSFLQKSS; SFLQKSSQ; FLQKSSQG; LQKSSQGV; QKSSQGVS;
KSSQGVSK; SSQGVSKK; SQGVSKKS; QGVSKKSF; GVSKKSFC; VSKKSFCS; SKKSFCSS;
KKSFCSSL; KSFCSSLQ; SFCSSLQF; FCSSLQFL; GYRRYIIP; YRRYIIPN; RRYIIPNN;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

RYIIPNNM; YIIPNNMP; IIPNNMPQ; IPNNMPQS; PNNMPQSL; NNMPQSLG; NMPQSLGN;
MPQSLGNS; PQSLGNSS; QSLGNSSK; SLGNSSKQ; LGNSSKQR; GNSSKQRR; NSSKQRRT;
SSKQRRTP; SKQRRTPM; KQRRTPMP; QRRTPMPR; RRTPMPRI; RTPMPRIK; TPMPRIKV;
PMPRIKVL; MPRIKVLN; PRIKVLNI; RIKVLNII; IKVLNIIN; KVLNIINK; VLNIINKS;
LNIINKSI; NIINKSIY; IINKSIYT; INKSIYTR; NKSIYTRK; KSIYTRKQ; SIYTRKQN;
IYTRKQNI; YTRKQNII; TRKQNIIV; RKQNIIVL; KQNIIVLI; QNIIVLIW; NIIVLIWV;
IIVLIWVK; IVLIWVKQ; VLIWVKQF; LIWVKQFQ; IWVKQFQS; WVKQFQSH; VKQFQSHA;
LLIEAYSG; LIEAYSGN; IEAYSGNF; EAYSGNFV; AYSGNFVI; YSGNFVIP; SGNFVIPI;
GNFVIPII; NFVIPIIK; FVIPIIKE; VIPIIKEL; IPIIKELI; PIIKELIP; IIKELIPY;
IKELIPYL; KELIPYLS; GTNTTNSL; TNTTNSLN; SSKPSNSP; SKPSNSPR; KPSNSPRS;
PSNSPRST; SNSPRSTS; NSPRSTSN; SPRSTSNY; PRSTSNYS; RSTSNYSI; STSNYSIC;
TSNYSICL; SNYSICLR; NYSICLRS; GTCYALYS; TCYALYSS; CYALYSSK; YALYSSKG;
ALYSSKGC; LYSSKGCN; YSSKGCNL; SSKGCNLN; SKGCNLNF; KGCNLNFY; GCNLNFYS;
CNLNFYSS; NLNFYSSS; LNFYSSSS; NFYSSSSL; FYSSSSLP; YSSSSLPS; SSSSLPSS;
SSSLPSSN; SSLPSSNF; SLPSSNFS; LPSSNFSH; KSCGSSSL; SCGSSSLR; CGSSSLRY;
GSSSLRYT; SSSLRYTG; SSLRYTGN; SSTHEPGN; STHEPGNT; THEPGNTK; HEPGNTKK;
EPGNTKKK; PGNTKKKG; GNTKKKGL; NTKKKGLL; TKKKGLLT; ESFTESFT; SFTESFTA;
FTESFTAG; TESFTAGK; ESFTAGKA; SFTAGKAV; FTAGKAVV; TAGKAVVL; AGKAVVLL;
GKAVVLLF; KAVVLLFF; AVVLLFFP; VVLLFFPS; VLLFFPST; LLFFPSTL; LFFPSTLS;
FFPSTLSS; FPSTLSSP; PSTLSSPL; STLSSPLQ; TLSSPLQN; LSSPLQNS; SSPLQNSS;
SPLQNSSK; PLQNSSKS; LQNSSKSS; QNSSKSSK; NSSKSSKI; SSKSSKIK; SKSSKIKI;
KSSKIKIK; SSKIKIKI; SKIKIKIL; ALFFVPVQ; LFFVPVQV; FFVPVQVL; FVPVQVLP;
VPVQVLPT; PVQVLPTF; VQVLPTFT; QVLPTFTE; VLPTFTEA; LPTFTEAC; PTFTEACR;
TFTEACRD; FTEACRDS; TEACRDSW; EACRDSWR; ACRDSWRR; CRDSWRRT; RDSWRRTM;
DSWRRTMA; SWRRTMAF; WRRTMAFV; RRTMAFVQ; RTMAFVQF; TMAFVQFN; MAFVQFNW;
AFVQFNWG; FVQFNWGQ; VQFNWGQG; QFNWGQGQ; FNWGQGQD; NWGQGQDS; ARKTCLSC;
RKTCLSCT; KTCLSCTF; TCLSCTFL; CLSCTFLP; LSCTFLPE; SCTFLPEV; CTFLPEVM;
TFLPEVMV; FLPEVMVW; LPEVMVWL; PEVMVWLH; EVMVWLHS; VMVWLHSM; MVWLHSMG;
VWLHSMGK; WLHSMGKQ; LHSMGKQL; HSMGKQLL; SMGKQLLP; MGKQLLPV; GKQLLPVS;
KQLLPVSH; QLLPVSHA; LLPVSHAL; LPVSHALS; PVSHALSF; VSHALSFL; SHALSFLR;
HALSFLRS; ALSFLRSW; LSFLRSWF; SFLRSWFG; FLRSWFGC; LRSWFGCI; RSWFGCIP;
SWFGCIPL; GHGLAAFH; HGLAAFHG; AAPPCGLF; APPCGLFF; PPCGLFFY; PCGLFFYN;
CGLFFYNI; EAEAASAS; AEAASAST; EAASASTL; AASASTLS; ASASTLSL; SASTLSLK;
GLAKLFGE; LAKLFGEI; AKLFGEIP; KLFGEIPI; LFGEIPIL; FGEIPILL; GEIPILLQ;
EIPILLQF; IPILLQFL; PILLQFLQ

---

9 mers:

MDKVLNREE; DKVLNREES; KVLNREESM; VLNREESME; LNREESMEL; NREESMELM;
REESMELMD; EESMELMDL; ESMELMDLL; SMELMDLLG; MELMDLLGL; ELMDLLGLE;
LMDLLGLER; MDLLGLERA; DLLGLERAA; LLGLERAAW; LGLERAAWG; GLERAAWGN;
LERAAWGNL; ERAAWGNLP; RAAWGNLPL; AAWGNLPLM; AWGNLPLMR; WGNLPLMRK;
GNLPLMRKA; NLPLMRKAY; LPLMRKAYL; PLMRKAYLR; LMRKAYLRK; MRKAYLRKC;
RKAYLRKCK; KAYLRKCKE; AYLRKCKEF; YLRKCKEFH; LRKCKEFHP; RKCKEFHPD;
KCKEFHPDK; CKEFHPDKG; KEFHPDKGG; EFHPDKGGD; FHPDKGGDE; HPDKGGDED;
PDKGGDEDK; DKGGDEDKM; KGGDEDKMK; GGDEDKMKR; GDEDKMKRM; DEDKMKRMN;
EDKMKRMNT; DKMKRMNTL; KMKRMNTLY; MKRMNTLYK; KRMNTLYKK; RMNTLYKKM;
MNTLYKKME; NTLYKKMEQ; TLYKKMEQD; LYKKMEQDV; YKKMEQDVK; KKMEQDVKV;
KMEQDVKVA; MEQDVKVAH; EQDVKVAHQ; QDVKVAHQP; DVKVAHQPD; VKVAHQPDF;
KVAHQPDFG; VAHQPDFGT; AHQPDFGTW; HQPDFGTWS; QPDFGTWSS; PDFGTWSSS;
DFGTWSSSE; FGTWSSSEV; GTWSSSEVC; TWSSSEVCA; WSSSEVCAD; SSSEVCADF;
SSEVCADFP; SEVCADFPL; EVCADFPLC; VCADFPLCP; CADFPLCPD; ADFPLCPDT;
DFPLCPDTL; FPLCPDTLY; PLCPDTLYC; LCPDTLYCK; CPDTLYCKE; PDTLYCKEW;
DTLYCKEWP; TLYCKEWPI; LYCKEWPIC; YCKEWPICS; CKEWPICSK; KEWPICSKK;
EWPICSKKP; WPICSKKPS; PICSKKPSV; ICSKKPSVH; CSKKPSVHC; SKKPSVHCP;
KKPSVHCPC; KPSVHCPCM; PSVHCPCML; SVHCPCMLC; VHCPCMLCQ; HCPCMLCQL;
CPCMLCQLR; PCMLCQLRL; CMLCQLRLR; MLCQLRLRH; LCQLRLRHL; CQLRLRHLN;
QLRLRHLNR; LRLRHLNRK; RLRHLNRKF; LRHLNRKFL; RHLNRKFLR; HLNRKFLRK;
LNRKFLRKE; NRKFLRKEP; RKFLRKEPL; KFLRKEPLV; FLRKEPLVW; LRKEPLVWI;
RKEPLVWID; KEPLVWIDC; EPLVWIDCY; PLVWIDCYC; LVWIDCYCI; VWIDCYCID;
WIDCYCIDC; IDCYCIDCF; DCYCIDCFT; CYCIDCFTQ; YCIDCFTQW; CIDCFTQWF;
IDCFTQWFG; DCFTQWFGL; CFTQWFGLD; FTQWFGLDL; TQWFGLDLT; QWFGLDLTE;
WFGLDLTEE; FGLDLTEET; GLDLTEETL; LDLTEETLQ; DLTEETLQW; LTEETLQWW;
TEETLQWWV; EETLQWWVQ; ETLQWWVQI; TLQWWVQII; LQWWVQIIG; QWWVQIIGE;
WWVQIIGET; WVQIIGETP; VQIIGETPF; QIIGETPFR; IIGETPFRD; IGETPFRDL;
GETPFRDLK; ETPFRDLKL; KALSNYFFY; ALSNYFFYR; LSNYFFYRC; SNYFFYRCQ;
NYFFYRCQP; YFFYRCQPM; FFYRCQPME; FYRCQPMEQ; YRCQPMEQK; RCQPMEQKS;
CQPMEQKSG; QPMEQKSGS; PMEQKSGSP; MEQKSGSPG; EQKSGSPGG; QKSGSPGGV;
KSGSPGGVP; SGSPGGVPL; GSPGGVPLM; SPGGVPLMK; PGGVPLMKN; GGVPLMKNG;
GVPLMKNGM; VPLMKNGMK; PLMKNGMKI; LMKNGMKIY; MKNGMKIYF; KNGMKIYFA;
NGMKIYFAM; GMKIYFAMK; MKIYFAMKI; KIYFAMKIC; IYFAMKICL; YFAMKICLP;
FAMKICLPV; AMKICLPVM; MKICLPVMK; KICLPVMKK; ICLPVMKKQ; CLPVMKKQQ;
LPVMKKQQQ; PVMKKQQQI; VMKKQQQIL; MKKQQQILN; KKQQQILNT; KQQQILNTQ;
QQQILNTQH; QQILNTQHH; QILNTQHHP; ILNTQHHPK; LNTQHHPKK; NTQHHPKKK;
TQHHPKKKE; QHHPKKKER; KTLKTFPLI; TLKTFPLIY; LKTFPLIYT; KTFPLIYTS;
TFPLIYTSF; FPLIYTSFL; PLIYTSFLV; LIYTSFLVK; IYTSFLVKL; YTSFLVKLY;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

TSFLVKLYL; SFLVKLYLV; FLVKLYLVI; LVKLYLVIE; VKLYLVIEP; KLYLVIEPL;
LYLVIEPLP; YLVIEPLPA; LVIEPLPAL; VIEPLPALL; IEPLPALLC; EPLPALLCI;
PLPALLCIL; LPALLCILL; PALLCILLK; ALLCILLKK; LLCILLKKK; LCILLKKKL;
CILLKKKLK; ILLKKKLKF; LLKKKLKFC; LKKKLKFCI; KKKLKFCIK; KKLKFCIKN;
KLKFCIKNL; LKFCIKNLW; KFCIKNLWK; FCIKNLWKN; CIKNLWKNI; IKNLWKNIL;
LLLVDTCVL; LLVDTCVLG; LVDTCVLGI; VDTCVLGII; DTCVLGIIL; TCVLGIILY;
CVLGIILYS; VLGIILYSF; LHIDIEFLQ; HIDIEFLQL; IDIEFLQLI; DIEFLQLII;
IEFLQLIIS; EFLQLIISV; FLQLIISVK; LQLIISVKS; QLIISVKSC; LIISVKSCV;
IISVKSCVP; ISVKSCVPL; SVKSCVPLV; VKSCVPLVF; FVRVLIRNT; VRVLIRNTY;
RVLIRNTYY; VLIRNTYYI; LIRNTYYIV; IRNTYYIVP; RSMILAQKS; SMILAQKSL;
MILAQKSLK; ILAQKSLKK; LAQKSLKKQ; AQKSLKKQS; QKSLKKQSR; KSLKKQSRC;
SLKKQSRCL; LKKQSRCLG; KKQSRCLGN; RQSVRMCFY; QSVRMCFYY; RSVKSVRKK;
SVKSVRKKT; VKSVRKKTS; KSVRKKTSL; SVRKKTSLI; VRKKTSLIT; RKKTSLITL;
KKTSLITLS; KTSLITLSI; TSLITLSIM; SLITLSIMK; LITLSIMKS; ITLSIMKST;
TLSIMKSTL; LSIMKSTLQ; SIMKSTLQM; IMKSTLQML; MKSTLQMLL; KSTLQMLLF;
STLQMLLFL; TLQMLLFLQ; LQMLLFLQK; QMLLFLQKV; MLLFLQKVK; LLFLQKVKI;
LFLQKVKIK; FLQKVKIKK; LQKVKIKKV; QKVKIKKVF; KVKIKKVFV; VKIKKVFVS;
KIKKVFVSK; IKKVFVSKQ; YLELMEMLY; NNIWQVLLG; NIWQVLLGC; IWQVLLGCT;
WQVLLGCTV; QVLLGCTVC; VLLGCTVCY; LLGCTVCYL; LGCTVCYLK; GCTVCYLKW;
CTVCYLKWI; TVCYLKWIL; YLIFCTVLF; LIFCTVLFS; IFCTVLFSM; FCTVLFSMY;
CTVLFSMYL; TVLFSMYLK; VLFSMYLKE; LFSMYLKED; FSMYLKEDT; SMYLKEDTG;
MYLKEDTGY; YLKEDTGYL; LKEDTGYLK; KEDTGYLKV; EDTGYLKVP; DTGYLKVPL;
TGYLKVPLI; GYLKVPLIV; YLKVPLIVE; LKVPLIVEK; KVPLIVEKQ; VPLIVEKQH;
ISTWLFLKM; KGQELNQRI; GQELNQRIC; QELNQRICL; ELNQRICLQ; LNQRICLQD;
NQRICLQDM; QRICLQDME; TKEPKYFHQ; KEPKYFHQA; EPKYFHQAW; PKYFHQAWL;
KYFHQAWLQ; MSILSLKPC; SILSLKPCK; ILSLKPCKL; LSLKPCKLD; SLKPCKLDL;
ENPYKTQSS; NPYKTQSSY; PYKTQSSYL; YKTQSSYLK; KTQSSYLKK; TQSSYLKKE;
QSSYLKKEF; SSYLKKEFY; SYLKKEFYK; YLKKEFYKV; LKKEFYKVE; LILQLIYNL;
ILQLIYNLE; LQLIYNLEL; QLIYNLELL; LIYNLELLN; IYNLELLNG; YNLELLNGR;
NLELLNGRK; LELLNGRKG; ELLNGRKGW; LLNGRKGWI; LNGRKGWIL; NGRKGWILR;
NIIYAWGNV; IIYAWGNVF; IYAWGNVFL; YAWGNVFLI; AWGNVFLIL; WGNVFLILQ;
GNVFLILQE; NVFLILQEK; VFLILQEKR; FLILQEKRI; LILQEKRIQ; ILQEKRIQK;
LQEKRIQKL; QEKRIQKLK; EKRIQKLKT; KRIQKLKTL; RIQKLKTLD; IQKLKTLDM;
QKLKTLDMD; KLKTLDMDQ; LKTLDMDQA; KTLDMDQAL; TLDMDQALN; LDMDQALNP;
DMDQALNPN; MDQALNPNH; DQALNPNHN; QALNPNHNA; ALNPNHNAL; LNPNHNALP;
NPNHNALPK; PNHNALPKS; NHNALPKSQ; HNALPKSQI; NALPKSQIL; ALPKSQILQ;
LPKSQILQP; PKSQILQPL; KSQILQPLL; SQILQPLLK; QILQPLLKI; ILQPLLKIP;
LQPLLKIPK; QPLLKIPKG; PLLKIPKGQ; LLKIPKGQT; LKIPKGQTP; KIPKGQTPI;
IPKGQTPIV; PKGQTPIVK; KGQTPIVKS; GQTPIVKSC; QTPIVKSCI; TPIVKSCIC;
PIVKSCICV; IVKSCICVK; VKSCICVKA; KSCICVKAF; SCICVKAFS; CICVKAFSV;
ICVKAFSVL; CVKAFSVLK; VKAFSVLKG; KAFSVLKGL; AFSVLKGLK; FSVLKGLKH;
SVLKGLKHH; VLKGLKHHP; LKGLKHHPQ; KGLKHHPQN; GLKHHPQNN; LKHHPQNNT;
KHHPQNNTS; HHPQNNTSL; HPQNNTSLK; PQNNTSLKV; QNNTSLKVA; NNTSLKVAY;
NTSLKVAYT; TSLKVAYTK; SLKVAYTKA; LKVAYTKAA; KVAYTKAAF; VAYTKAAFI;
AYTKAAFIK; YTKAAFIKC; TKAAFIKCI; KAAFIKCIC; AAFIKCICT; AFIKCICTI;
FIKCICTIK; IKCICTIKA; KCICTIKAP; CICTIKAPV; ICTIKAPVS; ILVCNCPCL;
LVCNCPCLS; VCNCPCLSI; CNCPCLSIY; NCPCLSIYL; CPCLSIYLI; PCLSIYLII;
CLSIYLIIS; LSIYLIISG; SIYLIISGS; IYLIISGSP; YLIISGSPG; LIISGSPGS;
IISGSPGSL; ISGSPGSLS; SGSPGSLSV; GSPGSLSVP; SPGSLSVPS; PGSLSVPSN;
GSLSVPSNT; SLSVPSNTL; LSVPSNTLT; SVPSNTLTS; VPSNTLTSS; PSNTLTSST;
SNTLTSSTW; NTLTSSTWD; TLTSSTWDS; LTSSTWDSI; TSSTWDSIP; SSTWDSIPY;
STWDSIPYI; TWDSIPYIG; WDSIPYIGC; DSIPYIGCP; SIPYIGCPS; IPYIGCPST;
PYIGCPSTL; YIGCPSTLW; IGCPSTLWV; GCPSTLWVL; CPSTLWVLL; PSTLWVLLF;
STLWVLLFI; TLWVLLFIR; LWVLLFIRS; WVLLFIRSL; VLLFIRSLS; LLFIRSLSK;
LFIRSLSKK; FIRSLSKKE; IRSLSKKEI; RSLSKKEIG; GFFTDLFLR; FFTDLFLRR;
FTDLFLRRI; TDLFLRRIL; DLFLRRILK; LFLRRILKY; FLRRILKYL; LRRILKYLA;
RRILKYLAR; RILKYLARP; ILKYLARPL; LKYLARPLH; KYLARPLHC; YLARPLHCC;
LARPLHCCV; ARPLHCCVP; RPLHCCVPE; PLHCCVPEL; LHCCVPELL; HCCVPELLV;
CCVPELLVN; CVPELLVNR; VPELLVNRP; PELLVNRPQ; ELLVNRPQI; LLVNRPQIS;
LVNRPQISA; VNRPQISAA; NRPQISAAE; RPQISAAET; PQISAAETY; QISAAETYR;
ISAAETYRL; SAAETYRLS; AAETYRLSA; AETYRLSAL; ETYRLSALQ; TYRLSALQR;
YRLSALQRG; RLSALQRGP; LSALQRGPT; SALQRGPTP; ALQRGPTPC; LQRGPTPCS;
QRGPTPCSS; RGPTPCSSS; GPTPCSSSN; PTPCSSSNT; TPCSSSNTV; PCSSSNTVV;
CSSSNTVVA; SSSNTVVAV; SSNTVVAVL; SNTVVAVLV; NTVVAVLVT; STGGTFSPP;
TGGTFSPPV; GGTFSPPVK; GTFSPPVKV; TFSPPVKVP; FSPPVKVPK; SPPVKVPKY;
PPVKVPKYL; PVKVPKYLA; VKVPKYLAF; KVPKYLAFS; VPKYLAFSF; PKYLAFSFL;
KYLAFSFLL; YLAFSFLLG; LAFSFLLGS; AFSFLLGSG; FSFLLGSGT; SFLLGSGTQ;
FLLGSGTQH; LLGSGTQHS; LGSGTQHST; GSGTQHSTG; ALWSVFITW; LWSVFITWD;
WSVFITWDW; SVFITWDWA; VFITWDWAV; FITWDWAVG; ITWDWAVGF; TWDWAVGFL;
WDWAVGFLG; DWAVGFLGV; WAVGFLGVI; AVGFLGVIV; VGFLGVIVP; GFLGVIVPS;
FLGVIVPSG; LGVIVPSGY; GVIVPSGYF; VIVPSGYFD; IVPSGYFDL; FISTPCISK;
ISTPCISKG; STPCISKGS; TPCISKGSP; PCISKGSPP; CISKGSPPT; ISKGSPPTA;
SKGSPPTAK; KGSPPTAKK; GSPPTAKKW; SPPTAKKWK; PPTAKKWKL; PTAKKWKLL;
TAKKWKLLP; IGFPPPCSC; GFPPPCSCT; FPPPCSCTF; PPPCSCTFC; PPCSCTFCD;
PCSCTFCDP; CSCTFCDPA; RLSMLVIPI; LSMLVIPIT; SMLVIPITS; MLVIPITSV;
LVIPITSVC; VIPITSVCT; IPITSVCTV; PITSVCTVT; ITSVCTVTA; TSVCTVTAS;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

SVCTVTASH; VCTVTASHI; CTVTASHIS; TVTASHISR; VTASHISRF; TASHISRFP;
ASHISRFPQ; SHISRFPQV; HISRFPQVR; ISRFPQVRS; SRFPQVRSS; RFPQVRSSF;
FPQVRSSFK; PQVRSSFKL; QVRSSFKLG; VRSSFKLGR; RSSFKLGRG; SSFKLGRGI;
SFKLGRGIL; FKLGRGILA; KLGRGILAV; LGRGILAVL; QGSIFLSGL; GSIFLSGLS;
SIFLSGLSL; IFLSGLSLL; FLSGLSLLK; LSGLSLLKS; SGLSLLKSF; GLSLLKSFS;
LSLLKSFSA; SLLKSFSAL; LLKSFSALS; LKSFSALSF; KSFSALSFR; SFSALSFRL;
FSALSFRLK; SALSFRLKP; ALSFRLKPL; LSFRLKPLR; SFRLKPLRF; FRLKPLRFS;
RLKPLRFSS; LKPLRFSSG; KPLRFSSGS; PLRFSSGSP; LRFSSGSPI; RFSSGSPIS;
FSSGSPISG; SSGSPISGF; SGSPISGFR; GSPISGFRK; SPISGFRKH; PISGFRKHS;
ISGFRKHST; SGFRKHSTS; GFRKHSTSV; FRKHSTSVI; RKHSTSVIA; KHSTSVIAS;
HSTSVIAST; STSVIASTP; TSVIASTPV; SVIASTPVL; VIASTPVLT; IASTPVLTS;
ASTPVLTSR; STPVLTSRT; TPVLTSRTS; PVLTSRTST; VLTSRTSTP; LTSRTSTPP;
TSRTSTPPF; SRTSTPPFI; RTSTPPFIS; TSTPPFISS; STPPFISSF; TPPFISSFG;
PPFISSFGT; PFISSFGTC; FISSFGTCT; ISSFGTCTG; SSFGTCTGS; SFGTCTGSF;
FGTCTGSFG; GTCTGSFGF; TCTGSFGFL; CTGSFGFLG; TGSFGFLGA; GSFGFLGAA;
SFGFLGAAP; FGFLGAAPG; GFLGAAPGH; FLGAAPGHS; LGAAPGHSP; GAAPGHSPF;
AAPGHSPFL; APGHSPFLL; PGHSPFLLV; GHSPFLLVG; HSPFLLVGA; SPFLLVGAI;
PFLLVGAIF; FLLVGAIFI; LLVGAIFIC; LVGAIFICF; VGAIFICFK; GAIFICFKS;
AIFICFKSR; IFICFKSRC; FICFKSRCY; ICFKSRCYS; CFKSRCYSP; FKSRCYSPV;
KSRCYSPVQ; SRCYSPVQA; RQHPLRSSS; QHPLRSSSL; HPLRSSSLI; PLRSSSLIS;
LRSSSLIST; RSSSLISTS; SSSLISTSW; SSLISTSWG; SLISTSWGN; LISTSWGNS;
ISTSWGNSF; STSWGNSFF; TSWGNSFFY; SWGNSFFYK; WGNSFFYKL; GNSFFYKLS;
VHSLCNFFY; HSLCNFFYT; SLCNFFYTV; LCNFFYTVS; CNFFYTVSI; NFFYTVSII;
FFYTVSIIY; FYTVSIIYT; YTVSIIYTI; TVSIIYTIS; VSIIYTISM; SIIYTISMA;
IIYTISMAK; IYTISMAKM; YTISMAKMY; TISMAKMYT; ISMAKMYTG; SMAKMYTGT;
MAKMYTGTF; AKMYTGTFP; KMYTGTFPF; MYTGTFPFS; YTGTFPFSY; TGTFPFSYL;
GTFPFSYLS; TFPFSYLSN; FPFSYLSNH; GPNRGKIRI; PNRGKIRII; NRGKIRIIL;
RGKIRIILL; GKIRIILLN; KIRIILLNI; IRIILLNII; RIILLNIII; IILLNIIIK;
ILLNIIIKV; LLNIIIKVY; LNIIIKVYR; NIIIKVYRG; IIIKVYRGI; IIKVYRGIY;
IKVYRGIYN; KVYRGIYNC; VYRGIYNCP; YRGIYNCPG; RGIYNCPGS; GIYNCPGSF;
IYNCPGSFL; YNCPGSFLQ; NCPGSFLQK; CPGSFLQKS; PGSFLQKSS; GSFLQKSSQ;
SFLQKSSQG; FLQKSSQGV; LQKSSQGVS; QKSSQGVSK; KSSQGVSKK; SSQGVSKKS;
SQGVSKKSF; QGVSKKSFC; GVSKKSFCS; VSKKSFCSS; SKKSFCSSL; KKSFCSSLQ;
KSFCSSLQF; SFCSSLQFL; GYRRYIIPN; YRRYIIPNN; RRYIIPNNM; RYIIPNNMP;
YIIPNNMPQ; IIPNNMPQS; IPNNMPQSL; PNNMPQSLG; NNMPQSLGN; NMPQSLGNS;
MPQSLGNSS; PQSLGNSSK; QSLGNSSKQ; SLGNSSKQR; LGNSSKQRR; GNSSKQRRT;
NSSKQRRTP; SSKQRRTPM; SKQRRTPMP; KQRRTPMPR; QRRTPMPRI; RRTPMPRIK;
RTPMPRIKV; TPMPRIKVL; PMPRIKVLN; MPRIKVLNI; PRIKVLNII; RIKVLNIIN;
IKVLNIINK; KVLNIINKS; VLNIINKSI; LNIINKSIY; NIINKSIYT; IINKSIYTR;
INKSIYTRK; NKSIYTRKQ; KSIYTRKQN; SIYTRKQNI; IYTRKQNII; YTRKQNIIV;
TRKQNIIVL; RKQNIIVLI; KQNIIVLIW; QNIIVLIWV; NIIVLIWVK; IIVLIWVKQ;
IVLIWVKQF; VLIWVKQFQ; LIWVKQFQS; IWVKQFQSH; WVKQFQSHA; LLIEAYSGN;
LIEAYSGNF; IEAYSGNFV; EAYSGNFVI; AYSGNFVIP; YSGNFVIPI; SGNFVIPII;
GNFVIPIIK; NFVIPIIKE; FVIPIIKEL; VIPIIKELI; IPIIKELIP; PIIKELIPY;
IIKELIPYL; IKELIPYLS; GTNTTNSLN; SSKPSNSPR; SKPSNSPRS; KPSNSPRST;
PSNSPRSTS; SNSPRSTSN; NSPRSTSNY; SPRSTSNYS; PRSTSNYSI; RSTSNYSIC;
STSNYSICL; TSNYSICLR; SNYSICLRS; GTCYALYSS; TCYALYSSK; CYALYSSKG;
YALYSSKGC; ALYSSKGCN; LYSSKGCNL; YSSKGCNLN; SSKGCNLNF; SKGCNLNFY;
KGCNLNFYS; GCNLNFYSS; CNLNFYSSS; NLNFYSSSS; LNFYSSSSL; NFYSSSSLP;
FYSSSSLPS; YSSSSLPSS; SSSSLPSSN; SSSLPSSNF; SSLPSSNFS; SLPSSNFSH;
KSCGSSSLR; SCGSSSLRY; CGSSSLRYT; GSSSLRYTG; SSSLRYTGN; SSTHEPGNT;
STHEPGNTK; THEPGNTKK; HEPGNTKKK; EPGNTKKKG; PGNTKKKGL; GNTKKKGLL;
NTKKKGLLT; ESFTESFTA; SFTESFTAG; FTESFTAGK; TESFTAGKA; ESFTAGKAV;
SFTAGKAVV; FTAGKAVVL; TAGKAVVLL; AGKAVVLLF; GKAVVLLFF; KAVVLLFFP;
AVVLLFFPS; VVLLFFPST; VLLFFPSTL; LLFFPSTLS; LFFPSTLSS; FFPSTLSSP;
FPSTLSSPL; PSTLSSPLQ; STLSSPLQN; TLSSPLQNS; LSSPLQNSS; SSPLQNSSK;
SPLQNSSKS; PLQNSSKSS; LQNSSKSSK; QNSSKSSKI; NSSKSSKIK; SSKSSKIKI;
SKSSKIKIK; KSSKIKIKI; SSKIKIKIL; ALFFVPVQV; LFFVPVQVL; FFVPVQVLP;
FVPVQVLPT; VPVQVLPTF; PVQVLPTFT; VQVLPTFTE; QVLPTFTEA; VLPTFTEAC;
LPTFTEACR; PTFTEACRD; TFTEACRDS; FTEACRDSW; TEACRDSWR; EACRDSWRR;
ACRDSWRRT; CRDSWRRTM; RDSWRRTMA; DSWRRTMAF; SWRRTMAFV; WRRTMAFVQ;
RRTMAFVQF; RTMAFVQFN; TMAFVQFNW; MAFVQFNWG; AFVQFNWGQ; FVQFNWGQG;
VQFNWGQGQ; QFNWGQGQD; FNWGQGQDS; ARKTCLSCT; RKTCLSCTF; KTCLSCTFL;
TCLSCTFLP; CLSCTFLPE; LSCTFLPEV; SCTFLPEVM; CTFLPEVMV; TFLPEVMVW;
FLPEVMVWL; LPEVMVWLH; PEVMVWLHS; EVMVWLHSM; VMVWLHSMG; MVWLHSMGK;
VWLHSMGKQ; WLHSMGKQL; LHSMGKQLL; HSMGKQLLP; SMGKQLLPV; MGKQLLPVS;
GKQLLPVSH; KQLLPVSHA; QLLPVSHAL; LLPVSHALS; LPVSHALSF; PVSHALSFL;
VSHALSFLR; SHALSFLRS; HALSFLRSW; ALSFLRSWF; LSFLRSWFG; SFLRSWFGC;
FLRSWFGCI; LRSWFGCIP; RSWFGCIPL; GHGLAAFHG; AAPPCGLFF; APPCGLFFY;
PPCGLFFYN; PCGLFFYNI; EAEAASAST; AEAASASTL; EAASASTLS; AASASTLSL;
ASASTLSLK; GLAKLFGEI; LAKLFGEIP; AKLFGEIPI; KLFGEIPIL; LFGEIPILL;
FGEIPILLQ; GEIPILLQF; EIPILLQFL; IPILLQFLQ

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

10 mers:

MDKVLNREES; DKVLNREESM; KVLNREESME; VLNREESMEL; LNREESMELM;
NREESMELMD; REESMELMDL; EESMELMDLL; ESMELMDLLG; SMELMDLLGL;
MELMDLLGLE; ELMDLLGLER; LMDLLGLERA; MDLLGLERAA; DLLGLERAAW;
LLGLERAAWG; LGLERAAWGN; GLERAAWGNL; LERAAWGNLP; ERAAWGNLPL;
RAAWGNLPLM; AAWGNLPLMR; AWGNLPLMRK; WGNLPLMRKA; GNLPLMRKAY;
NLPLMRKAYL; LPLMRKAYLR; PLMRKAYLRK; LMRKAYLRKC; MRKAYLRKCK;
RKAYLRKCKE; KAYLRKCKEF; AYLRKCKEFH; YLRKCKEFHP; LRKCKEFHPD;
RKCKEFHPDK; KCKEFHPDKG; CKEFHPDKGG; KEFHPDKGGD; EFHPDKGGDE;
FHPDKGGDED; HPDKGGDEDK; PDKGGDEDKM; DKGGDEDKMK; KGGDEDKMKR;
GGDEDKMKRM; GDEDKMKRMN; DEDKMKRMNT; EDKMKRMNTL; DKMKRMNTLY;
KMKRMNTLYK; MKRMNTLYKK; KRMNTLYKKM; RMNTLYKKME; MNTLYKKMEQ;
NTLYKKMEQD; TLYKKMEQDV; LYKKMEQDVK; YKKMEQDVKV; KKMEQDVKVA;
KMEQDVKVAH; MEQDVKVAHQ; EQDVKVAHQP; QDVKVAHQPD; DVKVAHQPDF;
VKVAHQPDFG; KVAHQPDFGT; VAHQPDFGTW; AHQPDFGTWS; HQPDFGTWSS;
QPDFGTWSSS; PDFGTWSSSE; DFGTWSSSEV; FGTWSSSEVC; GTWSSSEVCA;
TWSSSEVCAD; WSSSEVCADF; SSSEVCADFP; SSEVCADFPL; SEVCADFPLC;
EVCADFPLCP; VCADFPLCPD; CADFPLCPDT; ADFPLCPDTL; DFPLCPDTLY;
FPLCPDTLYC; PLCPDTLYCK; LCPDTLYCKE; CPDTLYCKEW; PDTLYCKEWP;
DTLYCKEWPI; TLYCKEWPIC; LYCKEWPICS; YCKEWPICSK; CKEWPICSKK;
KEWPICSKKP; EWPICSKKPS; WPICSKKPSV; PICSKKPSVH; ICSKKPSVHC;
CSKKPSVHCP; SKKPSVHCPC; KKPSVHCPCM; KPSVHCPCML; PSVHCPCMLC;
SVHCPCMLCQ; VHCPCMLCQL; HCPCMLCQLR; CPCMLCQLRL; PCMLCQLRLR;
CMLCQLRLRH; MLCQLRLRHL; LCQLRLRHLN; CQLRLRHLNR; QLRLRHLNRK;
LRLRHLNRKF; RLRHLNRKFL; LRHLNRKFLR; RHLNRKFLRK; HLNRKFLRKE;
LNRKFLRKEP; NRKFLRKEPL; RKFLRKEPLV; KFLRKEPLVW; FLRKEPLVWI;
LRKEPLVWID; RKEPLVWIDC; KEPLVWIDCY; EPLVWIDCYC; PLVWIDCYCI;
LVWIDCYCID; VWIDCYCIDC; WIDCYCIDCF; IDCYCIDCFT; DCYCIDCFTQ;
CYCIDCFTQW; YCIDCFTQWF; CIDCFTQWFG; IDCFTQWFGL; DCFTQWFGLD;
CFTQWFGLDL; FTQWFGLDLT; TQWFGLDLTE; QWFGLDLTEE; WFGLDLTEET;
FGLDLTEETL; GLDLTEETLQ; LDLTEETLQW; DLTEETLQWW; LTEETLQWWV;
TEETLQWWVQ; EETLQWWVQI; ETLQWWVQII; TLQWWVQIIG; LQWWVQIIGE;
QWWVQIIGET; WWVQIIGETP; WVQIIGETPF; VQIIGETPFR; QIIGETPFRD;
IIGETPFRDL; IGETPFRDLK; GETPFRDLKL; KALSNYFFYR; ALSNYFFYRC;
LSNYFFYRCQ; SNYFFYRCQP; NYFFYRCQPM; YFFYRCQPME; FFYRCQPMEQ;
FYRCQPMEQK; YRCQPMEQKS; RCQPMEQKSG; CQPMEQKSGS; QPMEQKSGSP;
PMEQKSGSPG; MEQKSGSPGG; EQKSGSPGGV; QKSGSPGGVP; KSGSPGGVPL;
SGSPGGVPLM; GSPGGVPLMK; SPGGVPLMKN; PGGVPLMKNG; GGVPLMKNGM;
GVPLMKNGMK; VPLMKNGMKI; PLMKNGMKIY; LMKNGMKIYF; MKNGMKIYFA;
KNGMKIYFAM; NGMKIYFAMK; GMKIYFAMKI; MKIYFAMKIC; KIYFAMKICL;
IYFAMKICLP; YFAMKICLPV; FAMKICLPVM; AMKICLPVMK; MKICLPVMKK;
KICLPVMKKQ; ICLPVMKKQQ; CLPVMKKQQQ; LPVMKKQQQI; PVMKKQQQIL;
VMKKQQQILN; MKKQQQILNT; KKQQQILNTQ; KQQQILNTQH; QQQILNTQHH;
QQILNTQHHP; QILNTQHHPK; ILNTQHHPKK; LNTQHHPKKE; NTQHHPKKER;
TQHHPKKKER; KTLKTFPLIY; TLKTFPLIYT; LKTFPLIYTS; KTFPLIYTSF;
TFPLIYTSFL; FPLIYTSFLV; PLIYTSFLVK; LIYTSFLVKL; IYTSFLVKLY;
YTSFLVKLYL; TSFLVKLYLV; SFLVKLYLVI; FLVKLYLVIE; LVKLYLVIEP;
VKLYLVIEPL; KLYLVIEPLP; LYLVIEPLPA; YLVIEPLPAL; LVIEPLPALL;
VIEPLPALLC; IEPLPALLCI; EPLPALLCIL; PLPALLCILL; LPALLCILLK;
PALLCILLKK; ALLCILLKKK; LLCILLKKKL; LCILLKKKLK; CILLKKKLKF;
ILLKKKLKFC; LLKKKLKFCI; LKKKLKFCIK; KKKLKFCIKN; KKLKFCIKNL;
KLKFCIKNLW; LKFCIKNLWK; KFCIKNLWKN; FCIKNLWKNI; CIKNLWKNIL;
LLLVDTCVLG; LLVDTCVLGI; LVDTCVLGII; VDTCVLGIIL; DTCVLGIILY;
TCVLGIILYS; CVLGIILYSF; LHIDIEFLQL; HIDIEFLQLI; IDIEFLQLII;
DIEFLQLIIS; IEFLQLIISV; EFLQLIISVK; FLQLIISVKS; LQLIISVKSC;
QLIISVKSCV; LIISVKSCVP; IISVKSCVPL; ISVKSCVPLV; SVKSCVPLVF;
FVRVLIRNTY; VRVLIRNTYY; RVLIRNTYYI; VLIRNTYYIV; LIRNTYYIVP;
RSMILAQKSL; SMILAQKSLK; MILAQKSLKK; ILAQKSLKKQ; LAQKSLKKQS;
AQKSLKKQSR; QKSLKKQSRC; KSLKKQSRCL; SLKKQSRCLG; LKKQSRCLGN;
RQSVRMCFYY; RSVKSVRKKT; SVKSVRKKTS; VKSVRKKTSL; KSVRKKTSLI;
SVRKKTSLIT; VRKKTSLITL; RKKTSLITLS; KKTSLITLSI; KTSLITLSIM;
TSLITLSIMK; SLITLSIMKS; LITLSIMKST; ITLSIMKSTL; TLSIMKSTLQ;
LSIMKSTLQM; SIMKSTLQML; IMKSTLQMLL; MKSTLQMLLF; KSTLQMLLFL;
STLQMLLFLQ; TLQMLLFLQK; LQMLLFLQKV; QMLLFLQKVK; MLLFLQKVKI;
LLFLQKVKIK; LFLQKVKIKK; FLQKVKIKKV; LQKVKIKKVF; QKVKIKKVFV;
KVKIKKVFVS; VKIKKVFVSK; KIKKVFVSKQ; NNIWQVLLGC; NIWQVLLGCT;
IWQVLLGCTV; WQVLLGCTVC; QVLLGCTVCY; VLLGCTVCYL; LLGCTVCYLK;
LGCTVCYLKW; GCTVCYLKWI; CTVCYLKWIL; YLIFCTVLFS; LIFCTVLFSM;
IFCTVLFSMY; FCTVLFSMYL; CTVLFSMYLK; TVLFSMYLKE; VLFSMYLKED;
LFSMYLKEDT; FSMYLKEDTG; SMYLKEDTGY; MYLKEDTGYL; YLKEDTGYLK;
LKEDTGYLKV; KEDTGYLKVP; EDTGYLKVPL; DTGYLKVPLI; TGYLKVPLIV;
GYLKVPLIVE; YLKVPLIVEK; LKVPLIVEKQ; KVPLIVEKQH; KGQELNQRIC;
GQELNQRICL; QELNQRICLQ; ELNQRICLQD; LNQRICLQDM; NQRICLQDME;
TKEPKYFHQA; KEPKYFHQAW; EPKYFHQAWL; PKYFHQAWLQ; MSILSLKPCK;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

SILSLKPCKL; ILSLKPCKLD; LSLKPCKLDL; ENPYKTQSSY; NPYKTQSSYL;
PYKTQSSYLK; YKTQSSYLKK; KTQSSYLKKE; TQSSYLKKEF; QSSYLKKEFY;
SSYLKKEFYK; SYLKKEFYKV; YLKKEFYKVE; LILQLIYNLE; ILQLIYNLEL;
LQLIYNLELL; QLIYNLELLN; LIYNLELLNG; IYNLELLNGR; YNLELLNGRK;
NLELLNGRKG; LELLNGRKGW; ELLNGRKGWI; LLNGRKGWIL; LNGRKGWILR;
NIIYAWGNVF; IIYAWGNVFL; IYAWGNVFLI; YAWGNVFLIL; AWGNVFLILQ;
WGNVFLILQE; GNVFLILQEK; NVFLILQEKR; VFLILQEKRI; FLILQEKRIQ;
LILQEKRIQK; ILQEKRIQKL; LQEKRIQKLK; QEKRIQKLKT; EKRIQKLKTL;
KRIQKLKTLD; RIQKLKTLDM; IQKLKTLDMD; QKLKTLDMDQ; KLKTLDMDQA;
LKTLDMDQAL; KTLDMDQALN; TLDMDQALNP; LDMDQALNPN; DMDQALNPNH;
MDQALNPNHN; DQALNPNHNA; QALNPNHNAL; ALNPNHNALP; LNPNHNALPK;
NPNHNALPKS; PNHNALPKSQ; NHNALPKSQI; HNALPKSQIL; NALPKSQILQ;
ALPKSQILQP; LPKSQILQPL; PKSQILQPLL; KSQILQPLLK; SQILQPLLKI;
QILQPLLKIP; ILQPLLKIPK; LQPLLKIPKG; QPLLKIPKGQ; PLLKIPKGQT;
LLKIPKGQTP; LKIPKGQTPI; KIPKGQTPIV; IPKGQTPIVK; PKGQTPIVKS;
KGQTPIVKSC; GQTPIVKSCI; QTPIVKSCIC; TPIVKSCICV; PIVKSCICVK;
IVKSCICVKA; VKSCICVKAF; KSCICVKAFS; SCICVKAFSV; CICVKAFSVL;
ICVKAFSVLK; CVKAFSVLKG; VKAFSVLKGL; KAFSVLKGLK; AFSVLKGLKH;
FSVLKGLKHH; SVLKGLKHHP; VLKGLKHHPQ; LKGLKHHPQN; KGLKHHPQNN;
GLKHHPQNNT; LKHHPQNNTS; KHHPQNNTSL; HHPQNNTSLK; HPQNNTSLKV;
PQNNTSLKVA; QNNTSLKVAY; NNTSLKVAYT; NTSLKVAYTK; TSLKVAYTKA;
SLKVAYTKAA; LKVAYTKAAF; KVAYTKAAFI; VAYTKAAFIK; AYTKAAFIKC;
YTKAAFIKCI; TKAAFIKCIC; KAAFIKCICT; AAFIKCICTI; AFIKCICTIK;
FIKCICTIKA; IKCICTIKAP; KCICTIKAPV; SILVCNCPCL; ILVCNCPCLS;
LVCNCPCLSI; VCNCPCLSIY; CNCPCLSIYL; NCPCLSIYLI; CPCLSIYLII;
PCLSIYLIIS; CLSIYLIISG; LSIYLIISGS; SIYLIISGSP; IYLIISGSPG;
YLIISGSPGS; LIISGSPGSL; IISGSPGSLS; ISGSPGSLSV; SGSPGSLSVP;
GSPGSLSVPS; SPGSLSVPSN; PGSLSVPSNT; GSLSVPSNTL; SLSVPSNTLT;
LSVPSNTLTS; SVPSNTLTSS; VPSNTLTSST; PSNTLTSSTW; SNTLTSSTWD;
NTLTSSTWDS; TLTSSTWDSI; LTSSTWDSIP; TSSTWDSIPY; SSTWDSIPYI;
STWDSIPYIG; TWDSIPYIGC; WDSIPYIGCP; DSIPYIGCPS; SIPYIGCPST;
IPYIGCPSTL; PYIGCPSTLW; YIGCPSTLWV; IGCPSTLWVL; GCPSTLWVLL;
CPSTLWVLLF; PSTLWVLLFI; STLWVLLFIR; TLWVLLFIRS; LWVLLFIRSL;
WVLLFIRSLS; VLLFIRSLSK; LLFIRSLSKK; LFIRSLSKKE; FIRSLSKKEI;
IRSLSKKEIG; GFFTDLFLRR; FFTDLFLRRI; FTDLFLRRIL; TDLFLRRILK;
DLFLRRILKY; LFLRRILKYL; FLRRILKYLA; LRRILKYLAR; RRILKYLARP;
RILKYLARPL; ILKYLARPLH; LKYLARPLHC; KYLARPLHCC; YLARPLHCCV;
LARPLHCCVP; ARPLHCCVPE; RPLHCCVPEL; PLHCCVPELL; LHCCVPELLV;
HCCVPELLVN; CCVPELLVNR; CVPELLVNRP; VPELLVNRPQ; PELLVNRPQI;
ELLVNRPQIS; LLVNRPQISA; LVNRPQISAA; VNRPQISAAE; NRPQISAAET;
RPQISAAETY; PQISAAETYR; QISAAETYRL; ISAAETYRLS; SAAETYRLSA;
AAETYRLSAL; AETYRLSALQ; ETYRLSALQR; TYRLSALQRG; YRLSALQRGP;
RLSALQRGPT; LSALQRGPTP; SALQRGPTPC; ALQRGPTPCS; LQRGPTPCSS;
QRGPTPCSSS; RGPTPCSSSN; GPTPCSSSNT; PTPCSSSNTV; TPCSSSNTVV;
PCSSSNTVVA; CSSSNTVVAV; SSSNTVVAVL; SSNTVVAVLV; SNTVVAVLVT;
STGGTFSPPV; TGGTFSPPVK; GGTFSPPVKV; GTFSPPVKVP; TFSPPVKVPK;
FSPPVKVPKY; SPPVKVPKYL; PPVKVPKYLA; PVKVPKYLAF; VKVPKYLAFS;
KVPKYLAFSF; VPKYLAFSFL; PKYLAFSFLL; KYLAFSFLLG; YLAFSFLLGS;
LAFSFLLGSG; AFSFLLGSGT; FSFLLGSGTQ; SFLLGSGTQH; FLLGSGTQHS;
LLGSGTQHST; LGSGTQHSTG; ALWSVFITWD; LWSVFITWDW; WSVFITWDWA;
SVFITWDWAV; VFITWDWAVG; FITWDWAVGF; ITWDWAVGFL; TWDWAVGFLG;
WDWAVGFLGV; DWAVGFLGVI; WAVGFLGVIV; AVGFLGVIVP; VGFLGVIVPS;
GFLGVIVPSG; FLGVIVPSGY; LGVIVPSGYF; GVIVPSGYFD; VIVPSGYFDL;
FISTPCISKG; ISTPCISKGS; STPCISKGSP; TPCISKGSPP; PCISKGSPPT;
CISKGSPPTA; ISKGSPPTAK; SKGSPPTAKK; KGSPPTAKKW; GSPPTAKKWK;
SPPTAKKWKL; PPTAKKWKLL; PTAKKWKLLP; IGFPPPCSCT; GFPPPCSCTF;
FPPPCSCTFC; PPPCSCTFCD; PPCSCTFCDP; PCSCTFCDPA; RLSMLVIPIT;
LSMLVIPITS; SMLVIPITSV; MLVIPITSVC; LVIPITSVCT; VIPITSVCTV;
IPITSVCTVT; PITSVCTVTA; ITSVCTVTAS; TSVCTVTASH; SVCTVTASHI;
VCTVTASHIS; CTVTASHISR; TVTASHISRF; VTASHISRFP; TASHISRFPQ;
ASHISRFPQV; SHISRFPQVR; HISRFPQVRS; ISRFPQVRSS; SRFPQVRSSF;
RFPQVRSSFK; FPQVRSSFKL; PQVRSSFKLG; QVRSSFKLGR; VRSSFKLGRG;
RSSFKLGRGI; SSFKLGRGIL; SFKLGRGILA; FKLGRGILAV; KLGRGILAVL;
QGSIFLSGLS; GSIFLSGLSL; SIFLSGLSLL; IFLSGLSLLK; FLSGLSLLKS;
LSGLSLLKSF; SGLSLLKSFS; GLSLLKSFSA; LSLLKSFSAL; SLLKSFSALS;
LLKSFSALSF; LKSFSALSFR; KSFSALSFRL; SFSALSFRLK; FSALSFRLKP;
SALSFRLKPL; ALSFRLKPLR; LSFRLKPLRF; SFRLKPLRFS; FRLKPLRFSS;
RLKPLRFSSG; LKPLRFSSGS; KPLRFSSGSP; PLRFSSGSPI; LRFSSGSPIS;
RFSSGSPISG; FSSGSPISGF; SSGSPISGFR; SGSPISGFRK; GSPISGFRKH;
SPISGFRKHS; PISGFRKHST; ISGFRKHSTS; SGFRKHSTSV; GFRKHSTSVI;
FRKHSTSVIA; RKHSTSVIAS; KHSTSVIAST; HSTSVIASTP; STSVIASTPV;
TSVIASTPVL; SVIASTPVLT; VIASTPVLTS; IASTPVLTSR; ASTPVLTSRT;
STPVLTSRTS; TPVLTSRTST; PVLTSRTSTP; VLTSRTSTPP; LTSRTSTPPF;
TSRTSTPPFI; SRTSTPPFIS; RTSTPPFISS; TSTPPFISSF; STPPFISSFG;
TPPFISSFGT; PPFISSFGTC; PFISSFGTCT; FISSFGTCTG; ISSFGTCTGS;
SSFGTCTGSF; SFGTCTGSFG; FGTCTGSFGF; GTCTGSFGFL; TCTGSFGFLG;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

CTGSFGFLGA; TGSFGFLGAA; GSFGFLGAAP; SFGFLGAAPG; FGFLGAAPGH;
GFLGAAPGHS; FLGAAPGHSP; LGAAPGHSPF; GAAPGHSPFL; AAPGHSPFLL;
APGHSPFLLV; PGHSPFLLVG; GHSPFLLVGA; HSPFLLVGAI; SPFLLVGAIF;
PFLLVGAIFI; FLLVGAIFIC; LLVGAIFICF; LVGAIFICFK; VGAIFICFKS;
GAIFICFKSR; AIFICFKSRC; IFICFKSRCY; FICFKSRCYS; ICFKSRCYSP;
CFKSRCYSPV; FKSRCYSPVQ; KSRCYSPVQA; RQHPLRSSSL; QHPLRSSSLI;
HPLRSSSLIS; PLRSSSLIST; LRSSSLISTS; RSSSLISTSW; SSSLISTSWG;
SSLISTSWGN; SLISTSWGNS; LISTSWGNSF; ISTSWGNSFF; STSWGNSFFY;
TSWGNSFFYK; SWGNSFFYKL; WGNSFFYKLS; VHSLCNFFYT; HSLCNFFYTV;
SLCNFFYTVS; LCNFFYTVSI; CNFFYTVSII; NFFYTVSIIY; FFYTVSIIYT;
FYTVSIIYTI; YTVSIIYTIS; TVSIIYTISM; VSIIYTISMA; SIIYTISMAK;
IIYTISMAKM; IYTISMAKMY; YTISMAKMYT; TISMAKMYTG; ISMAKMYTGT;
SMAKMYTGTF; MAKMYTGTFP; AKMYTGTFPF; KMYTGTFPFS; MYTGTFPFSY;
YTGTFPFSYL; TGTFPFSYLS; GTFPFSYLSN; TFPFSYLSNH; GPNRGKIRII;
PNRGKIRIIL; NRGKIRIILL; RGKIRIILLN; GKIRIILLNI; KIRIILLNII;
IRIILLNIII; RIILLNIIIK; IILLNIIIKV; ILLNIIIKVY; LLNIIIKVYR;
LNIIIKVYRG; NIIIKVYRGI; IIIKVYRGIY; IIKVYRGIYN; IKVYRGIYNC;
KVYRGIYNCP; VYRGIYNCPG; YRGIYNCPGS; RGIYNCPGSF; GIYNCPGSFL;
IYNCPGSFLQ; YNCPGSFLQK; NCPGSFLQKS; CPGSFLQKSS; PGSFLQKSSQ;
GSFLQKSSQG; SFLQKSSQGV; FLQKSSQGVS; LQKSSQGVSK; QKSSQGVSKK;
KSSQGVSKKS; SSQGVSKKSF; SQGVSKKSFC; QGVSKKSFCS; GVSKKSFCSS;
VSKKSFCSSL; SKKSFCSSLQ; KKSFCSSLQF; KSFCSSLQFL; GYRRYIIPNN;
YRRYIIPNNM; RRYIIPNNMP; RYIIPNNMPQ; YIIPNNMPQS; IIPNNMPQSL;
IPNNMPQSLG; PNNMPQSLGN; NNMPQSLGNS; NMPQSLGNSS; MPQSLGNSSK;
PQSLGNSSKQ; QSLGNSSKQR; SLGNSSKQRR; LGNSSKQRRT; GNSSKQRRTP;
NSSKQRRTPM; SSKQRRTPMP; SKQRRTPMPR; KQRRTPMPRI; QRRTPMPRIK;
RRTPMPRIKV; RTPMPRIKVL; TPMPRIKVLN; PMPRIKVLNI; MPRIKVLNII;
PRIKVLNIIN; RIKVLNIINK; IKVLNIINKS; KVLNIINKSI; VLNIINKSIY;
LNIINKSIYT; NIINKSIYTR; IINKSIYTRK; INKSIYTRKQ; NKSIYTRKQN;
KSIYTRKQNI; SIYTRKQNII; IYTRKQNIIV; YTRKQNIIVL; TRKQNIIVLI;
RKQNIIVLIW; KQNIIVLIWV; QNIIVLIWVK; NIIVLIWVKQ; IIVLIWVKQF;
IVLIWVKQFQ; VLIWVKQFQS; LIWVKQFQSH; IWVKQFQSHA; LLIEAYSGNF;
LIEAYSGNFV; IEAYSGNFVI; EAYSGNFVIP; AYSGNFVIPI; YSGNFVIPII;
SGNFVIPIIK; GNFVIPIIKE; NFVIPIIKEL; FVIPIIKELI; VIPIIKELIP;
IPIIKELIPY; PIIKELIPYL; IIKELIPYLS; SSKPSNSPRS; SKPSNSPRST;
KPSNSPRSTS; PSNSPRSTSN; SNSPRSTSNY; NSPRSTSNYS; SPRSTSNYSI;
PRSTSNYSIC; RSTSNYSICL; STSNYSICLR; TSNYSICLRS; GTCYALYSSK;
TCYALYSSKG; CYALYSSKGC; YALYSSKGCN; ALYSSKGCNL; LYSSKGCNLN;
YSSKGCNLNF; SSKGCNLNFY; SKGCNLNFYS; KGCNLNFYSS; GCNLNFYSSS;
CNLNFYSSSS; NLNFYSSSSL; LNFYSSSSLP; NFYSSSSLPS; FYSSSSLPSS;
YSSSSLPSSN; SSSSLPSSNF; SSSLPSSNFS; SSLPSSNFSH; KSCGSSSLRY;
SCGSSSLRYT; CGSSSLRYTG; GSSSLRYTGN; SSTHEPGNTK; STHEPGNTKK;
THEPGNTKKK; HEPGNTKKKG; EPGNTKKKGL; PGNTKKKGLL; GNTKKKGLLT;
ESFTESFTAG; SFTESFTAGK; FTESFTAGKA; TESFTAGKAV; ESFTAGKAVV;
SFTAGKAVVL; FTAGKAVVLL; TAGKAVVLLF; AGKAVVLLFF; GKAVVLLFFP;
KAVVLLFFPS; AVVLLFFPST; VVLLFFPSTL; VLLFFPSTLS; LLFFPSTLSS;
LFFPSTLSSP; FFPSTLSSPL; FPSTLSSPLQ; PSTLSSPLQN; STLSSPLQNS;
TLSSPLQNSS; LSSPLQNSSK; SSPLQNSSKS; SPLQNSSKSS; PLQNSSKSSK;
LQNSSKSSKI; QNSSKSSKIK; NSSKSSKIKI; SSKSSKIKIK; SKSSKIKIKI;
KSSKIKIKIL; ALFFVPVQVL; LFFVPVQVLP; FFVPVQVLPT; FVPVQVLPTF;
VPVQVLPTFT; PVQVLPTFTE; VQVLPTFTEA; QVLPTFTEAC; VLPTFTEACR;
LPTFTEACRD; PTFTEACRDS; TFTEACRDSW; FTEACRDSWR; TEACRDSWRR;
EACRDSWRRT; ACRDSWRRTM; CRDSWRRTMA; RDSWRRTMAF; DSWRRTMAFV;
SWRRTMAFVQ; WRRTMAFVQF; RRTMAFVQFN; RTMAFVQFNW; TMAFVQFNWG;
MAFVQFNWGQ; AFVQFNWGQG; FVQFNWGQGQ; VQFNWGQGQD; QFNWGQGQDS;
ARKTCLSCTF; RKTCLSCTFL; KTCLSCTFLP; TCLSCTFLPE; CLSCTFLPEV;
LSCTFLPEVM; SCTFLPEVMV; CTFLPEVMVW; TFLPEVMVWL; FLPEVMVWLH;
LPEVMVWLHS; PEVMVWLHSM; EVMVWLHSMG; VMVWLHSMGK; MVWLHSMGKQ;
VWLHSMGKQL; WLHSMGKQLL; LHSMGKQLLP; HSMGKQLLPV; SMGKQLLPVS;
MGKQLLPVSH; GKQLLPVSHA; KQLLPVSHAL; QLLPVSHALS; LLPVSHALSF;
LPVSHALSFL; PVSHALSFLR; VSHALSFLRS; SHALSFLRSW; HALSFLRSWF;
ALSFLRSWFG; LSFLRSWFGC; SFLRSWFGCI; FLRSWFGCIP; LRSWFGCIPL;
AAPPCGLFFY; APPCGLFFYN; PPCGLFFYNI; EAEAASASTL; AEAASASTLS;
EAASASTLSL; AASASTLSLK; GLAKLFGEIP; LAKLFGEIPI; AKLFGEIPIL;
KLFGEIPILL; LFGEIPILLQ; FGEIPILLQF; GEIPILLQFL; EIPILLQFLQ 11 mers:

MDKVLNREESM; DKVLNREESME; KVLNREESMEL; VLNREESMELM; LNREESMELMD;
NREESMELMDL; REESMELMDLL; EESMELMDLLG; ESMELMDLLGL; SMELMDLLGLE;
MELMDLLGLER; ELMDLLGLERA; LMDLLGLERAA; MDLLGLERAAW; DLLGLERAAWG;
LLGLERAAWGN; LGLERAAWGNL; GLERAAWGNLP; LERAAWGNLPL; ERAAWGNLPLM;
RAAWGNLPLMR; AAWGNLPLMRK; AWGNLPLMRKA; WGNLPLMRKAY; GNLPLMRKAYL;
NLPLMRKAYLR; LPLMRKAYLRK; PLMRKAYLRKC; LMRKAYLRKCK; MRKAYLRKCKE;
RKAYLRKCKEF; KAYLRKCKEFH; AYLRKCKEFHP; YLRKCKEFHPD; LRKCKEFHPDK;
RKCKEFHPDKG; KCKEFHPDKGG; CKEFHPDKGGD; KEFHPDKGGDE; EFHPDKGGDED;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

FHPDKGGDEDK; HPDKGGDEDKM; PDKGGDEDKMK; DKGGDEDKMKR; KGGDEDKMKRM;
GGDEDKMKRMN; GDEDKMKRMNT; DEDKMKRMNTL; EDKMKRMNTLY; DKMKRMNTLYK;
KMKRMNTLYKK; MKRMNTLYKKM; KRMNTLYKKME; RMNTLYKKMEQ; MNTLYKKMEQD;
NTLYKKMEQDV; TLYKKMEQDVK; LYKKMEQDVKV; YKKMEQDVKVA; KKMEQDVKVAH;
KMEQDVKVAHQ; MEQDVKVAHQP; EQDVKVAHQPD; QDVKVAHQPDF; DVKVAHQPDFG;
VKVAHQPDFGT; KVAHQPDFGTW; VAHQPDFGTWS; AHQPDFGTWSS; HQPDFGTWSSS;
QPDFGTWSSSE; PDFGTWSSSEV; DFGTWSSSEVC; FGTWSSSEVCA; GTWSSSEVCAD;
TWSSSEVCADF; WSSSEVCADFP; SSSEVCADFPL; SSEVCADFPLC; SEVCADFPLCP;
EVCADFPLCPD; VCADFPLCPDT; CADFPLCPDTL; ADFPLCPDTLY; DFPLCPDTLYC;
FPLCPDTLYCK; PLCPDTLYCKE; LCPDTLYCKEW; CPDTLYCKEWP; PDTLYCKEWPI;
DTLYCKEWPIC; TLYCKEWPICS; LYCKEWPICSK; YCKEWPICSKK; CKEWPICSKKP;
KEWPICSKKPS; EWPICSKKPSV; WPICSKKPSVH; PICSKKPSVHC; ICSKKPSVHCP;
CSKKPSVHCPC; SKKPSVHCPCM; KKPSVHCPCML; KPSVHCPCMLQ; PSVHCPCMLCQ;
SVHCPCMLCQL; VHCPCMLCQLR; HCPCMLCQLRL; CPCMLCQLRLR; PCMLCQLRLRH;
CMLCQLRLRHL; MLCQLRLRHLN; LCQLRLRHLNR; CQLRLRHLNRK; QLRLRHLNRKF;
LRLRHLNRKFL; RLRHLNRKFLR; LRHLNRKFLRK; RHLNRKFLRKE; HLNRKFLRKEP;
LNRKFLRKEPL; NRKFLRKEPLV; RKFLRKEPLVW; KFLRKEPLVWI; FLRKEPLVWID;
LRKEPLVWIDC; RKEPLVWIDCY; KEPLVWIDCYC; EPLVWIDCYCI; PLVWIDCYCID;
LVWIDCYCIDC; VWIDCYCIDCF; WIDCYCIDCFT; IDCYCIDCFTQ; DCYCIDCFTQW;
CYCIDCFTQWF; YCIDCFTQWFG; CIDCFTQWFGL; IDCFTQWFGLD; DCFTQWFGLDL;
CFTQWFGLDLT; FTQWFGLDLTE; TQWFGLDLTEE; QWFGLDLTEET; WFGLDLTEETL;
FGLDLTEETLQ; GLDLTEETLQW; LDLTEETLQWW; DLTEETLQWWV; LTEETLQWWVQ;
TEETLQWWVQI; EETLQWWVQII; ETLQWWVQIIG; TLQWWVQIIGE; LQWWVQIIGET;
QWWVQIIGETP; WWVQIIGETPF; WVQIIGETPFR; VQIIGETPFRD; QIIGETPFRDL;
IIGETPFRDLK; IGETPFRDLKL; KALSNYFFYRC; ALSNYFFYRCQ; LSNYFFYRCQP;
SNYFFYRCQPM; NYFFYRCQPME; YFFYRCQPMEQ; FFYRCQPMEQK; FYRCQPMEQKS;
YRCQPMEQKSG; RCQPMEQKSGS; CQPMEQKSGSP; QPMEQKSGSPG; PMEQKSGSPGG;
MEQKSGSPGGV; EQKSGSPGGVP; QKSGSPGGVPL; KSGSPGGVPLM; SGSPGGVPLMK;
GSPGGVPLMKN; SPGGVPLMKNG; PGGVPLMKNGM; GGVPLMKNGMK; GVPLMKNGMKI;
VPLMKNGMKIY; PLMKNGMKIYF; LMKNGMKIYFA; MKNGMKIYFAM; KNGMKIYFAMK;
NGMKIYFAMKI; GMKIYFAMKIC; MKIYFAMKICL; KIYFAMKICLP; IYFAMKICLPV;
YFAMKICLPVM; FAMKICLPVMK; AMKICLPVMKK; MKICLPVMKKQ; KICLPVMKKQQ;
ICLPVMKKQQQ; CLPVMKKQQQI; LPVMKKQQQIL; PVMKKQQQILN; VMKKQQQILNT;
MKKQQQILNTQ; KKQQQILNTQH; KQQQILNTQHH; QQQILNTQHHP; QQILNTQHHPK;
QILNTQHHPKK; ILNTQHHPKKK; LNTQHHPKKKE; NTQHHPKKKER; KTLKTFPLIYT;
TLKTFPLIYTS; LKTFPLIYTSF; KTFPLIYTSFL; TFPLIYTSFLV; FPLIYTSFLVK;
PLIYTSFLVKL; LIYTSFLVKLY; IYTSFLVKLYL; YTSFLVKLYLV; TSFLVKLYLVI;
SFLVKLYLVIE; FLVKLYLVIEP; LVKLYLVIEPL; VKLYLVIEPLP; KLYLVIEPLPA;
LYLVIEPLPAL; YLVIEPLPALL; LVIEPLPALLC; VIEPLPALLCI; IEPLPALLCIL;
EPLPALLCILL; PLPALLCILLK; LPALLCILLKK; PALLCILLKKK; ALLCILLKKKL;
LLCILLKKKLK; LCILLKKKLKF; CILLKKKLKFC; ILLKKKLKFCI; LLKKKLKFCIK;
LKKKLKFCIKN; KKKLKFCIKNL; KKLKFCIKNLW; KLKFCIKNLWK; LKFCIKNLWKN;
KFCIKNLWKNI; FCIKNLWKNIL; LLLVDTCVLGI; LLVDTCVLGII; LVDTCVLGIIL;
VDTCVLGIILY; DTCVLGIILYS; TCVLGIILYSF; LHIDIEFLQLI; HIDIEFLQLII;
IDIEFLQLIIS; DIEFLQLIISV; IEFLQLIISVK; EFLQLIISVKS; FLQLIISVKSC;
LQLIISVKSCV; QLIISVKSCVP; LIISVKSCVPL; IISVKSCVPLV; ISVKSCVPLVF;
FVRVLIRNTYY; VRVLIRNTYYI; RVLIRNTYYIV; VLIRNTYYIVP; RSMILAQKSLK;
SMILAQKSLKK; MILAQKSLKKQ; ILAQKSLKKQS; LAQKSLKKQSR; AQKSLKKQSRC;
QKSLKKQSRCL; KSLKKQSRCLG; SLKKQSRCLGN; RSVKSVRKKTS; SVKSVRKKTSL;
VKSVRKKTSLI; KSVRKKTSLIT; SVRKKTSLITL; VRKKTSLITLS; RKKTSLITLSI;
KKTSLITLSIM; KTSLITLSIMK; TSLITLSIMKS; SLITLSIMKST; LITLSIMKSTL;
ITLSIMKSTLQ; TLSIMKSTLQM; LSIMKSTLQML; SIMKSTLQMLL; IMKSTLQMLLF;
MKSTLQMLLFL; KSTLQMLLFLQ; STLQMLLFLQK; TLQMLLFLQKV; LQMLLFLQKVK;
QMLLFLQKVKI; MLLFLQKVKIK; LLFLQKVKIKK; LFLQKVKIKKV; FLQKVKIKKVF;
LQKVKIKKVFV; QKVKIKKVFVS; KVKIKKVFVSK; VKIKKVFVSKQ; NNIWQVLLGCT;
NIWQVLLGCTV; IWQVLLGCTVC; WQVLLGCTVCY; QVLLGCTVCYL; VLLGCTVCYLK;
LLGCTVCYLKW; LGCTVCYLKWI; GCTVCYLKWIL; YLIFCTVLFSM; LIFCTVLFSMY;
IFCTVLFSMYL; FCTVLFSMYLK; CTVLFSMYLKE; TVLFSMYLKED; VLFSMYLKEDT;
LFSMYLKEDTG; FSMYLKEDTGY; SMYLKEDTGYL; MYLKEDTGYLK; YLKEDTGYLKV;
LKEDTGYLKVP; KEDTGYLKVPL; EDTGYLKVPLI; DTGYLKVPLIV; TGYLKVPLIVE;
GYLKVPLIVEK; YLKVPLIVEKQ; LKVPLIVEKQH; KGQELNQRICL; GQELNQRICLQ;
QELNQRICLQD; ELNQRICLQDM; LNQRICLQDME; TKEPKYFHQAW; KEPKYFHQAWL;
EPKYFHQAWLQ; MSILSLKPCKL; SILSLKPCKLD; ILSLKPCKLDL; ENPYKTQSSYL;
NPYKTQSSYLK; PYKTQSSYLKK; YKTQSSYLKKE; KTQSSYLKKEF; TQSSYLKKEFY;
QSSYLKKEFYK; SSYLKKEFYKV; SYLKKEFYKVE; LILQLIYNLEL; ILQLIYNLELL;
LQLIYNLELLN; QLIYNLELLNG; LIYNLELLNGR; IYNLELLNGRK; YNLELLNGRKG;
NLELLNGRKGW; LELLNGRKGWI; ELLNGRKGWIL; LLNGRKGWILR; NIIYAWGNVFL;
IIYAWGNVFLI; IYAWGNVFLIL; YAWGNVFLILQ; AWGNVFLILQE; WGNVFLILQEK;
GNVFLILQEKR; NVFLILQEKRI; VFLILQEKRIQ; FLILQEKRIQK; LILQEKRIQKL;
ILQEKRIQKLK; LQEKRIQKLKT; QEKRIQKLKTL; EKRIQKLKTLD; KRIQKLKTLDM;
RIQKLKTLDMD; IQKLKTLDMDQ; QKLKTLDMDQA; KLKTLDMDQAL; LKTLDMDQALN;
KTLDMDQALNP; TLDMDQALNPN; LDMDQALNPNH; DMDQALNPNHN; MDQALNPNHNA;
DQALNPNHNAL; QALNPNHNALP; ALNPNHNALPK; LNPNHNALPKS; NPNHNALPKSQ;
PNHNALPKSQI; NHNALPKSQIL; HNALPKSQILQ; NALPKSQILQP; ALPKSQILQPL;
LPKSQILQPLL; PKSQILQPLLK; KSQILQPLLKI; SQILQPLLKIP; QILQPLLKIPK;
ILQPLLKIPKG; LQPLLKIPKGQ; QPLLKIPKGQT; PLLKIPKGQTP; LLKIPKGQTPI;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

LKIPKGQTPIV; KIPKGQTPIVK; IPKGQTPIVKS; PKGQTPIVKSC; KGQTPIVKSCI;
GQTPIVKSCIC; QTPIVKSCICV; TPIVKSCICVK; PIVKSCICVKA; IVKSCICVKAF;
VKSCICVKAFS; KSCICVKAFSV; SCICVKAFSVL; CICVKAFSVLK; ICVKAFSVLKG;
CVKAFSVLKGL; VKAFSVLKGLK; KAFSVLKGLKH; AFSVLKGLKHH; FSVLKGLKHHP;
SVLKGLKHHPQ; VLKGLKHHPQN; LKGLKHHPQNN; KGLKHHPQNNT; GLKHHPQNNTS;
LKHHPQNNTSL; KHHPQNNTSLK; HHPQNNTSLKV; HPQNNTSLKVA; PQNNTSLKVAY;
QNNTSLKVAYT; NNTSLKVAYTK; NTSLKVAYTKA; TSLKVAYTKAA; SLKVAYTKAAF;
LKVAYTKAAFI; KVAYTKAAFIK; VAYTKAAFIKC; AYTKAAFIKCI; YTKAAFIKCIC;
TKAAFIKCICT; KAAFIKCICTI; AAFIKCICTIK; AFIKCICTIKA; FIKCICTIKAP;
IKCICTIKAPV; SILVCNCPCLS; ILVCNCPCLSI; LVCNCPCLSIY; VCNCPCLSIYL;
CNCPCLSIYLI; NCPCLSIYLII; CPCLSIYLIIS; PCLSIYLIISG; CLSIYLIISGS;
LSIYLIISGSP; SIYLIISGSPG; IYLIISGSPGS; YLIISGSPGSL; LIISGSPGSLS;
IISGSPGSLSV; ISGSPGSLSVP; SGSPGSLSVPS; GSPGSLSVPSN; SPGSLSVPSNT;
PGSLSVPSNTL; GSLSVPSNTLT; SLSVPSNTLTS; LSVPSNTLTSS; SVPSNTLTSST;
VPSNTLTSSTW; PSNTLTSSTWD; SNTLTSSTWDS; NTLTSSTWDSI; TLTSSTWDSIP;
LTSSTWDSIPY; TSSTWDSIPYI; SSTWDSIPYIG; STWDSIPYIGC; TWDSIPYIGCP;
WDSIPYIGCPS; DSIPYIGCPST; SIPYIGCPSTL; IPYIGCPSTLW; PYIGCPSTLWV;
YIGCPSTLWVL; IGCPSTLWVLL; GCPSTLWVLLF; CPSTLWVLLFI; PSTLWVLLFIR;
STLWVLLFIRS; TLWVLLFIRSL; LWVLLFIRSLS; WVLLFIRSLSK; VLLFIRSLSKK;
LLFIRSLSKKE; LFIRSLSKKEI; FIRSLSKKEIG; GFFTDLFLRRI; FFTDLFLRRIL;
FTDLFLRRILK; TDLFLRRILKY; DLFLRRILKYL; LFLRRILKYLA; FLRRILKYLAR;
LRRILKYLARP; RRILKYLARPL; RILKYLARPLH; ILKYLARPLHC; LKYLARPLHCC;
KYLARPLHCCV; YLARPLHCCVP; LARPLHCCVPE; ARPLHCCVPEL; RPLHCCVPELL;
PLHCCVPELLV; LHCCVPELLVN; HCCVPELLVNR; CCVPELLVNRP; CVPELLVNRPQ;
VPELLVNRPQI; PELLVNRPQIS; ELLVNRPQISA; LLVNRPQISAA; LVNRPQISAAE;
VNRPQISAAET; NRPQISAAETY; RPQISAAETYR; PQISAAETYRL; QISAAETYRLS;
ISAAETYRLSA; SAAETYRLSAL; AAETYRLSALQ; AETYRLSALQR; ETYRLSALQRG;
TYRLSALQRGP; YRLSALQRGPT; RLSALQRGPTP; LSALQRGPTPC; SALQRGPTPCS;
ALQRGPTPCSS; LQRGPTPCSSS; QRGPTPCSSSN; RGPTPCSSSNT; GPTPCSSSNTV;
PTPCSSSNTVV; TPCSSSNTVVA; PCSSSNTVVAV; CSSSNTVVAVL; SSSNTVVAVLV;
SSNTVVAVLVT; STGGTFSPPVK; TGGTFSPPVKV; GGTFSPPVKVP; GTFSPPVKVPK;
TFSPPVKVPKY; FSPPVKVPKYL; SPPVKVPKYLA; PPVKVPKYLAF; PVKVPKYLAFS;
VKVPKYLAFSF; KVPKYLAFSFL; VPKYLAFSFLL; PKYLAFSFLLG; KYLAFSFLLGS;
YLAFSFLLGSG; LAFSFLLGSGT; AFSFLLGSGTQ; FSFLLGSGTQH; SFLLGSGTQHS;
FLLGSGTQHST; LLGSGTQHSTG; ALWSVFITWDW; LWSVFITWDWA; WSVFITWDWAV;
SVFITWDWAVG; VFITWDWAVGF; FITWDWAVGFL; ITWDWAVGFLG; TWDWAVGFLGV;
WDWAVGFLGVI; DWAVGFLGVIV; WAVGFLGVIVP; AVGFLGVIVPS; VGFLGVIVPSG;
GFLGVIVPSGY; FLGVIVPSGYF; LGVIVPSGYFD; GVIVPSGYFDL; FISTPCISKGS;
ISTPCISKGSP; STPCISKGSPP; TPCISKGSPPT; PCISKGSPPTA; CISKGSPPTAK;
ISKGSPPTAKK; SKGSPPTAKKW; KGSPPTAKKWK; GSPPTAKKWKL; SPPTAKKWKLL;
PPTAKKWKLLP; IGFPPPCSCTF; GFPPPCSCTFC; FPPPCSCTFCD; PPPCSCTFCDP;
PPCSCTFCDPA; RLSMLVIPITS; LSMLVIPITSV; SMLVIPITSVC; MLVIPITSVCT;
LVIPITSVCTV; VIPITSVCTVT; IPITSVCTVTA; PITSVCTVTAS; ITSVCTVTASH;
TSVCTVTASHI; SVCTVTASHIS; VCTVTASHISR; CTVTASHISRF; TVTASHISRFP;
VTASHISRFPQ; TASHISRFPQV; ASHISRFPQVR; SHISRFPQVRS; HISRFPQVRSS;
ISRFPQVRSSF; SRFPQVRSSFK; RFPQVRSSFKL; FPQVRSSFKLG; PQVRSSFKLGR;
QVRSSFKLGRG; VRSSFKLGRGI; RSSFKLGRGIL; SSFKLGRGILA; SFKLGRGILAV;
FKLGRGILAVL; QGSIFLSGLSL; GSIFLSGLSLL; SIFLSGLSLLK; IFLSGLSLLKS;
FLSGLSLLKSF; LSGLSLLKSFS; SGLSLLKSFSA; GLSLLKSFSAL; LSLLKSFSALS;
SLLKSFSALSF; LLKSFSALSFR; LKSFSALSFRL; KSFSALSFRLK; SFSALSFRLKP;
FSALSFRLKPL; SALSFRLKPLR; ALSFRLKPLRF; LSFRLKPLRFS; SFRLKPLRFSS;
FRLKPLRFSSG; RLKPLRFSSGS; LKPLRFSSGSP; KPLRFSSGSPI; PLRFSSGSPIS;
LRFSSGSPISG; RFSSGSPISGF; FSSGSPISGFR; SSGSPISGFRK; SGSPISGFRKH;
GSPISGFRKHS; SPISGFRKHST; PISGFRKHSTS; ISGFRKHSTSV; SGFRKHSTSVI;
GFRKHSTSVIA; FRKHSTSVIAS; RKHSTSVIAST; KHSTSVIASTP; HSTSVIASTPV;
STSVIASTPVL; TSVIASTPVLT; SVIASTPVLTS; VIASTPVLTSR; IASTPVLTSRT;
ASTPVLTSRTS; STPVLTSRTST; TPVLTSRTSTP; PVLTSRTSTPP; VLTSRTSTPPF;
LTSRTSTPPFI; TSRTSTPPFIS; SRTSTPPFISS; RTSTPPFISSF; TSTPPFISSFG;
STPPFISSFGT; TPPFISSFGTC; PPFISSFGTCT; PFISSFGTCTG; FISSFGTCTGS;
ISSFGTCTGSF; SSFGTCTGSFG; SFGTCTGSFGF; FGTCTGSFGFL; GTCTGSFGFLG;
TCTGSFGFLGA; CTGSFGFLGAA; TGSFGFLGAAP; GSFGFLGAAPG; SFGFLGAAPGH;
FGFLGAAPGHS; GFLGAAPGHSP; FLGAAPGHSPF; LGAAPGHSPFL; GAAPGHSPFLL;
AAPGHSPFLLV; APGHSPFLLVG; PGHSPFLLVGA; GHSPFLLVGAI; HSPFLLVGAIF;
SPFLLVGAIFI; PFLLVGAIFIC; FLLVGAIFICF; LLVGAIFICFK; LVGAIFICFKS;
VGAIFICFKSR; GAIFICFKSRC; AIFICFKSRCY; IFICFKSRCYS; FICFKSRCYSP;
ICFKSRCYSPV; CFKSRCYSPVQ; FKSRCYSPVQA; RQHPLRSSSLI; QHPLRSSSLIS;
HPLRSSSLIST; PLRSSSLISTS; LRSSSLISTSW; RSSSLISTSWG; SSSLISTSWGN;
SSLISTSWGNS; SLISTSWGNSF; LISTSWGNSFF; ISTSWGNSFFY; STSWGNSFFYK;
TSWGNSFFYKL; SWGNSFFYKLS; VHSLCNFFYTV; HSLCNFFYTVS; SLCNFFYTVSI;
LCNFFYTVSII; CNFFYTVSIIY; NFFYTVSIIYT; FFYTVSIIYTI; FYTVSIIYTIS;
YTVSIIYTISM; TVSIIYTISMA; VSIIYTISMAK; IIYTISMAKMY;
IYTISMAKMYT; YTISMAKMYTG; TISMAKMYTGT; ISMAKMYTGTF; SMAKMYTGTFP;
MAKMYTGTFPF; AKMYTGTFPFS; KMYTGTFPFSY; MYTGTFPFSYL; YTGTFPFSYLS;
TGTFPFSYLSN; GTFPFSYLSNH; GPNRGKIRIIL; PNRGKIRIILL; NRGKIRIILLN;
RGKIRIILLNI; GKIRIILLNII; KIRIILLNIII; IRIILLNIIIK; RIILLNIIIKV;
IILLNIIIKVY; ILLNIIIKVYR; LLNIIIKVYRG; LNIIIKVYRGI; NIIIKVYRGIY;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

IIIKVYRGIYN; IIKVYRGIYNC; IKVYRGIYNCP; KVYRGIYNCPG; VYRGIYNCPGS;
YRGIYNCPGSF; RGIYNCPGSFL; GIYNCPGSFLQ; IYNCPGSFLQK; YNCPGSFLQKS;
NCPGSFLQKSS; CPGSFLQKSSQ; PGSFLQKSSQG; GSFLQKSSQGV; SFLQKSSQGVS;
FLQKSSQGVSK; LQKSSQGVSKK; QKSSQGVSKKS; KSSQGVSKKSF; SSQGVSKKSFC;
SQGVSKKSFCS; QGVSKKSFCSS; GVSKKSFCSSL; VSKKSFCSSLQ; SKKSFCSSLQF;
KKSFCSSLQFL; GYRRYIIPNNM; YRRYIIPNNMP; RRYIIPNNMPQ; RYIIPNNMPQS;
YIIPNNMPQSL; IIPNNMPQSLG; IPNNMPQSLGN; PNNMPQSLGNS; NNMPQSLGNSS;
NMPQSLGNSSK; MPQSLGNSSKQ; PQSLGNSSKQR; QSLGNSSKQRR; SLGNSSKQRRT;
LGNSSKQRRTP; GNSSKQRRTPM; NSSKQRRTPMP; SSKQRRTPMPR; SKQRRTPMPRI;
KQRRTPMPRIK; QRRTPMPRIKV; RRTPMPRIKVL; RTPMPRIKVLN; TPMPRIKVLNI;
PMPRIKVLNII; MPRIKVLNIIN; PRIKVLNIINK; RIKVLNIINKS; IKVLNIINKSI;
KVLNIINKSIY; VLNIINKSIYT; LNIINKSIYTR; NIINKSIYTRK; IINKSIYTRKQ;
INKSIYTRKQN; NKSIYTRKQNI; KSIYTRKQNII; SIYTRKQNIIV; IYTRKQNIIVL;
YTRKQNIIVLI; TRKQNIIVLIW; RKQNIIVLIWV; KQNIIVLIWVK; QNIIVLIWVKQ;
NIIVLIWVKQF; IIVLIWVKQFQ; IVLIWVKQFQS; VLIWVKQFQSH; LIWVKQFQSHA;
LLIEAYSGNFV; LIEAYSGNFVI; IEAYSGNFVIP; EAYSGNFVIPI; AYSGNFVIPII;
YSGNFVIPIIK; SGNFVIPIIKE; GNFVIPIIKEL; NFVIPIIKELI; FVIPIIKELIP;
VIPIIKELIPY; IPIIKELIPYL; PIIKELIPYLS; SSKPSNSPRST; SKPSNSPRSTS;
KPSNSPRSTSN; PSNSPRSTSNY; SNSPRSTSNYS; NSPRSTSNYSI; SPRSTSNYSIC;
PRSTSNYSICL; RSTSNYSICLR; STSNYSICLRS; GTCYALYSSKG; TCYALYSSKGC;
CYALYSSKGCN; YALYSSKGCNL; ALYSSKGCNLN; LYSSKGCNLNF; YSSKGCNLNFY;
SSKGCNLNFYS; SKGCNLNFYSS; KGCNLNFYSSS; GCNLNFYSSSS; CNLNFYSSSSL;
NLNFYSSSSLP; LNFYSSSSLPS; NFYSSSSLPSS; FYSSSSLPSSN; YSSSSLPSSNF;
SSSSLPSSNFS; SSSLPSSNFSH; KSCGSSSLRYT; SCGSSSLRYTG; CGSSSLRYTGN;
SSTHEPGNTKK; STHEPGNTKKK; THEPGNTKKKG; HEPGNTKKKGL; EPGNTKKKGLL;
PGNTKKKGLLT; ESFTESFTAGK; SFTESFTAGKA; FTESFTAGKAV; TESFTAGKAVV;
ESFTAGKAVVL; SFTAGKAVVLL; FTAGKAVVLLF; TAGKAVVLLFF; AGKAVVLLFFP;
GKAVVLLFFPS; KAVVLLFFPST; AVVLLFFPSTL; VVLLFFPSTLS; VLLFFPSTLSS;
LLFFPSTLSSP; LFFPSTLSSPL; FFPSTLSSPLQ; FPSTLSSPLQN; PSTLSSPLQNS;
STLSSPLQNSS; TLSSPLQNSSK; LSSPLQNSSKS; SSPLQNSSKSS; SPLQNSSKSSK;
PLQNSSKSSKI; LQNSSKSSKIK; QNSSKSSKIKI; NSSKSSKIKIK; SSKSSKIKIKI;
SKSSKIKIKIL; ALFFVPVQVLP; LFFVPVQVLPT; FFVPVQVLPTF; FVPVQVLPTFT;
VPVQVLPTFTE; PVQVLPTFTEA; VQVLPTFTEAC; QVLPTFTEACR; VLPTFTEACRD;
LPTFTEACRDS; PTFTEACRDSW; TFTEACRDSWR; FTEACRDSWRR; TEACRDSWRRT;
EACRDSWRRTM; ACRDSWRRTMA; CRDSWRRTMAF; RDSWRRTMAFV; DSWRRTMAFVQ;
SWRRTMAFVQF; WRRTMAFVQFN; RRTMAFVQFNW; RTMAFVQFNWG; TMAFVQFNWGQ;
MAFVQFNWGQG; AFVQFNWGQGQ; FVQFNWGQGQD; VQFNWGQGQDS; ARKTCLSCTFL;
RKTCLSCTFLP; KTCLSCTFLPE; TCLSCTFLPEV; CLSCTFLPEVM; LSCTFLPEVMV;
SCTFLPEVMVW; CTFLPEVMVWL; TFLPEVMVWLH; FLPEVMVWLHS; LPEVMVWLHSM;
PEVMVWLHSMG; EVMVWLHSMGK; VMVWLHSMGKQ; MVWLHSMGKQL; VWLHSMGKQLL;
WLHSMGKQLLP; LHSMGKQLLPV; HSMGKQLLPVS; SMGKQLLPVSH; MGKQLLPVSHA;
GKQLLPVSHAL; KQLLPVSHALS; QLLPVSHALSF; LLPVSHALSFL; LPVSHALSFLR;
PVSHALSFLRS; VSHALSFLRSW; SHALSFLRSWF; HALSFLRSWFG; ALSFLRSWFGC;
LSFLRSWFGCI; SFLRSWFGCIP; FLRSWFGCIPL; AAPPCGLFFYN; APPCGLFFYNI;
EAEAASASTLS; AEAASASTLSL; EAASASTLSLK; GLAKLFGEIPI; LAKLFGEIPIL;
AKLFGEIPILL; KLFGEIPILLQ; LFGEIPILLQF; FGEIPILLQFL; GEIPILLQFLQ

BK virus complementary reading frame 2

8 mers:

WIKFLTGK; IKFLTGKN; KFLTGKNP; FLTGKNPW; LTGKNPWS; TGKNPWSS; GKNPWSSW;
KNPWSSWT; NPWSSWTF; ALKELPGE; LKELPGEI; KELPGEIF; ELPGEIFP; GSVRNFTL;
SVRNFTLT; VRNFTLTK; RNFTLTKG; NFTLTKGA; FTLTKGAT; TLTKGATR; LTKGATRI;
TKGATRIK; ILCIKKWS; LCIKKWSR; CIKKWSRM; LISLILEP; ISLILEPG; SLILEPGV;
LILEPGVA; ILEPGVAQ; LEPGVAQR; EPGVAQRF; PGVAQRFV; GVAQRFVL; VAQRFVLI;
AQRFVLIF; QRFVLIFL; RFVLIFLF; FVLIFLFA; VLIFLFAQ; LIFLFAQI; IFLFAQIP;
FLFAQIPC; LFAQIPCT; FAQIPCTA; AQIPCTAR; QIPCTARN; IPCTARNG; PCTARNGL;
CTARNGLF; TARNGLFV; ARNGLFVP; RNGLFVPK; NGLFVPKS; GLFVPKSL; LFVPKSLL;
FVPKSLLC; VPKSLLCT; PKSLLCTA; KSLLCTAL; SLLCTALA; LLCTALAC; LCTALACY;
CTALACYV; TALACYVS; ALACYVSL; LACYVSLD; IATALTAS; ATALTASH; TALTASHS;
ALTASHSG; LTASHSGL; TASHSGLA; LKKLCNGG; KLCNGGSK; LCNGGSKL; LEKLPSEI;
SFKVTNLY; FKVTNLYL; KVTNLYLD; VTNLYLDK; VIIFFIGA; IIFFIGAN; IFFIGANL;
FFIGANLW; FIGANLWN; IGANLWNR; GANLWNRR; ANLWNRRV; NLWNRRVG; LWNRRVGV;
WNRRVGVL; NRRVGVLV; RRVGVLVE; RVGVLVEF; VGVLVEFL; RSNSRFST; SNSRFSTL;
NSRFSTLN; SRFSTLNT; RFSTLNTT; FSTLNTTQ; STLNTTQK; TLNTTQKK; LNTTQKKK;
NTTQKKKK; TTQKKKKG; TQKKKKGR; QKKKKGRR; KKKKGRRP; NPCLLCCV; PCLLCCVY;
CLLCCVYY; KTYGKIFC; TYGKIFCN; YGKIFCNF; GKIFCNFY; YYILFNST; FLSKAVYL;
RSIPYYRR; SIPYYRRK; IPYYRRKH; PYYRRKHS; YYRRKHSR; YRRKHSRG; RRKHSRGL;
RKHSRGLK; KHSRGLKG; HSRGLKGA; RNKAGVLE; NKAGVLEI; KAGVLEIN; AGVLEINY;
GCVFIIRY; CVFIIRYV; VFIIRYVF; FIIRYVFR; IIRYVFRI; IRYVFRIS; RYVFRISI;
YVFRISIQ; VFRISIQC; FRISIQCR; RISIQCRG; ISIQCRGV; KVSEKRPA; VSEKRPAL;
SEKRPALS; EKRPALSL; KALCKCYY; ALCKCYYF; LCKCYYFC; CKCYYFCR; KCYYFCRK;
KSKKYLSA; SKKYLSAS; KKYLSASS; KYLSASSR; YLSASSRY; LSASSRYS; SASSRYSF;
ASSRYSFS; KKSRYPSY; KSRYPSYD; SRYPSYDQ; RYPSYDQG; YPSYDQGR; PSYDQGRN;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

SYDQGRNA; YDQGRNAN; DQGRNANR; QGRNANRK; GRNANRKI; RNANRKIQ; NANRKIQS;
ANRKIQSY; NRKIQSYI; RKIQSYIR; NGFNIWSS; GFNIWSSW; FNIWSSWK; NIWSSWKC;
IWSSWKCC; WSSWKCCT; SSWKCCTR; SWKCCTRT; WKCCTRTI; KCCTRTIY; CCTRTIYG;
CTRTIYGR; TRTIYGRC; RTIYGRCC; TIYGRCCL; IYGRCCLA; YGRCCLAA; GRCCLAAL;
RCCLAALF; CCLAALFA; CLAALFAT; FFALYCFQ; FALYCFQC; ALYCFQCT; WKNNTSCR;
KNNTSCRV; NNTSCRVI; NTSCRVIR; TSCRVIRF; SCRVIRFV; CRVIRFVW; RVIRFVWW;
SLKCKPTH; LKCKPTHG; KCKPTHGK; CKPTHGKA; KPTHGKAN; PTHGKANL; ARCSYRSV;
RCSYRSVH; CSYRSVHG; SYRSVHGC; YRSVHGCF; IKGFAFRT; KGFAFRTW; GFAFRTWN;
FAFRTWNK; APRTWNKQ; FRTWNKQF; RTWNKQFR; TWNKQFRQ; WNKQFRQF; NKQFRQFE;
KQFRQFER; QFRQFERL; FRQFERLF; RQFERLFR; QFERLFRW; FERLFRWK; ERLFRWKC;
GKFRKETF; KFRKETFK; FRKETFKQ; RKETFKQK; KETFKQKN; ETFKQKNP; TFKQKNPN;
FKQKNPNI; KQKNPNIS; QKNPNIST; KNPNISTR; NPNISTRL; PNISTRLG; NISTRLGY;
ISTRLGYN; STRLGYNE; AQNIFKKI; QNIFKKIL; NIFKKILT; IFKKILTK; FKKILTKL;
KKILTKLR; KILTKLRV; ILTKLRVL; LTKLRVLT; KKNFTKWN; KNFTKWND; NFTKWNDL;
FTKWNDLV; TKWNDLVA; KWNDLVAT; WNDLVATA; NDLVATAN; DLVATANL; LVATANLV;
DKYVYFFK; KYVYFFKD; YVYFFKDE; VYFFKDEI; YMHGEMYS; YYKRRGFR; YKRRGFRN;
RLWTWIKH; IPITMLFP; PITMLFPS; ITMLFPSL; TMLFPSLR; MLFPSLRY; LFPSLRYF;
FPSLRYFS; PSLRYFSP; SLRYFSPC; RFPKVRPP; NTTPKITQ; TTPKITQA; KWLIQKQH;
WLIQKQHL; LIQKQHLL; IQKQHLLN; QKQHLLNV; KQHLLNVY; QHLLNVYV; HLLNVYVQ;
KHLFKAFW; HLFKAFWF; LFKAFWFA; FKAFWFAI; KAFWFAIV; AFWFAIVP; FWFAIVPV;
WFAIVPVC; FAIVPVCQ; AIVPVCQY; IVPVCQYI; VPVCQYIL; PVCQYILS; VCQYILSY;
CQYILSYL; QYILSYLG; YILSYLGP; ILSYLGPL; LSYLGPLE; SYLGPLEV; YLGPLEVF;
LGPLEVFL; GPLEVFLC; PLEVFLCH; LEVFLCHQ; EVFLCHQT; VFLCHQTP; PLLPGIPY;
LLPGIPYH; LPGIPYHT; AAHPLSGF; AHPLSGFS; HPLSGFSC; PLSGFSCL; GHLAKRKL;
HLAKRKLG; LAKRKLGK; AKRKLGKD; KRKLGKDS; RKLGKDSL; KLGKDSLQ; LGKDSLQI;
GKDSLQIF; KDSLQIFF; DSLQIFFS; SLQIFFSG; LQIFFSGG; QIFFSGGS; NILQGLST;
ILQGLSTV; LQGLSTVV; QGLSTVVF; GLSTVVFQ; LSTVVFQS; STVVFQSC; TGHKYQQL;
GHKYQQLK; HKYQQLKH; KYQQLKHT; YQQLKHTG; QQLKHTGY; QLKHTGYQ; LKHTGYQL;
KHTGYQLY; HTGYQLYK; TGYQLYKE; GYQLYKEA; YQLYKEAP; QLYKEAPH; LYKEAPHP;
YKEAPHPV; KEAPHPVH; EAPHPVHL; APHPVHLA; PHPVHLAT; HPVHLATL; PVHLATLW;
LCWSHEVL; CWSHEVLG; WSHEVLGE; SHEVLGEH; HEVLGEHF; EVLGEHFP; VLGEHFPL;
LGEHFPLL; HFHFYWDQ; FHFYWDQV; HFYWDQVP; FYWDQVPS; YWDQVPST; WDQVPSTQ;
DQVPSTQL; QVPSTQLD; VPSTQLDK; PSTQLDKH; STQLDKHC; TQLDKHCF; QLDKHCFC;
LDKHCFCP; DKHCFCPN; KHCFCPNR; HCFCPNRP; CFCPNRPY; FCPNRPYG; CPNRPYGQ;
PNRPYGQY; NRPYGQYS; RPYGQYSL; PYGQYSLP; YGQYSLPG; GQYSLPGT; QYSLPGTG;
YSLPGTGL; SLPGTGLL; LPGTGLLG; PGTGLLGF; YHQGTLTC; HQGTLTCN; QGTLTCNS;
GTLTCNSL; TLTCNSLA; LTCNSLAL; TCNSLALP; CNSLALPA; NSLALPAF; SLALPAFP;
LALPAFPR; ALPAFPRV; LPAFPRVL; PAFPRVLH; FPRVLHLQ; PRVLHLQQ;
RVLHLQQR; VLHLQQRS; LHLQQRSG; HLQQRSGN; LQQRSGNY; QQRSGNYC; QRSGNYCL;
RSGNYCLE; VFLHHAHA; FLHHAHAL; LHHAHALF; HHAHALFV; HAHALFVT; AHALFVTL;
HALFVTLH; ALFVTLHE; LFVTLHEG; PLFVQLQP; LFVQLQPP; FVQLQPPT; VQLQPPTS;
QLQPPTSV; LQPPTSVD; QPPTSVDF; PPTSVDFH; PTSVDFHR; TSVDFHRL; SVDFHRLG;
VDFHRLGP; DFHRLGPH; FHRLGPHL; HRLGPHLN; RLGPHLNW; LGPHLNWG; GPHLNWGG;
PHLNWGGE; HLNWGGEF; LNWGGEFL; NWGGEFLL; WGGEFLLC; GGEFLLCC; GEFLLCCN;
EFLLCCNR; FLLCCNRE; LLCCNREA; LCCNREAF; CCNREAFF; CNREAFFS; NREAFFSL;
REAFFSLG; EAFFSLGY; AFFSLGYH; FFSLGYHC; SHFQHLAL; HFQHLALD; FQHLALDP;
FHLDPPFL; HLDPPFLG; LDPPFLGL; DPPFLGLG; PPFLGLGS; PFLGLGSI; FLGLGSIL;
LGLGSILP; GLGSILPL; LLELLLLL; LELLLLLL; ELLLLLLL; LLLLLLLV; LLLLLLVV;
LLLLLVVL; LLLLVVLA; LLLVVLAL; LLVVLALA; LVVLALAR; VVLALARV; VLALARVP;
LALARVPL; ALARVPLA; LARVPLAF; ARVPLAFW; RVPLAFWE; VPLAFWEL; PLAFWELP;
LAFWELPL; AFWELPLD; FWELPLDT; WELPLDTL; ELPLDTLL; LPLDTLLF; PLDTLLFF;
LDTLLFFW; DTLLFFWL; TLLFFWLG; LLFFWLGP; LFFWLGPS; FFWLGPSS; FWLGPSSY;
WLGPSSYA; LGPSSYAS; GPSSYASR; PSSYASRA; SSYASRAG; SYASRAGV; YASRAGVT;
ASRAGVTV; SRAGVTVP; RAGVTVPY; AGVTVPYR; GVTVPYRP; VTVPYRPR; TVPYRPRS;
VPYRPRSK; PYRPRSKG; YRPRSKGN; RPRSKGNI; PRSKGNIH; LAPPGAIV; APPGAIVF;
PPGAIVFS; PGAIVFSI; GAIVFSIN; AIVFSINS; IVFSINSP; VFSINSPE; FSINSPEC;
SINSPECT; INSPECTL; NSPECTLC; FLKSILCV; LKSILCVT; KSILCVTS; SILCVTSS;
ILCVTSSI; LCVTSSIL; CVTSSILS; VTSSILSA; TSSILSAS; SSILSASS; SILSASSI;
ILSASSIL; VWPKCTRV; WPKCTRVP; PKCTRVPS; CTRVPSLS; TRVPSLSA;
RVPSLSAT; VPSLSATC; PSLSATCL; SLSATCLT; LSATCLTI; SATCLTIE; ATCLTIEG;
TCLTIEGL; CLTIEGLI; LTIEGLIG; TIEGLIGE; IEGLIGER; EGLIGERS; GLIGERSE;
KFIGAFTI; FIGAFTIV; IGAFTIVQ; GAFTIVQV; AFTIVQVV; FTIVQVVS; TIVQVVSS;
IVQVVSSK; VQVVSSKN; QVVSSKNL; VVSSKNLA; VSSKNLAK; SSKNLAKE; SKNLAKES;
KNLAKESL; NLAKESLK; LAKESLKN; AKESLKNL; KESLKNLS; ESLKNLSV; SLKNLSVL;
LKNLSVLL; KNLSVLLC; NLSVLLCN; LSVLLCNS; SVLLCNSC; VLLCNSCE; LLCNSCEV;
LCNSCEVI; CNSCEVIE; NSCEVIEG; SCEVIEGI; CEVIEGIS; EVIEGISS; VIEGISSL;
IEGISSLI; EGISSLIT; GISSLITC; ISSLITCH; SSLITCHK; SLITCHKA; LITCHKAW;
ITCHKAWE; TCHKAWEI; CHKAWEIV; HKAWEIVA; KAWEIVAN; AWEIVANK; WEIVANKE;
EIVANKEG; IVANKEGP; VANKEGPQ; ANKEGPQC; NKEGPQCL; KEGPQCLG; EGPQCLGS;
GPQCLGSR; PQCLGSRY; ILLTKVFT; LLTKVFTP; LTKVFTPG; TKVFTPGN; KVFTPGNR;
VFTPGNRI; FTPGNRIS; YSSGLNNS; SSGLNNSK; SGLNNSKA; GLNNSKAM; LNNSKAMP;
NNSKAMPD; NSKAMPDC; SQSSKNLY; QSSKNLYP; SSKNLYPT; AKELIPLT; KELIPLTV;
IKAANPAI; KAANPAIA; AANPAIAP; ANPAIAPG; NPAIAPGA; PAIAPGAP; AIAPGAPA;
IAPGAPAI; APGAPAIT; PGAPAITA; GAPAITAY; APAITAYV; GVRPIAAI; VRPIAAIA;
RPIAAIAS; PIAAIASE; IAAIASEV; AAIASEVL; AIASEVLV; IASEVLVM; ASEVLVMP;
SEVLVMPS; EVLVMPST; VLVMPSTV; LVMPSTVA; VMPSTVAR; MPSTVARD; PSTVARDA;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

STVARDAI; TSIAAAAS; SIAAAASP; IAAAASPA; AAAASPAA; AASPAAI; ASPAAIS;
ASPAAISA; SPAAISAT; PAAISATE; AAISATEN; AISATENP; ISATENPV; SATENPVA;
ATENPVAA; TENPVAAA; ENPVAAAA; NPVAAAAS; PVAAAASD; VAAAASDT; AAAASDTL;
AAASDTLA; AASDTLAT; ASDTLATR; SDTLATRS; DTLATRSP; TLATRSPK; LATRSPKS;
ATRSPKSA; TRSPKSAR; RSPKSARA; SPKSARAA; PKSARAAP; KSARAAPM; SARAAPMN;
ARAAPMNL; RAAPMNLE; AAPMNLEI; APMNLEIQ; PMNLEIQK; MNLEIQKK; NLEIQKKR;
LEIQKKRD; EIQKKRDY; IQKKRDYL; QKKRDYLP; KKRDYLPR; KRDYLPRS; RDYLPRSL;
DYLPRSLL; YLPRSLLQ; LPRSLLQS; PRSLLQSL; RSLLQSLL; SLLQSLLQ; LLQSLLQQ;
LQSLLQQV; QSLLQQVK; SLLQQVKQ; LLQQVKQW; LQQVKQWY; QVKQWYF; QVKQWYFC;
VKQWYFCF; KQWYFCFS; QWYFCFSR; WYFCFSRL; YFCFSRLH; FCFSRLHC; CFSRLHCL;
FSRLHCLH; SRLHCLHL; RLHCLHLY; LHCLHLYK; HCLHLYKI; CLHLYKIP; LHLYKIPA;
HLYKIPAK; LYKIPAKA; YKIPAKAL; KIPAKALK; KSSELFFL; SSELFFLF; SELFFLFQ;
ELFFLFQS; LFFLFQSR; FFLFQSRF; FLFQSRFY; LFQSRFYQ; FQSRFYQL; QSRFYQLS;
SRFYQLSL; RFYQLSLK; FYQLSLKL; YQLSLKLV; QLSLKLVV; LSLKLVVT; SLKLVVTA;
LKLVVTAG; KLVVTAGA; LVVTAGAE; VVTAGAEP; VTAGAEPW; TAGAEPWP; AGAEPWPL;
GAEPWPLS; AEPWPLSS; EPWPLSSL; PWPLSSLT; WPLSSLTG; PLSSLTGD; LSSLTGDK;
SSLTGDKA; SLTGDKAK; LTGDKAKI; TGDKAKIP; GDKAKIPR; DKAKIPRL; KAKIPRLA;
AKIPRLAK; KIPRLAKH; IPRLAKHV; PRLAKHVC; RLAKHVCH; LAKHVCHA; AKHVCHAL;
KHVCHALS; HVCHALSF; VCHALSFL; CHALSFLR; HALSFLRS; ALSFLRSW; LSFLRSWF;
SFLRSWFG; FLRSWFGC; LRSWFGCI; RSWFGCIP; SWFGCIPW; WFGCIPWV; FGCIPWVS;
GCIPWVSS; CIPWVSSS; IPWVSSSS; PWVSSSSL; GHGLAAFP; HGLAAFPC; GLAAFPCE;
LAAFPCES; AAFPCESC; AFPCESCT; FPCESCTF; PCESCTFL; CESCTFLP; ESCTFLPE;
SCTFLPEV; CTFLPEVM; TFLPEVMV; FLPEVMVW; LPEVMVWL; PEVMVWLH; EVMVWLHS;
VMVWLHSM; MVWLHSMG; VWLHSMGK; WLHSMGKQ; LHSMGKQL; HSMGKQLL; SMGKQLLP;
MGKQLLPV; GKQLLPVA; KQLLPVAF; QLLPVAFF; LLPVAFFF; LPVAFFFI; PVAFFFII;
VAFFFIIY; AFFFIIYK; FFFIIYKR; FFIIYKRP; FIIYKRPR; IIYKRPRP; IYKRPRPP;
YKRPRPPL; KRPRPPLP; RPRPPLPP; PRPPLPPP; RPPLPPPF; PPLPPPFL; PLPPPFLS;
LPPPFLSS; PPPFLSSS; PPFLSSSK; PFLSSSKG; FLSSSKGV; LSSSKGVE; SSSKGVEA;
SSKGVEAF; SKGVEAFS; KGVEAFSE; GVEAFSEA; QNYLGKSL; NYLGKSLF; YLGKSLFF;
LGKSLFFC; GKSLFFCN; KSLFFCNF; SLFFCNFC; LFFCNFCK 9 mers:

WIKFLTGKN; IKFLTGKNP; KFLTGKNPW; FLTGKNPWS; LTGKNPWSS; TGKNPWSSW;
GKNPWSSWT; KNPWSSWTF; ALKELPGEI; LKELPGEIF; KELPGEIFP; GSVRNFTLT;
SVRNFTLTK; VRNFTLTKG; RNFTLTKGA; NFTLTKGAT; FTLTKGATR; TLTKGATRI;
LTKGATRIK; ILCIKKWSR; LCIKKWSRM; LISLILEPG; ISLILEPGV; SLILEPGVA;
LILEPGVAQ; ILEPGVAQR; LEPGVAQRF; EPGVAQRFV; PGVAQRFVL; GVAQRFVLI;
VAQRFVLIF; AQRFVLIFL; QRFVLIFLF; RFVLIFLFA; FVLIFLFAQ; VLIFLFAQI;
LIFLFAQIP; IFLFAQIPC; FLFAQIPCT; LFAQIPCTA; FAQIPCTAR; AQIPCTARN;
QIPCTARNG; IPCTARNGL; PCTARNGLF; CTARNGLFV; TARNGLFVP; ARNGLFVPK;
RNGLFVPKS; NGLFVPKSL; GLFVPKSLL; LFVPKSLLC; FVPKSLLCT; VPKSLLCTA;
PKSLLCTAL; KSLLCTALA; SLLCTALAC; LLCTALACY; LCTALACYV; CTALACYVS;
TALACYVSL; ALACYVSLD; IATALTASH; ATALTASHS; TALTASHSG; ALTASHSGL;
LTASHSGLA; LKKLCNGGS; KKLCNGGSK; SFKVTNLYL; FKVTNLYLD; KVTNLYLDK;
VIIFFIGAN; IIFFIGANL; IFFIGANLW; FFIGANLWN; FIGANLWNR; IGANLWNRR;
GANLWNRRV; ANLWNRRVG; NLWNRRVGV; LWNRRVGVL; WNRRVGVLV; NRRVGVLVE;
RRVGVLVEF; RVGVLVEFL; RSNSRFSTL; SNSRFSTLN; NSRFSTLNT; SRFSTLNTT;
RFSTLNTTQ; FSTLNTTQK; STLNTTQKK; TLNTTQKKK; LNTTQKKKK; NTTQKKKKG;
TTQKKKKGR; TQKKKKGRR; QKKKKGRRP; NPCLLCCVY; PCLLCCVYY; KTYGKIFCN;
TYGKIFCNF; YGKIFCNFY; RSIPYYRRK; SIPYYRRKH; IPYYRRKHS; PYYRRKHSR;
YYRRKHSRG; YRRKHSRGL; RRKHSRGLK; RKHSRGLKG; KHSRGLKGA; RNKAGVLEI;
NKAGVLEIN; KAGVLEINY; GCVFIIRYV; CVFIIRYVF; VFIIRYVFR; FIIRYVFRI;
IIRYVFRIS; IRYVFRISI; RYVFRISIQ; YVFRISIQC; VFRISIQCR; FRISIQCRG;
RISIQCRGV; KVSEKRPAL; VSEKRPALS; SEKRPALSL; KALCKCYYF; ALCKCYYFC;
LCKCYYFCR; CKCYYFCRK; KSKKYLSAS; SKKYLSASS; KKYLSASSR; KYLSASSRY;
YLSASSRYS; LSASSRYSF; SASSRYSFS; KKSRYPSYD; KSRYPSYDQ; SRYPSYDQG;
RYPSYDQGR; YPSYDQGRN; PSYDQGRNA; SYDQGRNAN; YDQGRNANR; DQGRNANRK;
QGRNANRKI; GRNANRKIQ; RNANRKIQS; NANRKIQSY; ANRKIQSYI; NRKIQSYIR;
NGFNIWSSW; GFNIWSSWK; FNIWSSWKC; NIWSSWKCC; IWSSWKCCT; WSSWKCCTR;
SSWKCCTRT; SWKCCTRTI; WKCCTRTIY; KCCTRTIYG; CCTRTIYGR; CTRTIYGRC;
TRTIYGRCC; RTIYGRCCL; TIYGRCCLA; IYGRCCLAA; YGRCCLAAL; GRCCLAALF;
RCCLAALFA; CCLAALFAT; FFALYCFQC; FALYCFQCT; WKNNTSCRV; KNNTSCRVI;
NNTSCRVIR; NTSCRVIRF; TSCRVIRFV; SCRVIRFVW; CRVIRFVWW; SLKCKPTHG;
LKCKPTHGK; KCKPTHGKA; CKPTHGKAN; KPTHGKANL; ARCSYRSVH; RCSYRSVHG;
CSYRSVHGC; SYRSVHGCF; IKGFAFRTW; KGFAFRTWN; GFAFRTWNK; FAFRTWNKQ;
AFRTWNKQF; FRTWNKQFR; RTWNKQFRQ; TWNKQFRQF; WNKQFRQFE; NKQFRQFER;
KQFRQFERL; QFRQFERLF; FRQFERLFR; RQFERLFRW; QFERLFRWK; FERLFRWKC;
GKFRKETFK; KFRKETFKQ; FRKETFKQK; RKETFKQKN; KETFKQKNP; ETFKQKNPN;
TFKQKNPNI; FKQKNPNIS; KQKNPNIST; QKNPNISTR; KNPNISTRL; NPNISTRLG;
PNISTRLGY; NISTRLGYN; ISTRLGYNE; AQNIFKKIL; QNIFKKILT; NIFKKILTK;
IFKKILTKL; FKKILTKLR; KKILTKLRV; KILTKLRVL; ILTKLRVLT; KKNFTKWND;
KNFTKWNDL; NFTKWNDLV; FTKWNDLVA; TKWNDLVAT; KWNDLVATA; WNDLVATAN;
NDLVATANL; DLVATANLV; DKYVYFFKD; KYVYFFKDE; YVYFFKDEI; YYKRRGFRN;
IPITMLFPS; PITMLFPSL; ITMLFPSLR; TMLFPSLRY; MLFPSLRYF; LFPSLRYFS;
FPSLRYFSP; PSLRYFSPC; NTTPKITQA; KWLIQKQHL; WLIQKQHLL; LIQKQHLLN;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

IQKQHLLNV; QKQHLLNVY; KQHLLNVYV; QHLLNVYVQ; KHLFKAFWF; HLFKAFWFA;
LFKAFWFAI; FKAFWFAIV; KAFWFAIVP; AFWFAIVPV; FWFAIVPVC; WFAIVPVCQ;
FAIVPVCQY; AIVPVCQYI; IVPVCQYIL; VPVCQYILS; PVCQYILSY; VCQYILSYL;
CQYILSYLG; QYILSYLGP; YILSYLGPL; ILSYLGPLE; LSYLGPLEV; SYLGPLEVF;
YLGPLEVFL; LGPLEVFLC; GPLEVFLCH; PLEVFLCHQ; LEVFLCHQT; EVFLCHQTP;
PLLPGIPYH; LLPGIPYHT; AAHPLSGFS; AHPLSGFSC; HPLSGFSCL; GHLAKRKLG;
HLAKRKLGK; LAKRKLGKD; AKRKLGKDS; KRKLGKDSL; RKLGKDSLQ; KLGKDSLQI;
LGKDSLQIF; GKDSLQIFF; KDSLQIFFS; DSLQIFFSG; SLQIFFSGG; LQIFFSGGS;
NILQGLSTV; ILQGLSTVV; LQGLSTVVF; QGLSTVVFQ; GLSTVVFQS; LSTVVFQSC;
TGHKYQQLK; GHKYQQLKH; HKYQQLKHT; KYQQLKHTG; YQQLKHTGY; QQLKHTGYQ;
QLKHTGYQL; LKHTGYQLY; KHTGYQLYK; HTGYQLYKE; TGYQLYKEA; GYQLYKEAP;
YQLYKEAPH; QLYKEAPHP; LYKEAPHPV; YKEAPHPVH; KEAPHPVHL; EAPHPVHLA;
APHPVHLAT; PHPVHLATL; HPVHLATLW; LCWSHEVLG; CWSHEVLGE; WSHEVLGEH;
SHEVLGEHF; HEVLGEHFP; EVLGEHFPL; VLGEHFPLL; HFHFYWDQV; FHFYWDQVP;
HFYWDQVPS; FYWDQVPST; YWDQVPSTQ; WDQVPSTQL; DQVPSTQLD; QVPSTQLDK;
VPSTQLDKH; PSTQLDKHC; STQLDKHCF; TQLDKHCFC; QLDKHCFCP; LDKHCFCPN;
DKHCFCPNR; KHCFCPNRP; HCFCPNRPY; CFCPNRPYG; FCPNRPYGQ; CPNRPYGQY;
PNRPYGQYS; NRPYGQYSL; RPYGQYSLP; PYGQYSLPG; YGQYSLPGT; GQYSLPGTG;
QYSLPGTGL; YSLPGTGLL; SLPGTGLLG; LPGTGLLGF; YHQGTLTCN; HQGTLTCNS;
QGTLTCNSL; GTLTCNSLA; TLTCNSLAL; LTCNSLALP; TCNSLALPA; CNSLALPAF;
NSLALPAFP; SLALPAFPR; LALPAFPRV; ALPAFPRVL; LPAFPRVLH; PAFPRVLHL;
AFPRVLHLQ; FPRVLHLQQ; PRVLHLQQR; RVLHLQQRS; VLHLQQRSG; LHLQQRSGN;
HLQQRSGNY; LQQRSGNYC; QQRSGNYCL; QRSGNYCLE; VFLHHAHAL; FLHHAHALF;
LHHAHALFV; HHAHALFVT; HAHALFVTL; AHALFVTLH; HALFVTLHE; ALFVTLHEG;
PLFVQLQPP; LFVQLQPPT; FVQLQPPTS; VQLQPPTSV; QLQPPTSVD; LQPPTSVDF;
QPPTSVDFH; PPTSVDFHR; PTSVDFHRL; TSVDFHRLG; SVDFHRLGP; VDFHRLGPH;
DFHRLGPHL; FHRLGPHLN; HRLGPHLNW; RLGPHLNWG; LGPHLNWGG; GPHLNWGGE;
PHLNWGGEF; HLNWGGEFL; LNWGGEFLL; NWGGEFLLC; WGGEFLLCC; GGEFLLCCN;
GEFLLCCNR; EFLLCCNRE; FLLCCNREA; LLCCNREAF; LCCNREAFF; CCNREAFFS;
CNREAFFSL; NREAFFSLG; REAFFSLGY; EAFFSLGYH; AFFSLGYHC; SHFQHLALD;
GFHLDPPFL; FHLDPPFLG; HLDPPFLGL; LDPPFLGLG; DPPFLGLGS; PPFLGLGSI;
PFLGLGSIL; FLGLGSILP; LGLGSILPL; LLELLLLLL; LELLLLLLV; ELLLLLLLV;
LLLLLLLVV; LLLLLLVVL; LLLLLVVLA; LLLVVLAL; LLVVLALA; LLVVLALAR;
LVVLALARV; VVLALARVP; VLALARVPL; LALARVPLA; ALARVPLAF; LARVPLAFW;
ARVPLAFWE; RVPLAFWEL; VPLAFWELP; PLAFWELPL; LAFWELPLD; AFWELPLDT;
FWELPLDTL; WELPLDTLL; ELPLDTLLF; LPLDTLLFF; PLDTLLFFW; LDTLLFFWL;
DTLLFFWLG; TLLFFWLGP; LLFFWLGPS; LFFWLGPSS; FFWLGPSSY; FWLGPSSYA;
WLGPSSYAS; LGPSSYASR; GPSSYASRA; PSSYASRAG; SSYASRAGV; SYASRAGVT;
YASRAGVTV; ASRAGVTVP; SRAGVTVPY; RAGVTVPYR; AGVTVPYRP; GVTVPYRPR;
VTVPYRPRS; TVPYRPRSK; VPYRPRSKG; PYRPRSKGN; YRPRSKGNI; RPRSKGNIH;
LAPPGAIVF; APPGAIVFS; PPGAIVFSI; PGAIVFSIN; GAIVFSINS; AIVFSINSP;
IVFSINSPE; VFSINSPEC; FSINSPECT; SINSPECTL; INSPECTLC; FLKSILCVT;
LKSILCVTS; KSILCVTSS; SILCVTSSI; ILCVTSSIL; LCVTSSILS; CVTSSILSA;
VTSSILSAS; TSSILSASS; SSILSASSI; SILSASSIL; VWPKCTRVP; WPKCTRVPS;
PKCTRVPSL; KCTRVPSLS; CTRVPSLSA; TRVPSLSAT; RVPSLSATC; VPSLSATCL;
PSLSATCLT; SLSATCLTI; LSATCLTIE; SATCLTIEG; ATCLTIEGL; TCLTIEGLI;
CLTIEGLIG; LTIEGLIGE; TIEGLIGER; IEGLIGERS; EGLIGERSE; KFIGAFTIV;
FIGAFTIVQ; IGAFTIVQV; GAFTIVQVV; AFTIVQVVS; FTIVQVVSS; TIVQVVSSK;
IVQVVSSKN; VQVVSSKNL; QVVSSKNLA; VVSSKNLAK; VSSKNLAKE; SSKNLAKES;
SKNLAKESL; KNLAKESLK; NLAKESLKN; LAKESLKNL; AKESLKNLS; KESLKNLSV;
ESLKNLSVL; SLKNLSVLL; LKNLSVLLC; KNLSVLLCN; NLSVLLCNS; LSVLLCNSC;
SVLLCNSCE; VLLCNSCEV; LLCNSCEVI; LCNSCEVIE; CNSCEVIEG; NSCEVIEGI;
SCEVIEGIS; CEVIEGISS; EVIEGISSL; VIEGISSLI; IEGISSLIT; EGISSLITC;
GISSLITCH; ISSLITCHK; SSLITCHKA; SLITCHKAW; LITCHKAWE; ITCHKAWEI;
TCHKAWEIV; CHKAWEIVA; HKAWEIVAN; KAWEIVANK; AWEIVANKE; WEIVANKEG;
EIVANKEGP; IVANKEGPQ; VANKEGPQC; ANKEGPQCL; NKEGPQCLG; KEGPQCLGS;
EGPQCLGSR; GPQCLGSRY; ILLTKVFTP; LLTKVFTPG; LTKVFTPGN; TKVFTPGNR;
KVFTPGNRI; VFTPGNRIS; YSSGLNNSK; SSGLNNSKA; SGLNNSKAM; GLNNSKAMP;
LNNSKAMPD; NNSKAMPDC; SQSSKNLYP; QSSKNLYPT; AKELIPLTV; IKAANPAIA;
KAANPAIAP; AANPAIAPG; ANPAIAPGA; NPAIAPGAP; PAIAPGAPA; AIAPGAPAI;
IAPGAPAIT; APGAPAITA; PGAPAITAY; GAPAITAYV; GVRPIAAIA; VRPIAAIAS;
RPIAAIASE; PIAAIASEV; IAAIASEVL; AAIASEVLV; AIASEVLVM; IASEVLVMP;
ASEVLVMPS; SEVLVMPST; EVLVMPSTV; VLVMPSTVA; LVMPSTVAR; VMPSTVARD;
MPSTVARDA; PSTVARDAI; TSIAAAASP; SIAAAASPA; IAAAASPAA; AAAASPAAI;
AAASPAAIS; AASPAAISA; ASPAAISAT; SPAAISATE; PAAISATEN; AAISATENP;
AISATENPV; ISATENPVA; SATENPVAA; ATENPVAAA; TENPVAAAA; ENPVAAAAS;
NPVAAAASD; PVAAAASDT; VAAAASDTL; AAAASDTLA; AAASDTLAT; AASDTLATR;
ASDTLATRS; SDTLATRSP; DTLATRSPK; TLATRSPKS; LATRSPKSA; ATRSPKSAR;
TRSPKSARA; RSPKSARAA; SPKSARAAP; PKSARAAPM; KSARAAPMN; SARAAPMNL;
ARAAPMNLE; RAAPMNLEI; AAPMNLEIQ; APMNLEIQK; PMNLEIQKK; MNLEIQKKR;
NLEIQKKRD; LEIQKKRDY; EIQKKRDYL; IQKKRDYLP; QKKRDYLPR; KKRDYLPRS;
KRDYLPRSL; RDYLPRSLL; DYLPRSLLQ; YLPRSLLQS; LPRSLLQSL; PRSLLQSLL;
RSLLQSLLQ; SLLQSLLQQ; LLQSLLQQV; LQSLLQQVK; QSLLQQVKQ; SLLQQVKQW;
LLQQVKQWY; LQQVKQWYF; QQVKQWYFC; QVKQWYFCF; VKQWYFCFS; KQWYFCFSR;
QWYFCFSRL; WYFCFSRLH; YFCFSRLHC; FCFSRLHCL; CFSRLHCLH; FSRLHCLHL;
SRLHCLHLY; RLHCLHLYK; LHCLHLYKI; HCLHLYKIP; CLHLYKIPA; LHLYKIPAK;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

HLYKIPAKA; LYKIPAKAL; YKIPAKALK; KSSELFFLF; SSELFFLFQ; SELFFLFQS;
ELFFLFQSR; LFFLFQSRF; FFLFQSRFY; FLFQSRFYQ; LFQSRFYQL; FQSRFYQLS;
QSRFYQLSL; SRFYQLSLK; RFYQLSLKL; FYQLSLKLV; YQLSLKLVV; QLSLKLVVT;
LSLKLVVTA; SLKLVVTAG; LKLVVTAGA; KLVVTAGAE; LVVTAGAEP; VVTAGAEPW;
VTAGAEPWP; TAGAEPWPL; AGAEPWPLS; GAEPWPLSS; AEPWPLSSL; EPWPLSSLT;
PWPLSSLTG; WPLSSLTGD; PLSSLTGDK; LSSLTGDKA; SSLTGDKAK; SLTGDKAKI;
LTGDKAKIP; TGDKAKIPR; GDKAKIPRL; DKAKIPRLA; KAKIPRLAK; AKIPRLAKH;
KIPRLAKHV; IPRLAKHVC; PRLAKHVCH; RLAKHVCHA; LAKHVCHAL; AKHVCHALS;
KHVCHALSF; HVCHALSFL; VCHALSFLR; CHALSFLRS; HALSFLRSW; ALSFLRSWF;
LSFLRSWFG; SFLRSWFGC; FLRSWFGCI; LRSWFGCIP; RSWFGCIPW; SWFGCIPWV;
WFGCIPWVS; FGCIPWVSS; GCIPWVSSS; CIPWVSSSS; IPWVSSSSL; GHGLAAFPC;
HGLAAFPCE; GLAAFPCES; LAAFPCESC; AAFPCESCT; AFPCESCTF; FPCESCTFL;
PCESCTFLP; CESCTFLPE; ESCTFLPEV; SCTFLPEVM; CTFLPEVMV; TFLPEVMVW;
FLPEVMVWL; LPEVMVWLH; PEVMVWLHS; EVMVWLHSM; VMVWLHSMG; MVWLHSMGK;
VWLHSMGKQ; WLHSMGKQL; LHSMGKQLL; HSMGKQLLP; SMGKQLLPV; MGKQLLPVA;
GKQLLPVAF; KQLLPVAFF; QLLPVAFFF; LLPVAFFFI; LPVAFFFII; PVAFFFIIY;
VAFFFIIYK; AFFFIIYKR; FFFIIYKRP; FFIIYKRPR; FIIYKRPRP; IIYKRPRPP;
IYKRPRPPL; YKRPRPPLP; KRPRPPLPP; RPRPPLPPP; PRPPLPPPF; RPPLPPPFL;
PPLPPPFLS; PLPPPFLSS; LPPPFLSSS; PPPFLSSSK; PPFLSSSKG; PFLSSSKGV;
FLSSSKGVE; LSSSKGVEA; SSSKGVEAF; SSKGVEAFS; SKGVEAFSE; KGVEAFSEA;
QNYLGKSLF; NYLGKSLFF; YLGKSLFFC; LGKSLFFCN; GKSLFFCNF; KSLFFCNFC;
SLFFCNFCK 10 mers:

WIKFLTGKNP; IKFLTGKNPW; KFLTGKNPWS; FLTGKNPWSS; LTGKNPWSSW;
TGKNPWSSWT; GKNPWSSWTF; ALKELPGEIF; LKELPGEIFP; GSVRNFTLTK;
SVRNFTLTKG; VRNFTLTKGA; RNFTLTKGAT; NFTLTKGATR; FTLTKGATRI;
TLTKGATRIK; ILCIKKWSRM; LISLILEPGV; ISLILEPGVA; SLILEPGVAQ;
LILEPGVAQR; ILEPGVAQRF; LEPGVAQRFV; EPGVAQRFVL; PGVAQRFVLI;
GVAQRFVLIF; VAQRFVLIFL; AQRFVLIFLF; QRFVLIFLFA; RFVLIFLFAQ;
FVLIFLFAQI; VLIFLFAQIP; LIFLFAQIPC; IFLFAQIPCT; FLFAQIPCTA;
LFAQIPCTAR; FAQIPCTARN; AQIPCTARNG; QIPCTARNGL; IPCTARNGLF;
PCTARNGLFV; CTARNGLFVP; TARNGLFVPK; ARNGLFVPKS; RNGLFVPKSL;
NGLFVPKSLL; GLFVPKSLLC; LFVPKSLLCT; FVPKSLLCTA; VPKSLLCTAL;
PKSLLCTALA; KSLLCTALAC; SLLCTALACY; LLCTALACYV; LCTALACYVS;
CTALACYVSL; TALACYVSLD; IATALTASHS; ATALTASHSG; TALTASHSGL;
ALTASHSGLA; LKKLCNGGSK; SFKVTNLYLD; FKVTNLYLDK; VIIFFIGANL;
IIFFIGANLW; IFFIGANLWN; FFIGANLWNR; FIGANLWNRR; IGANLWNRRV;
GANLWNRRVG; ANLWNRRVGV; NLWNRRVGVL; LWNRRVGVLV; WNRRVGVLVE;
NRRVGVLVEF; RRVGVLVEFL; RSNSRFSTLN; SNSRFSTLNT; NSRFSTLNTT;
SRFSTLNTTQ; RFSTLNTTQK; FSTLNTTQKK; STLNTTQKKK; TLNTTQKKKK;
LNTTQKKKKG; NTTQKKKKGR; TTQKKKKGRR; TQKKKKGRRP; NPCLLCCVYY;
KTYGKIFCNF; TYGKIFCNFY; RSIPYYRRKH; SIPYYRRKHS; IPYYRRKHSR;
PYYRRKHSRG; YYRRKHSRGL; YRRKHSRGLK; RRKHSRGLKG; RKHSRGLKGA;
RNKAGVLEIN; NKAGVLEINY; GCVFIIRYVF; CVFIIRYVFR; VFIIRYVFRI;
FIIRYVFRIS; IIRYVFRISI; IRYVFRISIQ; RYVFRISIQC; YVFRISIQCR;
VFRISIQCRG; FRISIQCRGV; KVSEKRPALS; VSEKRPALSL; KALCKCYYFC;
ALCKCYYFCR; LCKCYYFCRK; KSKKYLSASS; SKKYLSASSR; KKYLSASSRY;
KYLSASSRYS; YLSASSRYSF; LSASSRYSFS; KKSRYPSYDQ; KSRYPSYDQG;
SRYPSYDQGR; RYPSYDQGRN; YPSYDQGRNA; PSYDQGRNAN; SYDQGRNANR;
YDQGRNANRK; DQGRNANRKI; QGRNANRKIQ; GRNANRKIQS; RNANRKIQSY;
NANRKIQSYI; ANRKIQSYIR; NGFNIWSSWK; GFNIWSSWKC; FNIWSSWKCC;
NIWSSWKCCT; IWSSWKCCTR; WSSWKCCTRT; SSWKCCTRTI; SWKCCTRTIY;
WKCCTRTIYG; KCCTRTIYGR; CCTRTIYGRC; CTRTIYGRCC; TRTIYGRCCL;
RTIYGRCCLA; TIYGRCCLAA; IYGRCCLAAL; YGRCCLAALF; GRCCLAALFA;
RCCLAALFAT; FFALYCFQCT; WKNNTSCRVI; KNNTSCRVIR; NNTSCRVIRF;
NTSCRVIRFV; TSCRVIRFVW; SCRVIRFVWW; SLKCKPTHGK; LKCKPTHGKA;
KCKPTHGKAN; CKPTHGKANL; ARCSYRSVHG; RCSYRSVHGC; CSYRSVHGCF;
IKGFAFRTWN; KGFAFRTWNK; GFAFRTWNKQ; FAFRTWNKQF; AFRTWNKQFR;
FRTWNKQFRQ; RTWNKQFRQF; TWNKQFRQFE; WNKQFRQFER; NKQFRQFERL;
KQFRQFERLF; QFRQFERLFR; FRQFERLFRW; RQFERLFRWK; QFERLFRWKC;
GKFRKETFKQ; KFRKETFKQK; FRKETFKQKN; RKETFKQKNP; KETFKQKNPN;
ETFKQKNPNI; TFKQKNPNIS; FKQKNPNIST; KQKNPNISTR; QKNPNISTRL;
KNPNISTRLG; NPNISTRLGY; PNISTRLGYN; NISTRLGYNE; AQNIFKKILT;
QNIFKKILTK; NIFKKILTKL; IFKKILTKLR; FKKILTKLRV; KKILTKLRVL;
KILTKLRVLT; KKNFTKWNDL; KNFTKWNDLV; NFTKWNDLVA; FTKWNDLVAT;
TKWNDLVATA; KWNDLVATAN; WNDLVATANL; NDLVATANLV; DKYVYFFKDE;
KYVYFFKDEI; IPITMLFPSL; PITMLFPSLR; ITMLFPSLRY; TMLFPSLRYF;
MLFPSLRYFS; LFPSLRYFSP; FPSLRYFSPC; KWLIQKQHLL; WLIQKQHLLN;
LIQKQHLLNV; IQKQHLLNVY; QKQHLLNVYV; KQHLLNVYVQ; HLFKAFWFA;
HLFKAFWFAI; LFKAFWFAIV; FKAFWFAIVP; KAFWFAIVPV; AFWFAIVPVC;
FWFAIVPVCQ; WFAIVPVCQY; FAIVPVCQYI; AIVPVCQYIL; IVPVCQYILS;
VPVCQYILSY; PVCQYILSYL; VCQYILSYLG; CQYILSYLGP; QYILSYLGPL;
YILSYLGPLE; ILSYLGPLEV; LSYLGPLEVF; SYLGPLEVFL; YLGPLEVFLC;
LGPLEVFLCH; GPLEVFLCHQ; PLEVFLCHQT; LEVFLCHQTP; PLPGIPYHT;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

AAHPLSGFSC; AHPLSGFSCL; GHLAKRKLGK; HLAKRKLGKD; LAKRKLGKDS;
AKRKLGKDSL; KRKLGKDSLQ; RKLGKDSLQI; KLGKDSLQIF; LGKDSLQIFF;
GKDSLQIFFS; KDSLQIFFSG; DSLQIFFSGG; SLQIFFSGGS; NILQGLSTVV;
ILQGLSTVVF; LQGLSTVVFQ; QGLSTVVFQS; GLSTVVFQSC; TGHKYQQLKH;
GHKYQQLKHT; HKYQQLKHTG; KYQQLKHTGY; YQQLKHTGYQ; QQLKHTGYQL;
QLKHTGYQLY; LKHTGYQLYK; KHTGYQLYKE; HTGYQLYKEA; TGYQLYKEAP;
GYQLYKEAPH; YQLYKEAPHP; QLYKEAPHPV; LYKEAPHPVH; YKEAPHPVHL;
KEAPHPVHLA; EAPHPVHLAT; APHPVHLATL; PHPVHLATLW; LCWSHEVLGE;
CWSHEVLGEH; WSHEVLGEHF; SHEVLGEHFP; HEVLGEHFPL; EVLGEHFPLL;
HFHFYWDQVP; FHFYWDQVPS; HFYWDQVPST; FYWDQVPSTQ; YWDQVPSTQL;
WDQVPSTQLD; DQVPSTQLDK; QVPSTQLDKH; VPSTQLDKHC; PSTQLDKHCF;
STQLDKHCFC; TQLDKHCFCP; QLDKHCFCPN; LDKHCFCPNR; DKHCFCPNRP;
KHCFCPNRPY; HCFCPNRPYG; CFCPNRPYGQ; FCPNRPYGQY; CPNRPYGQYS;
PNRPYGQYSL; NRPYGQYSLP; RPYGQYSLPG; PYGQYSLPGT; YGQYSLPGTG;
GQYSLPGTGL; QYSLPGTGLL; YSLPGTGLLG; SLPGTGLLGF; YHQGTLTCNS;
HQGTLTCNSL; QGTLTCNSLA; GTLTCNSLAL; TLTCNSLALP; LTCNSLALPA;
TCNSLALPAF; CNSLALPAFP; NSLALPAFPR; SLALPAFPRV; LALPAFPRVL;
ALPAFPRVLH; LPAFPRVLHL; PAFPRVLHLQ; AFPRVLHLQQ; FPRVLHLQQR;
PRVLHLQQRS; RVLHLQQRSG; VLHLQQRSGN; LHLQQRSGNY; HLQQRSGNYC;
LQQRSGNYCL; QQRSGNYCLE; VFLHHAHALF; FLHHAHALFV; LHHAHALFVT;
HHAHALFVTL; HAHALFVTLH; AHALFVTLHE; HALFVTLHEG; PLFVQLQPPT;
LFVQLQPPTS; FVQLQPPTSV; VQLQPPTSVD; QLQPPTSVDF; LQPPTSVDFH;
QPPTSVDFHR; PPTSVDFHRL; PTSVDFHRLG; TSVDFHRLGP; SVDFHRLGPH;
VDFHRLGPHL; DFHRLGPHLN; FHRLGPHLNW; HRLGPHLNWG; RLGPHLNWGG;
LGPHLNWGGE; GPHLNWGGEF; PHLNWGGEFL; HLNWGGEFLL; LNWGGEFLLC;
NWGGEFLLCC; WGGEFLLCCN; GGEFLLCCNR; GEFLLCCNRE; EFLLCCNREA;
FLLCCNREAF; LLCCNREAFF; LCCNREAFFS; CCNREAFFSL; CNREAFFSLG;
NREAFFSLGY; REAFFSLGYH; EAFFSLGYHC; GFHLDPPFLG; FHLDPPFLGL;
HLDPPFLGLG; LDPPFLGLGS; DPPFLGLGSI; PPFLGLGSIL; PFLGLGSILP;
FLGLGSILPL; LLELLLLLLL; LELLLLLLLV; ELLLLLLLVV; LLLLLLLVVL;
LLLLLLVVLA; LLLLLVVLAL; LLLLVVLALA; LLLVVLALAR; LLVVLALARV;
LVVLALARVP; VVLALARVPL; VLALARVPLA; LALARVPLAF; ALARVPLAFW;
LARVPLAFWE; ARVPLAFWEL; RVPLAFWELP; VPLAFWELPL; PLAFWELPLD;
LAFWELPLDT; AFWELPLDTL; FWELPLDTLL; WELPLDTLLF; ELPLDTLLFF;
LPLDTLLFFW; PLDTLLFFWL; LDTLLFFWLG; DTLLFFWLGP; TLLFFWLGPS;
LLFFWLGPSS; LFFWLGPSSY; FFWLGPSSYA; FWLGPSSYAS; WLGPSSYASR;
LGPSSYASRA; GPSSYASRAG; PSSYASRAGV; SSYASRAGVT; SYASRAGVTV;
YASRAGVTVP; ASRAGVTVPY; SRAGVTVPYR; RAGVTVPYRP; AGVTVPYRPR;
GVTVPYRPRS; VTVPYRPRSK; TVPYRPRSKG; VPYRPRSKGN; PYRPRSKGNI;
YRPRSKGNIH; LAPPGAIVFS; APPGAIVFSI; PPGAIVFSIN; PGAIVFSINS;
GAIVFSINSP; AIVFSINSPE; IVFSINSPEC; VFSINSPECT; FSINSPECTL;
SINSPECTLC; FLKSILCVTS; LKSILCVTSS; KSILCVTSSI; SILCVTSSIL;
ILCVTSSILS; LCVTSSILSA; CVTSSILSAS; VTSSILSASS; TSSILSASSI;
SSILSASSIL; VWPKCTRVPS; WPKCTRVPSL; PKCTRVPSLS; KCTRVPSLSA;
CTRVPSLSAT; TRVPSLSATC; RVPSLSATCL; VPSLSATCLT; PSLSATCLTI;
SLSATCLTIE; LSATCLTIEG; SATCLTIEGL; ATCLTIEGLI; TCLTIEGLIG;
CLTIEGLIGE; LTIEGLIGER; TIEGLIGERS; IEGLIGERSE; KFIGAFTIVQ;
FIGAFTIVQV; IGAFTIVQVV; GAFTIVQVVS; AFTIVQVVSS; FTIVQVVSSK;
TIVQVVSSKN; IVQVVSSKNL; VQVVSSKNLA; QVVSSKNLAK; VVSSKNLAKE;
VSSKNLAKES; SSKNLAKESL; SKNLAKESLK; KNLAKESLKN; NLAKESLKNL;
LAKESLKNLS; AKESLKNLSV; KESLKNLSVL; ESLKNLSVLL; SLKNLSVLLC;
LKNLSVLLCN; KNLSVLLCNS; NLSVLLCNSC; LSVLLCNSCE; SVLLCNSCEV;
VLLCNSCEVI; LLCNSCEVIE; LCNSCEVIEG; CNSCEVIEGI; NSCEVIEGIS;
SCEVIEGISS; CEVIEGISSL; EVIEGISSLI; VIEGISSLIT; IEGISSLITC;
EGISSLITCH; GISSLITCHK; ISSLITCHKA; SSLITCHKAW; SLITCHKAWE;
LITCHKAWEI; ITCHKAWEIV; TCHKAWEIVA; CHKAWEIVAN; HKAWEIVANK;
KAWEIVANKE; AWEIVANKEG; WEIVANKEGP; EIVANKEGPQ; IVANKEGPQC;
VANKEGPQCL; ANKEGPQCLG; NKEGPQCLGS; KEGPQCLGSR; EGPQCLGSRY;
ILLTKVFTPG; LLTKVFTPGN; LTKVFTPGNR; TKVFTPGNRI; KVFTPGNRIS;
YSSGLNNSKA; SSGLNNSKAM; SGLNNSKAMP; GLNNSKAMPD; LNNSKAMPDC;
SQSSKNLYPT; IKAANPAIAP; KAANPAIAPG; AANPAIAPGA; ANPAIAPGAP;
NPAIAPGAPA; PAIAPGAPAI; AIAPGAPAIT; IAPGAPAITA; APGAPAITAY;
PGAPAITAYV; GVRPIAAIAS; VRPIAAIASE; RPIAAIASEV; PIAAIASEVL;
IAAIASEVLV; AAIASEVLVM; AIASEVLVMP; IASEVLVMPS; ASEVLVMPST;
SEVLVMPSTV; EVLVMPSTVA; VLVMPSTVAR; LVMPSTVARD; VMPSTVARDA;
MPSTVARDAI; TSIAAAASPA; SIAAAASPAA; IAAAASPAAI; AAAASPAAIS;
AAASPAAISA; AASPAAISAT; ASPAAISATE; SPAAISATEN; PAAISATENP;
AAISATENPV; AISATENPVA; ISATENPVAA; SATENPVAAA; ATENPVAAAA;
TENPVAAAAS; ENPVAAAASD; NPVAAAASDT; PVAAAASDTL; VAAAASDTLA;
AAAASDTLAT; AAASDTLATR; AASDTLATRS; ASDTLATRSP; SDTLATRSPK;
DTLATRSPKS; TLATRSPKSA; LATRSPKSAR; ATRSPKSARA; TRSPKSARAA;
RSPKSARAAP; SPKSARAAPM; PKSARAAPMN; KSARAAPMNL; SARAAPMNLE;
ARAAPMNLEI; RAAPMNLEIQ; AAPMNLEIQK; APMNLEIQKK; PMNLEIQKKR;
MNLEIQKKRD; NLEIQKKRDY; LEIQKKRDYL; EIQKKRDYLP; IQKKRDYLPR;
QKKRDYLPRS; KKRDYLPRSL; KRDYLPRSLL; RDYLPRSLLQ; DYLPRSLLQS;
YLPRSLLQSL; LPRSLLQSLL; PRSLLQSLLQ; RSLLQSLLQQ; SLLQSLLQQV;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

LLQSLLQQVK; LQSLLQQVKQ; QSLLQQVKQW; SLLQQVKQWY; LLQQVKQWYF;
LQQVKQWYFC; QQVKQWYFCF; QVKQWYFCFS; VKQWYFCFSR; KQWYFCFSRL;
QWYFCFSRLH; WYFCFSRLHC; YFCFSRLHCL; FCFSRLHCLH; CFSRLHCLHL;
FSRLHCLHLY; SRLHCLHLYK; RLHCLHLYKI; LHCLHLYKIP; HCLHLYKIPA;
CLHLYKIPAK; LHLYKIPAKA; HLYKIPAKAL; LYKIPAKALK; KSSELFFLFQ;
SSELFFLFQS; SELFFLFQSR; ELFFLFQSRF; LFFLFQSRFY; FFLFQSRFYQ;
FLFQSRFYQL; LFQSRFYQLS; FQSRFYQLSL; QSRFYQLSLK; SRFYQLSLKL;
RFYQLSLKLV; FYQLSLKLVV; YQLSLKLVVT; QLSLKLVVTA; LSLKLVVTAG;
SLKLVVTAGA; LKLVVTAGAE; KLVVTAGAEP; LVVTAGAEPW; VVTAGAEPWP;
VTAGAEPWPL; TAGAEPWPLS; AGAEPWPLSS; GAEPWPLSSL; AEPWPLSSLT;
EPWPLSSLTG; PWPLSSLTGD; WPLSSLTGDK; PLSSLTGDKA; LSSLTGDKAK;
SSLTGDKAKI; SLTGDKAKIP; LTGDKAKIPR; TGDKAKIPRL; GDKAKIPRLA;
DKAKIPRLAK; KAKIPRLAKH; AKIPRLAKHV; KIPRLAKHVC; IPRLAKHVCH;
PRLAKHVCHA; RLAKHVCHAL; LAKHVCHALS; AKHVCHALSF; KHVCHALSFL;
HVCHALSFLR; VCHALSFLRS; CHALSFLRSW; HALSFLRSWF; ALSFLRSWFG;
LSFLRSWFGC; SFLRSWFGCI; FLRSWFGCIP; LRSWFGCIPW; RSWFGCIPWV;
SWFGCIPWVS; WFGCIPWVSS; FGCIPWVSSS; GCIPWVSSSL; CIPWVSSSLL;
GHGLAAFPCE; HGLAAFPCES; GLAAFPCESC; LAAFPCESCT; AAFPCESCTF;
AFPCESCTFL; FPCESCTFLP; PCESCTFLPE; CESCTFLPEV; ESCTFLPEVM;
SCTFLPEVMV; CTFLPEVMVW; TFLPEVMVWL; FLPEVMVWLH; LPEVMVWLHS;
PEVMVWLHSM; EVMVWLHSMG; VMVWLHSMGK; MVWLHSMGKQ; VWLHSMGKQL;
WLHSMGKQLL; LHSMGKQLLP; HSMGKQLLPV; SMGKQLLPVA; MGKQLLPVAF;
GKQLLPVAFF; KQLLPVAFFF; QLLPVAFFFI; LLPVAFFFII; LPVAFFFIIY;
PVAFFFIIYK; VAFFFIIYKR; AFFFIIYKRP; FFFIIYKRPR; FFIIYKRPRP;
FIIYKRPRPP; IIYKRPRPPL; IYKRPRPPLP; YKRPRPPLPP; KRPRPPLPPP;
RPRPPLPPPF; PRPPLPPPFL; RPPLPPPFLS; PPLPPPFLSS; PLPPPFLSSS;
LPPPFLSSSK; PPPFLSSSKG; PPFLSSSKGV; PFLSSSKGVE; FLSSSKGVEA;
LSSSKGVEAF; SSSKGVEAFS; SSKGVEAFSE; SKGVEAFSEA; QNYLGKSLFF;
NYLGKSLFFC; YLGKSLFFCN; LGKSLFFCNF; GKSLFFCNFC; KSLFFCNFCK 11 mers:

WIKFLTGKNPW; IKFLTGKNPWS; KFLTGKNPWSS; FLTGKNPWSSW; LTGKNPWSSWT;
TGKNPWSSWTF; ALKELPGEIFP; GSVRNFTLTKG; SVRNFTLTKGA; VRNFTLTKGAT;
RNFTLTKGATR; NFTLTKGATRI; FTLTKGATRIK; LISLILEPGVA; ISLILEPGVAQ;
SLILEPGVAQR; LILEPGVAQRF; ILEPGVAQRFV; LEPGVAQRFVL; EPGVAQRFVLI;
PGVAQRFVLIF; GVAQRFVLIFL; VAQRFVLIFLF; AQRFVLIFLFA; QRFVLIFLFAQ;
RFVLIFLFAQI; FVLIFLFAQIP; VLIFLFAQIPC; LIFLFAQIPCT; IFLFAQIPCTA;
FLFAQIPCTAR; LFAQIPCTARN; FAQIPCTARNG; AQIPCTARNGL; QIPCTARNGLF;
IPCTARNGLFV; PCTARNGLFVP; CTARNGLFVPK; TARNGLFVPKS; ARNGLFVPKSL;
RNGLFVPKSLL; NGLFVPKSLLC; GLFVPKSLLCT; LFVPKSLLCTA; FVPKSLLCTAL;
VPKSLLCTALA; PKSLLCTALAC; KSLLCTALACY; SLLCTALACYV; LLCTALACYVS;
LCTALACYVSL; CTALACYVSLD; IATALTASHSG; ATALTASHSGL; TALTASHSGLA;
SPKVTNLYLDK; VIIFFIGANLW; IIFFIGANLWN; IFFIGANLWNR; FFIGANLWNRR;
FIGANLWNRRV; IGANLWNRRVG; GANLWNRRVGV; ANLWNRRVGVL; NLWNRRVGVLV;
LWNRRVGVLVE; WNRRVGVLVEF; NRRVGVLVEFL; RSNSRFSTLNT; SNSRFSTLNTT;
NSRFSTLNTTQ; SRFSTLNTTQK; RFSTLNTTQKK; FSTLNTTQKKK; STLNTTQKKKK;
TLNTTQKKKKG; LNTTQKKKKGR; NTTQKKKKGRR; TTQKKKKGRRP; KTYGKIFCNFY;
RSIPYYRRKHS; SIPYYRRKHSR; IPYYRRKHSRG; PYYRRKHSRGL; YYRRKHSRGLK;
YRRKHSRGLKG; RRKHSRGLKGA; RNKAGVLEINY; GCVFIIRYVFR; CVFIIRYVFRI;
VFIIRYVFRIS; FIIRYVFRISI; IIRYVFRISIQ; IRYVFRISIQC; RYVFRISIQCR;
YVFRISIQCRG; VFRISIQCRGV; KVSEKRPALSL; KALCKCYYFCR; ALCKCYYFCRK;
KSKKYLSASSR; SKKYLSASSRY; KKYLSASSRYS; KYLSASSRYSF; YLSASSRYSFS;
KKSRYPSYDQG; KSRYPSYDQGR; SRYPSYDQGRN; RYPSYDQGRNA; YPSYDQGRNAN;
PSYDQGRNANR; SYDQGRNANRK; YDQGRNANRKI; DQGRNANRKIQ; QGRNANRKIQS;
GRNANRKIQSY; RNANRKIQSYI; NANRKIQSYIR; NGFNIWSSWKC; GFNIWSSWKCC;
FNIWSSWKCCT; NIWSSWKCCTR; IWSSWKCCTRT; WSSWKCCTRTI; SSWKCCTRTIY;
SWKCCTRTIYG; WKCCTRTIYGR; KCCTRTIYGRC; CCTRTIYGRCC; CTRTIYGRCCL;
TRTIYGRCCLA; RTIYGRCCLAA; TIYGRCCLAAL; IYGRCCLAALF; YGRCCLAALFA;
GRCCLAALFAT; WKNNTSCRVIR; KNNTSCRVIRF; NNTSCRVIRFV; NTSCRVIRFVW;
TSCRVIRFVWW; SLKCKPTHGKA; LCKCKPTHGKAN; KCKPTHGKANL; ARCSYRSVHGC;
RCSYRSVHGCF; IKGFAFRTWNK; KGFAFRTWNKQ; GFAFRTWNKQF; FAFRTWNKQFR;
APRTWNKQFRQ; FRTWNKQFRQF; RTWNKQFRQFE; TWNKQFRQFER; WNKQFRQFERL;
NKQFRQFERLF; KQFRQFERLFR; QFRQFERLFRW; FRQFERLFRWK; RQFERLFRWKC;
GKFRKETFKQK; KFRKETFKQKN; FRKETFKQKNP; RKETFKQKNPN; KETFKQKNPNI;
ETFKQKNPNIS; TFKQKNPNIST; FKQKNPNISTR; KQKNPNISTRL; QKNPNISTRLG;
KNPNISTRLGY; NPNISTRLGYN; PNISTRLGYNE; AQNIFKKILTK; QNIFKKILTKL;
NIFKKILTKLR; IFKKILTKLRV; FKKILTKLRVL; KKILTKLRVLT; KKNFTKWNDLV;
KNFTKWNDLVA; NFTKWNDLVAT; FTKWNDLVATA; TKWNDLVATAN; KWNDLVATANL;
WNDLVATANLV; DKYVYFFKDEI; IPITMLFPSLR; PITMLFPSLRY; ITMLFPSLRYF;
TMLFPSLRYFS; MLFPSLRYFSP; LFPSLRYFSPC; KWLIQKQHLLN; WLIQKQHLLNV;
LIQKQHLLNVY; IQKQHLLNVYV; QKQHLLNVYVQ; KHLFKAFWFAI; HLFKAFWFAIV;
LFKAFWFAIVP; FKAFWFAIVPV; KAFWFAIVPVC; AFWFAIVPVCQ; FWFAIVPVCQY;
WFAIVPVCQYI; FAIVPVCQYIL; AIVPVCQYILS; IVPVCQYILSY; VPVCQYILSYL;
PVCQYILSYLG; VCQYILSYLGP; CQYILSYLGPL; QYILSYLGPLE; YILSYLGPLEV;
ILSYLGPLEVF; LSYLGPLEVFL; SYLGPLEVFLC; YLGPLEVFLCH; LGPLEVFLCHQ;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

GPLEVFLCHQT; PLEVFLCHQTP; AAHPLSGFSCL; GHLAKRKLGKD; HLAKRKLGKDS;
LAKRKLGKDSL; AKRKLGKDSLQ; KRKLGKDSLQI; RKLGKDSLQIF; KLGKDSLQIFF;
LGKDSLQIFFS; GKDSLQIFFSG; KDSLQIFFSGG; DSLQIFFSGGS; NILQGLSTVVF;
ILQGLSTVVFQ; LQGLSTVVFQS; QGLSTVVFQSC; TGHKYQQLKHT; GHKYQQLKHTG;
HKYQQLKHTGY; KYQQLKHTGYQ; YQQLKHTGYQL; QQLKHTGYQLY; QLKHTGYQLYK;
LKHTGYQLYKE; KHTGYQLYKEA; HTGYQLYKEAP; TGYQLYKEAPH; GYQLYKEAPHP;
YQLYKEAPHPV; QLYKEAPHPVH; LYKEAPHPVHL; YKEAPHPVHLA; KEAPHPVHLAT;
EAPHPVHLATL; APHPVHLATLW; LCWSHEVLGEH; CWSHEVLGEHF; WSHEVLGEHFP;
SHEVLGEHFPL; HEVLGEHFPLL; HFHFYWDQVPS; FHFYWDQVPST; HFYWDQVPSTQ;
FYWDQVPSTQL; YWDQVPSTQLD; WDQVPSTQLDK; DQVPSTQLDKH; QVPSTQLDKHC;
VPSTQLDKHCF; PSTQLDKHCFC; STQLDKHCFCP; TQLDKHCFCPN; QLDKHCFCPNR;
LDKHCFCPNRP; DKHCFCPNRPY; KHCFCPNRPYG; HCFCPNRPYGQ; CFCPNRPYGQY;
FCPNRPYGQYS; CPNRPYGQYSL; PNRPYGQYSLP; NRPYGQYSLPG; RPYGQYSLPGT;
PYGQYSLPGTG; YGQYSLPGTGL; GQYSLPGTGLL; QYSLPGTGLLG; YSLPGTGLLGF;
YHQGTLTCNSL; HQGTLTCNSLA; QGTLTCNSLAL; GTLTCNSLALP; TLTCNSLALPA;
LTCNSLALPAF; TCNSLALPAFP; CNSLALPAFPR; NSLALPAFPRV; SLALPAFPRVL;
LALPAFPRVLH; ALPAFPRVLHL; LPAFPRVLHLQ; PAFPRVLHLQQ; AFPRVLHLQQR;
FPRVLHLQQRS; PRVLHLQQRSG; RVLHLQQRSGN; VLHLQQRSGNY; LHLQQRSGNYC;
HLQQRSGNYCL; LQQRSGNYCLE; VFLHHAHALFV; FLHHAHALFVT; LHHAHALFVTL;
HHAHALFVTLH; HAHALFVTLHE; AHALFVTLHEG; PLFVQLQPPTS; LFVQLQPPTSV;
FVQLQPPTSVD; VQLQPPTSVDF; QLQPPTSVDFH; LQPPTSVDFHR; QPPTSVDFHRL;
PPTSVDFHRLG; PTSVDFHRLGP; TSVDFHRLGPH; SVDFHRLGPHL; VDFHRLGPHLN;
DFHRLGPHLNW; FHRLGPHLNWG; HRLGPHLNWGG; RLGPHLNWGGE; LGPHLNWGGEF;
GPHLNWGGEFL; PHLNWGGEFLL; HLNWGGEFLLC; LNWGGEFLLCC; NWGGEFLLCCN;
WGGEFLLCCNR; GGEFLLCCNRE; GEFLLCCNREA; EFLLCCNREAF; FLLCCNREAFF;
LLCCNREAFFS; LCCNREAFFSL; CCNREAFFSLG; CNREAFFSLGY; NREAFFSLGYH;
REAFFSLGYHC; GFHLDPPFLGL; FHLDPPFLGLG; HLDPPFLGLGS; LDPPFLGLGSI;
DPPFLGLGSIL; PPFLGLGSILP; PFLGLGSILPL; LLELLLLLLLV; LELLLLLLVV;
ELLLLLLLVVL; LLLLLLLVVLA; LLLLLLVVLAL; LLLLLVVLALA; LLLLVVLALAR;
LLLVVLALARV; LLVVLALARVP; LVVLALARVPL; VVLALARVPLA; VLALARVPLAF;
LALARVPLAFW; ALARVPLAFWE; LARVPLAFWEL; ARVPLAFWELP; RVPLAFWELPL;
VPLAFWELPLD; PLAFWELPLDT; LAFWELPLDTL; AFWELPLDTLL; FWELPLDTLLF;
WELPLDTLLFF; ELPLDTLLFFW; LPLDTLLFFWL; PLDTLLFFWLG; LDTLLFFWLGP;
DTLLFFWLGPS; TLLFFWLGPSS; LLFFWLGPSSY; LFFWLGPSSYA; FFWLGPSSYAS;
FWLGPSSYASR; WLGPSSYASRA; LGPSSYASRAG; GPSSYASRAGV; PSSYASRAGVT;
SSYASRAGVTV; SYASRAGVTVP; YASRAGVTVPY; ASRAGVTVPYR; SRAGVTVPYRP;
RAGVTVPYRPR; AGVTVPYRPRS; GVTVPYRPRSK; VTVPYRPRSKG; TVPYRPRSKGN;
VPYRPRSKGNI; PYRPRSKGNIH; LAPPGAIVFSI; APPGAIVFSIN; PGAIVFSINS;
PGAIVFSINSP; GAIVFSINSPE; AIVFSINSPEC; IVFSINSPECT; VFSINSPECTL;
FSINSPECTLC; FLKSILCVTSS; LKSILCVTSSI; KSILCVTSSIL; SILCVTSSILS;
ILCVTSSILSA; LCVTSSILSAS; CVTSSILSASS; VTSSILSASSI; TSSILSASSIL;
VWPKCTRVPSL; WPKCTRVPSLS; PKCTRVPSLSA; KCTRVPSLSAT; CTRVPSLSATC;
TRVPSLSATCL; RVPSLSATCLT; VPSLSATCLTI; PSLSATCLTIE; SLSATCLTIEG;
LSATCLTIEGL; SATCLTIEGLI; ATCLTIEGLIG; TCLTIEGLIGE; CLTIEGLIGER;
LTIEGLIGERS; TIEGLIGERSE; KFIGAFTIVQV; FIGAFTIVQVV; IGAFTIVQVVS;
GAFTIVQVVSS; AFTIVQVVSSK; FTIVQVVSSKN; TIVQVVSSKNL; IVQVVSSKNLA;
VQVVSSKNLAK; QVVSSKNLAKE; VVSSKNLAKES; VSSKNLAKESL; SSKNLAKESLK;
SKNLAKESLKN; KNLAKESLKNL; NLAKESLKNLS; LAKESLKNLSV; AKESLKNLSVL;
KESLKNLSVLL; ESLKNLSVLLC; SLKNLSVLLCN; LKNLSVLLCNS; KNLSVLLCNSC;
NLSVLLCNSCE; LSVLLCNSCEV; SVLLCNSCEVI; VLLCNSCEVIG; LLCNSCEVIEG;
LCNSCEVIEGI; CNSCEVIEGIS; NSCEVIEGISS; SCEVIEGISSL; CEVIEGISSLI;
EVIEGISSLIT; VIEGISSLITC; IEGISSLITCH; EGISSLITCHK; GISSLITCHKA;
ISSLITCHKAW; SSLITCHKAWE; SLITCHKAWEI; LITCHKAWEIV; ITCHKAWEIVA;
TCHKAWEIVAN; CHKAWEIVANK; HKAWEIVANKE; KAWEIVANKEG; AWEIVANKEGP;
WEIVANKEGPQ; EIVANKEGPQC; IVANKEGPQCL; VANKEGPQCLG; ANKEGPQCLGS;
NKEGPQCLGSR; KEGPQCLGSRY; ILLTKVFTPGN; LLTKVFTPGNR; LTKVFTPGNRI;
TKVFTPGNRIS; YSSGLNNSKAM; SSGLNNSKAMP; SGLNNSKAMPD; GLNNSKAMPDC;
IKAANPAIAPG; KAANPAIAPGA; AANPAIAPGAP; ANPAIAPGAPA; NPAIAPGAPAI;
PAIAPGAPAIT; AIAPGAPAITA; IAPGAPAITAY; APGAPAITAYV; GVRPIAAIASE;
VRPIAAIASEV; RPIAAIASEVL; PIAAIASEVLV; IAAIASEVLVM; AAIASEVLVMP;
AIASEVLVMPS; IASEVLVMPST; ASEVLVMPSTV; SEVLVMPSTVA; EVLVMPSTVAR;
VLVMPSTVARD; LVMPSTVARDA; VMPSTVARDAI; TSIAAAASPAA; SIAAAASPAAI;
IAAAASPAAIS; AAAASPAAISA; AAASPAAISAT; AASPAAISATE; ASPAAISATEN;
SPAAISATENP; PAAISATENPV; AAISATENPVA; AISATENPVAA; ISATENPVAAA;
SATENPVAAAA; ATENPVAAAAS; TENPVAAAASD; ENPVAAAASDT; NPVAAAASDTL;
PVAAAASDTLA; VAAAASDTLAT; AAAASDTLATR; AAASDTLATRS; AASDTLATRSP;
ASDTLATRSPK; SDTLATRSPKS; DTLATRSPKSA; TLATRSPKSAR; LATRSPKSARA;
ATRSPKSARAA; TRSPKSARAAP; RSPKSARAAPM; SPKSARAAPMN; PKSARAAPMNL;
KSARAAPMNLE; SARAAPMNLEI; ARAAPMNLEIQ; RAAPMNLEIQK; AAPMNLEIQKK;
APMNLEIQKKR; PMNLEIQKKRD; MNLEIQKKRDY; NLEIQKKRDYL; LEIQKKRDYLP;
EIQKKRDYLPR; IQKKRDYLPRS; QKKRDYLPRSL; KKRDYLPRSLL; KRDYLPRSLLQ;
RDYLPRSLLQS; DYLPRSLLQSL; YLPRSLLQSLL; LPRSLLQSLLQ; PRSLLQSLLQQ;
RSLLQSLLQQV; SLLQSLLQQVK; LLQSLLQQVKQ; LQSLLQQVKQW; QSLLQQVKQWY;
SLLQQVKQWYF; LLQQVKQWYFC; LQQVKQWYFCF; QQVKQWYFCFS; QVKQWYFCFSR;
VKQWYFCFSRL; KQWYFCFSRLH; QWYFCFSRLHC; WYFCFSRLHCL; YFCFSRLHCLH;
FCFSRLHCLHL; CFSRLHCLHLY; FSRLHCLHLYK; SRLHCLHLYKI; RLHCLHLYKIP;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

LHCLHLYKIPA; HCLHLYKIPAK; CLHLYKIPAKA; LHLYKIPAKAL; HLYKIPAKALK;
KSSELFFLFQS; SSELFFLFQSR; SELFFLFQSRF; ELFFLFQSRFY; LFFLFQSRFYQ;
FFLFQSRFYQL; FLFQSRFYQLS; LFQSRFYQLSL; FQSRFYQLSLK; QSRFYQLSLKL;
SRFYQLSLKLV; RFYQLSLKLVV; FYQLSLKLVVT; YQLSLKLVVTA; QLSLKLVVTAG;
LSLKLVVTAGA; SLKLVVTAGAE; LKLVVTAGAEP; KLVVTAGAEPW; LVVTAGAEPWP;
VVTAGAEPWPL; VTAGAEPWPLS; TAGAEPWPLSS; AGAEPWPLSSL; GAEPWPLSSLT;
AEPWPLSSLTG; EPWPLSSLTGD; PWPLSSLTGDK; WPLSSLTGDKA; PLSSLTGDKAK;
LSSLTGDKAKI; SSLTGDKAKIP; SLTGDKAKIPR; LTGDKAKIPRL; TGDKAKIPRLA;
GDKAKIPRLAK; DKAKIPRLAKH; KAKIPRLAKHV; AKIPRLAKHVC; KIPRLAKHVCH;
IPRLAKHVCHA; PRLAKHVCHAL; RLAKHVCHALS; LAKHVCHALSF; AKHVCHALSFL;
KHVCHALSFLR; HVCHALSFLRS; VCHALSFLRSW; CHALSFLRSWF; HALSFLRSWFG;
ALSFLRSWFGC; LSFLRSWFGCI; SFLRSWFGCIP; FLRSWFGCIPW; LRSWFGCIPWV;
RSWFGCIPWVS; SWFGCIPWVSS; WFGCIPWVSSS; FGCIPWVSSSL; GCIPWVSSSLS;
GHGLAAFPCES; HGLAAFPCESC; GLAAFPCESCT; LAAFPCESCTF; AAFPCESCTFL;
APFCESCTFLP; FPCESCTFLPE; PCESCTFLPEV; CESCTFLPEVM; ESCTFLPEVMV;
SCTFLPEVMVW; CTFLPEVMVWL; TFLPEVMVWLH; FLPEVMVWLHS; LPEVMVWLHSM;
PEVMVWLHSMG; EVMVWLHSMGK; VMVWLHSMGKQ; MVWLHSMGKQL; VWLHSMGKQLL;
WLHSMGKQLLP; LHSMGKQLLPV; HSMGKQLLPVA; SMGKQLLPVAF; MGKQLLPVAFF;
GKQLLPVAFFF; KQLLPVAFFFI; QLLPVAFFFII; LLPVAFFFIIY; LPVAFFFIIYK;
PVAFFFIIYKR; VAFFFIIYKRP; AFFFIIYKRPR; FFFIIYKRPRP; FFIIYKRPRPP;
FIIYKRPRPPL; IIYKRPRPPLP; IYKRPRPPLPP; YKRPRPPLPPP; KRPRPPLPPPF;
RPRPPLPPPFL; PRPPLPPPFLS; RPPLPPPFLSS; PPLPPPFLSSS; PLPPPFLSSSK;
LPPPFLSSSKG; PPPFLSSSKGV; PPFLSSSKGVE; PFLSSSKGVEA; FLSSSKGVEAF;
LSSSKGVEAFS; SSSKGVEAFSE; SSKGVEAFSEA; QNYLGKSLFFC; NYLGKSLFFCN;
YLGKSLFFCNF; LGKSLFFCNFC; GKSLFFCNFCK

BK virus complementary reading frame 3

8 mers:

QGRIHGAH; GRIHGAHG; RIHGAHGP; IHGAHGPF; HGAHGPFR; GAHGPFRP; KSCLGKSS;
SCLGKSSL; CLGKSSLN; LGKSSLNE; GKSSLNEK; KSSLNEKS; SSLNEKSL; SLNEKSLF;
LNEKSLFK; NEKSLFKE; EKSLFKEV; NEENEYFV; KNGAGCKG; NGAGCKGS; GAGCKGSS;
AGCKGSSS; GCKGSSSA; FSSLPRYP; SSLPRYPV; SLPRYPVL; LPRYPVLQ; PRYPVLQG;
RYPVLQGM; YPVLQGMA; PVLQGMAY; VLQGMAYL; LQGMAYLF; QGMAYLFQ; GMAYLFQK;
MAYLFQKA; AYLFQKAF; YLFQKAFC; LFQKAFCA; FQKAFCAL; QKAFCALP; KAFCALPL;
AFCALPLH; FCALPLHA; CALPLHAM; ALPLHAMS; LPLHAMSA; PLHAMSAI; KIFKKRAL; FKKRALGL;
FKKRALGL; KKRALGLD; KRALGLDR; RALGLDRL; ALGLDRLL; LGLDRLLL; GLDRLLLH;
LLHTVVWL; LHTVVWLR; HTVVWLRP; TVVWLRPN; RNSAMVGP; NSAMVGPN; SAMVGPNN;
AMVGPNNW; MVGPNNWR; VGPNNWRN; GPNNWRNS; PNNWRNSL; NNWRNSLQ; NWRNSLQR;
WRNSLQRS; RNSLQRSK; NSLQRSKA; SLQRSKAL; LQRSKALR; INNKILKG; NNKILKGP;
NKILKGPK; VPTYGTEE; PTYGTEEW; TYGTEEWE; YGTEEWES; GTEEWESW; TEEWESWW;
EEWESWWS; EWESWWSS; WESWWSSF; ESWWSSFN; SWWSSFNE; WWSSFNEK; WSSFNEKW;
SSFNEKWD; SFNEKWDE; FNEKWDED; NEKWDEDL; EKWDEDLF; KWDEDLFC; WDEDLFCH;
DEDLFCHE; EDLFCHED; DLFCHEDM; LFCHEDMF; FCHEDMFA; CHEDMFAS; HEDMFASD;
EDMFASDE; DMFASDEE; MFASDEEA; FASDEEAT; ASDEEATA; SDEEATAD; DEEATADS;
EEATADSQ; EATADSQH; ATADSQHS; TADSQHST; ADSQHSTP; DSQHSTPP; SQHSTPPK;
QHSTPPKK; HSTPPKKK; STPPKKKR; TPPKKKRK; PPKKKRKV; PKKKRKVE; KKKRKVED;
KKRKVEDP; KRKVEDPK; RKVEDPKD; KVEDPKDF; VEDPKDFP; EDPKDFPS; DPKDFPSD;
PKDFPSDL; KDFPSDLH; DFPSDLHQ; FPSDLHQF; PSDLHQFL; SDLHQFLS; DLHQFLSQ;
LHQFLSQA; HQFLSQAV; QFLSQAVF; FLSQAVFS; LSQAVFSN; SQAVFSNR; QAVFSNRT;
AVFSNRTL; VFSNRTLA; FSNRTLAC; SNRTLACF; NRTLACFA; RTLACFAV; TLACFAVY;
LACFAVYT; ACFAVYTT; CFAVYTTK; FAVYTTKE; AVYTTKEK; VYTTKEKA; YTTKEKAQ;
TTKEKAQI; TKEKAQIL; KEKAQILY; EKAQILYK; KAQILYKK; AQILYKKL; QILYKKLM;
ILYKKLME; LYKKLMEK; YKKLMEKY; KKLMEKYS; KLMEKYSV; LMEKYSVT; MEKYSVTF;
EKYSVTFI; KYSVTFIS; YSVTFISR; SVTFISRH; VTFISRHM; TFISRHMC; FISRHMCA;
ISRHMCAG; SRHMCAGH; RHMCAGHN; HMCAGHNI; MCAGHNII; CAGHNIIF; AGHNIIFF;
GHNIIFFL; HNIIFFLT; NIIFFLTP; IIFFLTPH; IFFLTPHR; FFLTPHRH; FLTPHRHR;
LTPHRHRV; TPHRHRVS; PHRHRVSA; HRHRVSAI; RHRVSAIN; HRVSAINN; RVSAINNF;
VSAINNFC; SAINNFCQ; AINNFCQK; INNFCQKL; NNFCQKLC; NFCQKLCT; FCQKLCTF;
CQKLCTFS; QKLCTFSF; KLCTFSFL; LCTFSFLI; CTFSFLIC; TFSFLICK; FSFLICKG;
SFLICKGV; FLICKGVN; LICKGVNK; ICKGVNKE; CKGVNKEY; KGVNKEYL; GVNKEYLL;
VNKEYLLY; NKEYLLYS; KEYLLYSA; EYLLYSAL; YLLYSALT; LLYSALTR; LYSALTRD;
YSALTRDP; SALTRDPY; ALTRDPYH; LTRDPYHT; TRDPYHTI; RDPYHTIE; DPYHTIEE;
PYHTIEES; YHTIEESI; HTIEESIQ; TIEESIQG; IEESIQGG; EESIQGGL; ESIQGGLK;
SIQGGLKE; IQGGLKEH; QGGLKEHD; GGLKEHDF; GLKEHDFS; LKEHDFSP; KEHDFSPE;
EHDFSPEE; HDFSPEEP; DFSPEEPE; FSPEEPEE; SPEEPEET; PEEPEETK; EEPEETKQ;
EPEETKQV; PEETKQVS; EETKQVSW; ETKQVSWK; TKQVSWKL; KQVSWKLI; QVSWKLIT;
VSWKLITE; SWKLITEY; WKLITEYA; KLITEYAV; LITEYAVE; ITEYAVET; TEYAVETK;
EYAVETKC; YAVETKCE; AVETKCED; VETKCEDV; ETKCEDVF; TKCEDVFL; KCEDVFLL;
CEDVFLLL; EDVFLLLG; DVFLLLGM; VFLLLGMY; FLLLGMYL; LLLGMYLE; LLGMYLEF;
LGMYLEFQ; GMYLEFQY; MYLEFQYN; YLEFQYNV; LEFQYNVE; EFQYNVEE; FQYNVEEC;
QYNVEECK; YNVEECKK; NVEECKKC; VEECKKCQ; EECKKCQK; ECKKCQKK; CKKCQKKD;
KKCQKKDQ; KCQKKDQP; CQKKDQPY; QKKDQPYH; KKDQPYHF; KDQPYHFK; DQPYHFKY;
QPYHFKYH; PYHFKYHE; YHFKYHEK; HFKYHEKH; FKYHEKHF; KYHEKHFA; YHEKHFAN;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

HEKHFANA; EKHFANAI; KHFANAII; HFANAIIF; FANAIIFA; ANAIIFAE; NAIIFAES;
AIIFAESK; IIFAESKN; IFAESKNQ; FAESKNQK; AESKNQKS; ESKNQKSI; SKNQKSIC;
KNQKSICQ; NQKSICQQ; QKSICQQA; KSICQQAV; SICQQAVD; ICQQAVDT; CQQAVDTV;
QQAVDTVL; QAVDTVLA; AVDTVLAK; VDTVLAKK; DTVLAKKR; TVLAKKRV; VLAKKRVD;
LAKKRVDT; AKKRVDTL; KKRVDTLH; KRVDTLHM; RVDTLHMT; VDTLHMTR; DTLHMTRE;
TLHMTREE; LHMTREEM; HMTREEML; MTREEMLT; TREEMLTE; REEMLTER; EEMLTERF;
EMLTERFN; MLTERFNH; LTERFNHI; TERFNHIL; ERFNHILD; RFNHILDK; FNHILDKM;
NHILDKMD; HILDKMDL; ILDKMDLI; LDKMDLIF; DKMDLIFG; KMDLIFGA; MDLIFGAH;
DLIFGAHG; LIFGAHGN; IFGAHGNA; FGAHGNAV; GAHGNAVL; AHGNAVLE; HGNAVLEQ;
GNAVLEQY; NAVLEQYM; AVLEQYMA; VLEQYMAG; LEQYMAGV; EQYMAGVA; QYMAGVAW;
YMAGVAWL; MAGVAWLH; AGVAWLHC; GVAWLHCL; VAWLHCLL; AWLHCLLP; WLHCLLPK;
LHCLLPKM; HCLLPKMD; CLLPKMDS; LLPKMDSV; LPKMDSVI; PKMDSVIF; KMDSVIFD;
MDSVIFDF; DSVIFDFL; SVIFDFLH; VIFDFLHC; IFDFLHCI; FDFLHCIV; DFLHCIVF;
FLHCIVFN; LHCIVFNV; HCIVFNVP; CIVFNVPK; IVFNVPKR; VFNVPKRR; FNVPKRRY;
NVPKRRYW; VPKRRYWL; PKRRYWLF; KRRYWLFK; RRYWLFKG; RYWLFKGP; YWLFKGPI;
WLFKGPID; LFKGPIDS; FKGPIDSG; KGPIDSGK; GPIDSGKT; PIDSGKTT; IDSGKTTL;
DSGKTTLA; SGKTTLAA; GKTTLAAG; KTTLAAGL; TTLAAGLL; TLAAGLLD; LAAGLLDL;
AAGLLDLC; AGLLDLCG; GLLDLCGG; LLDLCGGK; LDLCGGKA; DLCGGKAL; LCGGKALN;
CGGKALNV; GGKALNVN; GKALNVNL; KALNVNLP; ALNVNLPM; LNVNLPME; NVNLPMER;
VNLPMERL; NLPMERLT; LPMERLTF; PMERLTFE; MERLTFEL; ERLTFELG; RLTFELGV;
LTFELGVA; TFELGVAI; FELGVAID; ELGVAIDQ; LGVAIDQY; GVAIDQYM; VAIDQYMV;
AIDQYMVV; IDQYMVVF; DQYMVVFE; QYMVVFED; YMVVFEDV; MVVFEDVK; VVFEDVKG;
VFEDVKGT; FEDVKGTG; EDVKGTGA; DVKGTGAE; VKGTGAES; KGTGAESK; GTGAESKD;
TGAESKDL; GAESKDLP; AESKDLPS; ESKDLPSG; SKDLPSGH; KDLPSGHG; DLPSGHGI;
LPSGHGIN; PSGHGINN; SGHGINNL; GHGINNLD; HGINNLDS; GINNLDSL; INNLDSLR;
NNLDSLRD; NLDSLRDY; LDSLRDYL; DSLRDYLD; SLRDYLDG; LRDYLDGS; RDYLDGSV;
DYLDGSVK; YLDGSVKV; LDGSVKVN; DGSVKVNL; GSVKVNLE; SVKVNLEK; VKVNLEKK;
KVNLEKKH; VNLEKKHL; NLEKKHLN; LEKKHLNK; EKKHLNKR; KKHLNKRT; KHLNKRTQ;
HLNKRTQI; LNKRTQIF; NKRTQIFP; KRTQIFPP; RTQIFPPG; TQIFPPGL; QIFPPGLV;
IFPPGLVT; FPPGLVTM; PPGLVTMN; PGLVTMNE; GLVTMNEY; LVTMNEYP; VTMNEYPV;
TMNEYPVP; MNEYPVPK; NEYPVPKT; EYPVPKTL; YPVPKTLQ; PVPKTLQA; VPKTLQAR;
PKTLQARF; KTLQARFV; TLQARFVR; LQARFVRQ; QARFVRQI; ARFVRQID; RFVRQIDF;
FVRQIDFR; VRQIDFRP; RQIDFRPK; QIDFRPKI; IDFRPKIY; DFRPKIYL; FRPKIYLR;
RPKIYLRK; PKIYLRKS; KIYLRKSL; IYLRKSLQ; YLRKSLQN; LRKSLQNS; RKSLQNSE;
KSLQNSEF; SLQNSEFL; LQNSEFLL; QNSEFLLE; NSEFLLEK; SEFLLEKR; EFLLEKRI;
FLLEKRIL; LLEKRILQ; LEKRILQS; EKRILQSG; KRILQSGM; RILQSGMT; ILQSGMTL;
LQSGMTLL; QSGMTLLL; SGMTLLLL; GMTLLLLL; MTLLLLLI; TLLLLLIW; LLLLLIWF;
LLLLIWFR; LLLIWFRP; LLIWFRPV; LIWFRPVA; IWFRPVAD; WFRPVADF; FRPVADFA;
RPVADFAT; PVADFATD; VADFATDI; ADFATDIQ; DFATDIQS; FATDIQSR; ATDIQSRI;
TDIQSRIV; DIQSRIVE; IQSRIVEW; QSRIVEWK; SRIVEWKE; RIVEWKER; IVEWKERL;
VEWKERLD; EWKERLDS; WKERLDSE; KERLDSEI; ERLDSEIS; RLDSEISM; LDSEISMY;
DSEISMYT; SEISMYTF; EISMYTFS; ISMYTFSR; SMYTFSRM; MYTFSRMK; YTFSRMKY;
TFSRMKYN; FSRMKYNI; SRMKYNIC; RMKYNICM; MKYNICMG; KYNICMGK; YNICMGKC;
NICMGKCI; ICMGKCIL; CMGKCILD; MGKCILDI; GKCILDIT; KCILDITR; CILDITRE;
ILDITREE; LDITREED; DITREEDS; ITREEDSE; TREEDSET; REEDSETE; EEDSETED;
EDSETEDS; DSETEDSG; SETEDSGH; ETEDSGHG; TEDSGHGS; EDSGHGSS; DSGHGSST;
SGHGSSTE; GHGSSTES; HGSSTESQ; GSSTESQS; SSTESQSQ; STESQSQC; TESQSQCS;
ESQSQCSS; SQSQCSSQ; QSQCSSQV; SQCSSQVS; QCSSQVSD; CSSQVSDT; SSQVSDTS;
SQVSDTSA; QVSDTSAP; VSDTSAPA; SDTSAPAE; DTSAPAED; TSAPAEDS; SAPAEDSQ;
APAEDSQR; PAEDSQRS; AEDSQRSD; EDSQRSDP; DSQRSDPH; SQRSDPHS; QRSDPHSQ;
RSDPHSQE; SDPHSQEL; DPHSQELH; PHSQELHL; HSQELHLC; SQELHLCK; QELHLCKG;
ELHLCKGF; LHLCKGFQ; HLCKGFQC; LCKGFQCF; CKGFQCFK; KGFQCFKR; GFQCFKRP;
FQCFKRPK; QCFKRPKT; CFKRPKTP; FKRPKTPP; KRPKTPPP; RPKTPPPK; HKLKSGLY;
KLKSGLYK; LKSGLYKS; KSGLYKSS; SGLYKSSI; GLYKSSIY; MYMYNKST; YMYNKSTC;
MYNKSTCL; YNKSTCLK; NKSTCLKH; KSTCLKHF; STCLKHFG; TCLKHFGL; CLKHFGLQ;
LKHFGLQL; KHFGLQLS; HFGLQLSL; FGLQLSLF; GLQLSLFV; LQLSLFVN; QLSLFVNI;
LSLFVNIS; SLFVNISY; LFVNISYH; FVNISYHI; VNISYHIW; NISYHIWV; ISYHIWVP;
SYHIWVPW; YHIWVPWK; HIWVPWKS; IWVPWKSF; WVPWKSFC; VPWKSFCA; PWKSFCAI;
WKSFCAIK; KSFCAIKH; SFCAIKHP; FCAIKHPN; CAIKHPNL; AIKHPNLF; IKHPNLFY;
KHPNLFYL; HPNLFYLG; PNLFYLGF; NLFYLGFH; LFYLGFHT; FYLGFHTI; YLGFHTIH;
LGFHTIHR; GFHTIHRL; FHTIHRLP; HTIHRLPI; TIHRLPIH; IHRLPIHS; HRLPIHSL;
RLPIHSLG; LPIHSLGS; PIHSLGSP; IHSLGSPV; HSLGSPVY; SLGSPVYK; LGSPVYKV;
GSPVYKVT; QKGNWVRI; KGNWVRIL; GNWVRILY; NWVRILYR; WVRILYRS; VRILYRSF;
RILYRSFS; ILYRSFSQ; LYRSFSQA; YRSFSQAD; RSFSQADL; SFSQADLK; FSQADLKI;
SQADLKIS; QADLKISC; ADLKISCK; DLKISCKA; LKISCKAS; KISCKASP; ISCKASPL;
SCKASPLL; CKASPLLC; KASPLLCS; ASPLLCSR; SPLLCSRA; PLLCSRAV; LLCSRAVS;
LCSRAVSK; CSRAVSKQ; SRAVSKQA; RAVSKQAT; AVSKQATN; VSKQATNI; SKQATNIS;
KQATNISS; NIQAISFT; IQAISFTK; QAISFTKR; AISFTKRP; ISFTKRPH; SFTKRPHT;
FTKRPHTL; TKRPHTLF; KRPHTLFI; QHCGSCVG; HCGSCVGH; CGSCVGHM; GSCVGHMK;
SCVGHMKY; CVGHMKYW; VGHMKYWG; GHMKYWGN; HMKYWGNI; MKYWGNIF; KYWGNIFP;
YWGNIFPS; WGNIFPSC; GNIFPSCE; NIFPSCES; IFPSCESP; FPSCESPK; PSCESPKI;
SCESPKIP; CESPKIPS; ESPKIPSI; SPKIPSIF; PKIPSIFI; KIPSIFIS; IPSIFIST;
PSIFISTG; SIFISTGI; IFISTGIR; FISTGIRY; ISTGIRYP; STGIRYPA; TGIRYPAL;
GIRYPALN; IRYPALNW; RYPALNWI; YPALNWIS; PALNWISI; ALNWISIV; LNWISIVF;
NWISIVFV; WISIVFVQ; ISIVFVQI; SIVFVQIG; IVFVQIGL; VFVQIGLM; FVQIGLMV;
VQIGLMVS; QIGLMVSI; IGLMVSIH; GLMVSIHY; LMVSIHYL; MVSIHYLG; VSIHYLGL;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

SIHYLGLG; IHYLGLGC; HYLGLGCW; YLGLGCWV; LGLGCWVF; GLGCWVFR; LGCWVFRG;
GCWVFRGY; CWVFRGYS; WVFRGYST; VFRGYSTI; FRGYSTIR; RGYSTIRV; GYSTIRVL;
HSLHFQGF; SLHFQGFS; LHFQGFST; HFQGFSTY; FQGFSTYS; QGFSTYSK; GFSTYSKE;
FSTYSKEV; STYSKEVE; TYSKEVEI; YSKEVEIT; SKEVEITA; KEVEITAL; EVEITALN;
VEITALNR; EITALNRF; ITALNRFS; TALNRFSS; ALNRFSST; LNRFSSTM; NRFSSTML;
RFSSTMLM; FSSTMLMH; SSTMLMHF; STMLMHFL; PCMKVKHA; CMKVKHAS; MKVKHASY;
KVKHASYS; VKHASYSN; KHASYSNN; HASYSNNL; ASYSNNLC; SYSNNLCL; YSNNLCLY;
SNNLCLYS; NNLCLYSY; NLCLYSYS; LCLYSYSL; CLYSYSLP; LYSYSLPH; YSYSLPHQ;
IGEGNSCC; GEGNSCCA; EGNSCCAV; GNSCCAVT; NSCCAVTG; SCCAVTGK; CCAVTGKH;
CAVTGKHF; AVTGKHFS; VTGKHFSL; TGKHFSLW; GKHFSLWA; KHFSLWAI; HFSLWAIT;
FSLWAITA; SLWAITAK; LWAITAKV; WAITAKVI; AITAKVIF; ITAKVIFS; TAKVIFST;
TKAPKVFI; KAPKVFIW; APKVFIWI; PKVFIWIP; KVFIWIPH; VFIWIPHF; FIWIPHFW;
IWIPHFWV; EAFYLCNS; AFYLCNSI; FYLCNSIY; YLCNSIYP; LCNSIYPS; CNSIYPSF;
NSIYPSFN; SIYPSFNF; FWHLHGFL; WHLHGFLW; HLHGFLWL; LHGFLWLF; HGFLWLFG;
GFLWLFGS; FLWLFGSC; LWLFGSCP; WLFGSCPW; LFGSCPWT; FGSCPWTL; GSCPWTLS;
SCPWTLSF; CPWTLSFS; PWTLSFSF; WTLSFSFG; TLSFSFGW; LSFSFGWG; SFSFGWGH;
FSFGWGHL; SFGWGHLH; FGWGHLHM; GWGHLHML; WGHLHMLQ; GHLHMLQE; HLHMLQEQ;
LHMLQEQV; HMLQEQVL; MLQEQVLQ; LQEQVLQS; QEQVLQSR; EQVLQSRT; QVLQSRTG;
VLQSRTGL; LQSRTGLE; QSRTGLEV; SRTGLEVK; RTGLEVKA; TGLEVKAT; GLEVKATS;
LEVKATSI; EVKATSIE; VKATSIEE; KATSIEEQ; ATSIEEQF; TSIEEQFF; SIEEQFFD;
TLLNVHFV; LLNVHFVD; LNVHFVDF; NVHFVDFL; VHFVDFLS; HFVDFLSP; FVDFLSPF;
VDFLSPFF; DFLSPFFV; LLLYCQHH; LLYCQHHL; LYCQHHLY; YCQHHLYY; CQHHLYYK;
QHHLYYKY; HHLYYKYG; HLYYKYGQ; LYYKYGQN; YYKYGQNV; YKYGQNVH; KYGQNVHG;
YGQNVHGY; GQNVHGYL; QNVHGYLP; NVHGYLPF; VHGYLPFQ; HGYLPFQL; GYLPFQLL;
YLPFQLLV; GKDQNNIV; KDQNNIVE; DQNNIVEY; QNNIVEYN; NNIVEYNY; NIVEYNYK;
IVEYNYKS; VEYNYKSL; KIFLFFSA; IFLFFSAI; FLFFSAIP; LFFSAIPV; FFSAIPVR;
FSAIPVRL; QTKKDPNA; QKYLHQET; KYLHQETE; YLHQETEY; LHQETEYH; HQETEYHS;
QETEYHST; ETEYHSTH; TEYHSTHL; EYHSTHLG; TIPKPCLI; IPKPCLIA; PKPCLIAD;
KPCLIADR; PCLIADRG; CLIADRGL; LIADRGLQ; IADRGLQW; ADRGLQWK; DRGLQWKL;
RGLQWKLC; GLQWKLCD; LQWKLCDP; QWKLCDPN; WKLCDPNH; KLCDPNHQ; LCDPNHQR;
CDPNHQRT; DPNHQRTY; PNHQRTYT; NHQRTYTL; HQRTYTLL; QRTYTLLE; RTYTLLEL;
TYTLLELR; YTLLELRN; QFELKQQT; FELKQQTQ; ELKQQTQQ; PQEHQQLQ; QEHQQLQH;
EHQQLQHM; HQQLQHMF; QQLQHMFE; QLQHMFEE; LQHMFEEL; QHMFEELG; HMFEELGL;
PLRYLLCP; LRYLLCPL; RYLLCPLQ; QGMQFELL; QGMQFELLQ; QGMQFELLQQ; QPPQQQFQ;
PPQQQFQP; PQQQFQPL; QQQFQPLK; QQFQPLKI; QFQPLKIL; FQPLKILW; QPLKILWQ;
PLKILWQQ; LKILWQQQ; KILWQQQP; ILWQQQPQ; LWQQQPQI; WQQQPQIH; QQQPQIHW;
QQPQIHWQ; QPQIHWQL; PQIHWQLG; QIHWQLGP; IHWQLGPP; HWQLGPPK; WQLGPPKV;
QLGPPKVL; LGPPKVLE; GPPKVLEQ; PPKVLEQH; PKVLEQHP; TWKYKKKG; WKYKKKGI;
KYKKKGIT; YKKKGITY; KKKGITYL; KKGITYLG; KGITYLGV; GITYLGVF; ITYLGVFY;
TYLGVFYR; YLGVFYRV; LGVFYRVF; GVFYRVFY; VFYRVFYS; FYRVFYSR; SSGTFVFP;
SGTFVFPV; GTFVFPVY; TFVFPVYT; FVFPVYTV; VFPVYTVF; FPVYTVFT; PVYTVFTS;
VYTVFTST; YTVFTSTK; TVFTSTKF; VFTSTKFQ; FTSTKFQQ; TSTKFQQK; STKFQQKL;
NKNKNPLS; KNKNPLSS; NKNPLSSF; KNPLSSFF; NPLSSFFC; PLSSFFCS; LSSFFCSS;
SSFFCSSP; SFFCSSPG; FFCSSPGF; FCSSPGFT; CSSPGFTN; SSPGFTNF; SPGFTNFH;
QLAQNHGL; LAQNHGLC; AQNHGLCP; QNHGLCPV; LGTRPRFL; GTRPRFLG; TRPRFLGS;
RPRFLGSQ; PRFLGSQN; RFLGSQNM; FLGSQNMS; LGSQNMSV; GSQNMSVM; SQNMSVMH;
QNMSVMHF; NMSVMHFP; MSVMHFPS; GHGLAAFH; HGLAAFHG; AAPPCESC; APPCESCT;
PPCESCTF; PCESCTFL; CESCTFLP; ESCTFLPE; SCTFLPEV; CTFLPEVM; TFLPEVMV;
FLPEVMVW; LPEVMVWL; PEVMVWLH; EVMVWLHS; VMVWLHSP; MVWLHSPV; VWLHSPVS;
WLHSPVSH; LHSPVSHA; HSPVSHAL; SPVSHALS; PVSHALSF; VSHALSFL; SHALSFLR;
HALSFLRS; ALSFLRSW; LSFLRSWF; SFLRSWFG; FLRSWFGC; LRSWFGCI; RSWFGCIP;
SWFGCIPW; WFGCIPWV; FGCIPWVS; GCIPWVSS; CIPWVSSS; IPWVSSSS; PWVSSSSL;
WVSSSSLW; VSSSSLWP; SSSSLWPF; SSSLWPFF; SSLWPFFL; YIRGRGRL; IRGRGRLC;
RGRGRLCL; GRGRLCLH; RGRLCLHP; GRLCLHPF; RLCLHPFS; LCLHPFSQ; CLHPFSQV;
LHPFSQVV; HPFSQVVR; PFSQVVRV; FSQVVRVW; SQVVRVWR; QVVRVWRL; VVRVWRLF;
VRVWRLFL; RVWRLFLR; VWRLFLRP; WRLFLRPS; RLFLRPSK; LFLRPSKT; FLRPSKTI;
LRPSKTIW; RPSKTIWG; PSKTIWGN; SKTIWGNP; KTIWGNPY; TIWGNPYS; IWGNPYSF;
WGNPYSFA; GNPYSFAI; NPYSFAIF; PYSFAIFA; YSFAIFAK 9 mers:

QGRIHGAHG; GRIHGAHGP; RIHGAHGPF; IHGAHGPFR; HGAHGPFRP; KSCLGKSSL;
SCLGKSSLN; CLGKSSLNE; LGKSSLNEK; GKSSLNEKS; KSSLNEKSL; SSLNEKSLF;
SLNEKSLFK; LNEKSLFKE; NEKSLFKEV; KNGAGCKGS; NGAGCKGSS; GAGCKGSSS;
AGCKGSSSA; FSSLPRYPV; SSLPRYPVL; SLPRYPVLQ; LPRYPVLQG; PRYPVLQGM;
RYPVLQGMA; YPVLQGMAY; PVLQGMAYL; VLQGMAYLF; LQGMAYLFQ; QGMAYLFQK;
GMAYLFQKA; MAYLFQKAF; AYLFQKAFC; YLFQKAFCA; LFQKAFCAL; FQKAFCALP;
QKAFCALPL; KAFCALPLH; AFCALPLHA; FCALPLHAM; CALPLHAMS; ALPLHAMSA;
KIFKKRALG; IFKKRALGL; FKKRALGLD; KKRALGLDR; KRALGLDRL; RALGLDRLL;
ALGLDRLLL; LGLDRLLLH; LLHTVVWLR; LHTVVWLRP; HTVVWLRPN; RNSAMVGPN;
NSAMVGPNN; SAMVGPNNW; AMVGPNNWR; MVGPNNWRN; VGPNNWRNS; GPNNWRNSL;
PNNWRNSLQ; NNWRNSLQR; NWRNSLQRS; WRNSLQRSK; RNSLQRSKA; NSLQRSKAL;
SLQRSKALR; INNKILKGP; NNKILKGPK; VPTYGTEEW; PTYGTEEWE; TYGTEEWES;
YGTEEWESW; GTEEWESWW; TEEWESWWS; EEWESWWSS; EWESWWSSF; WESWWSSFN;
ESWWSSFNE; SWWSSFNEK; WWSSFNEKW; WSSFNEKWD; SSFNEKWDE; SFNEKWDED;
FNEKWDEDL; NEKWDEDLF; EKWDEDLFC; KWDEDLFCH; WDEDLFCHE; DEDLFCHED;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

EDLFCHEDM; DLFCHEDMF; LFCHEDMFA; FCHEDMFAS; CHEDMFASD; HEDMFASDE;
EDMFASDEE; DMFASDEEA; MFASDEEAT; FASDEEATA; ASDEEATAD; SDEEATADS;
DEEATADSQ; EEATADSQH; EATADSQHS; ATADSQHST; TADSQHSTP; ADSQHSTPP;
DSQHSTPPK; SQHSTPPKK; QHSTPPKKK; HSTPPKKKR; STPPKKKRK; TPPKKKRKV;
PPKKKRKVE; PKKKRKVED; KKKRKVEDP; KKRKVEDPK; KRKVEDPKD; RKVEDPKDF;
KVEDPKDFP; VEDPKDFPS; EDPKDFPSD; DPKDFPSDL; PKDFPSDLH; KDFPSDLHQ;
DFPSDLHQF; FPSDLHQFL; PSDLHQFLS; SDLHQFLSQ; DLHQFLSQA; LHQFLSQAV;
HQFLSQAVF; QFLSQAVFS; FLSQAVFSN; LSQAVFSNR; SQAVFSNRT; QAVFSNRTL;
AVFSNRTLA; VFSNRTLAC; FSNRTLACF; SNRTLACFA; NRTLACFAV; RTLACFAVY;
TLACFAVYT; LACFAVYTT; ACFAVYTTK; CFAVYTTKE; FAVYTTKEK; AVYTTKEKA;
VYTTKEKAQ; YTTKEKAQI; TTKEKAQIL; TKEKAQILY; KEKAQILYK; EKAQILYKK;
KAQILYKKL; AQILYKKLM; QILYKKLME; ILYKKLMEK; LYKKLMEKY; YKKLMEKYS;
KKLMEKYSV; KLMEKYSVT; LMEKYSVTF; MEKYSVTFI; EKYSVTFIS; KYSVTFISR;
YSVTFISRH; SVTFISRHM; VTFISRHMC; TFISRHMCA; FISRHMCAG; ISRHMCAGH;
SRHMCAGHN; RHMCAGHNI; HMCAGHNII; MCAGHNIIF; CAGHNIIFF; AGHNIIFFL;
GHNIIFFLT; HNIIFFLTP; NIIFFLTPH; IIFFLTPHR; IFFLTPHRH; FFLTPHRHR;
FLTPHRHRV; LTPHRHRVS; TPHRHRVSA; PHRHRVSAI; HRHRVSAIN; RHRVSAINN;
HRVSAINNF; RVSAINNFC; VSAINNFCQ; SAINNFCQK; AINNFCQKL; INNFCQKLC;
NNFCQKLCT; NFCQKLCTF; FCQKLCTFS; CQKLCTFSF; QKLCTFSFL; KLCTFSFLI;
LCTFSFLIC; CTFSFLICK; TFSFLICKG; FSFLICKGV; SFLICKGVN; FLICKGVNK;
LICKGVNKE; ICKGVNKEY; CKGVNKEYL; KGVNKEYLL; GVNKEYLLY; VNKEYLLYS;
NKEYLLYSA; KEYLLYSAL; EYLLYSALT; YLLYSALTR; LLYSALTRD; LYSALTRDP;
YSALTRDPY; SALTRDPYH; ALTRDPYHT; LTRDPYHTI; TRDPYHTIE; RDPYHTIEE;
DPYHTIEES; PYHTIEESI; YHTIEESIQ; HTIEESIQG; TIEESIQGG; IEESIQGGL;
EESIQGGLK; ESIQGGLKE; SIQGGLKEH; IQGGLKEHD; QGGLKEHDF; GGLKEHDFS;
GLKEHDFSP; LKEHDFSPE; KEHDFSPEE; EHDFSPEEP; HDFSPEEPE; DFSPEEPEE;
FSPEEPEET; SPEEPEETK; PEEPEETKQ; EEPEETKQV; EPEETKQVS; PEETKQVSW;
EETKQVSWK; ETKQVSWKL; TKQVSWKLI; KQVSWKLIT; QVSWKLITE; VSWKLITEY;
SWKLITEYA; WKLITEYAV; KLITEYAVE; LITEYAVET; ITEYAVETK; TEYAVETKC;
EYAVETKCE; YAVETKCED; AVETKCEDV; VETKCEDVF; ETKCEDVFL; TKCEDVFLL;
KCEDVFLLL; CEDVFLLLG; EDVFLLLGM; DVFLLLGMY; VFLLLGMYL; FLLLGMYLE;
LLLGMYLEF; LLGMYLEFQ; LGMYLEFQY; GMYLEFQYN; MYLEFQYNV; YLEFQYNVE;
LEFQYNVEE; EFQYNVEEC; FQYNVEECK; QYNVEECKK; YNVEECKKC; NVEECKKCQ;
VEECKKCQK; EECKKCQKK; ECKKCQKKD; CKKCQKKDQ; KKCQKKDQP; KCQKKDQPY;
CQKKDQPYH; QKKDQPYHF; KKDQPYHFK; KDQPYHFKY; DQPYHFKYH; QPYHFKYHE;
PYHFKYHEK; YHFKYHEKH; HFKYHEKHF; FKYHEKHFA; KYHEKHFAN; YHEKHFANA;
HEKHFANAI; EKHFANAII; KHFANAIIF; HFANAIIFA; FANAIIFAE; ANAIIFAES;
NAIIFAESK; AIIFAESKN; IIFAESKNQ; IFAESKNQK; FAESKNQKS; AESKNQKSI;
ESKNQKSIC; SKNQKSICQ; KNQKSICQQ; NQKSICQQA; QKSICQQAV; KSICQQAVD;
SICQQAVDT; ICQQAVDTV; CQQAVDTVL; QQAVDTVLA; QAVDTVLAK; AVDTVLAKK;
VDTVLAKKR; DTVLAKKRV; TVLAKKRVD; VLAKKRVDT; LAKKRVDTL; AKKRVDTLH;
KKRVDTLHM; KRVDTLHMT; RVDTLHMTR; VDTLHMTRE; DTLHMTREE; TLHMTREEM;
LHMTREEML; HMTREEMLT; MTREEMLTE; TREEMLTER; REEMLTERF; EEMLTERFN;
EMLTERFNH; MLTERFNHI; LTERFNHIL; TERFNHILD; ERFNHILDK; RFNHILDKM;
FNHILDKMD; NHILDKMDL; HILDKMDLI; ILDKMDLIF; LDKMDLIFG; DKMDLIFGA;
KMDLIFGAH; MDLIFGAHG; DLIFGAHGN; LIFGAHGNA; IFGAHGNAV; FGAHGNAVL;
GAHGNAVLE; AHGNAVLEQ; HGNAVLEQY; GNAVLEQYM; NAVLEQYMA; AVLEQYMAG;
VLEQYMAGV; LEQYMAGVA; EQYMAGVAW; QYMAGVAWL; YMAGVAWLH; MAGVAWLHC;
AGVAWLHCL; GVAWLHCLL; VAWLHCLLP; AWLHCLLPK; WLHCLLPKM; LHCLLPKMD;
HCLLPKMDS; CLLPKMDSV; LLPKMDSVI; LPKMDSVIF; PKMDSVIFD; KMDSVIFDF;
MDSVIFDFL; DSVIFDFLH; SVIFDFLHC; VIFDFLHCI; IFDFLHCIV; FDFLHCIVF;
DFLHCIVFN; FLHCIVFNV; LHCIVFNVP; HCIVFNVPK; CIVFNVPKR; IVFNVPKRR;
VFNVPKRRY; FNVPKRRYW; NVPKRRYWL; VPKRRYWLF; PKRRYWLFK; KRRYWLFKG;
RRYWLFKGP; RYWLFKGPI; YWLFKGPID; WLFKGPIDS; LFKGPIDSG; FKGPIDSGK;
KGPIDSGKT; GPIDSGKTT; PIDSGKTTL; IDSGKTTLA; DSGKTTLAA; SGKTTLAAG;
GKTTLAAGL; KTTLAAGLL; TTLAAGLLD; TLAAGLLDL; LAAGLLDLC; AAGLLDLCG;
AGLLDLCGG; GLLDLCGGK; LLDLCGGKA; LDLCGGKAL; DLCGGKALN; LCGGKALNV;
CGGKALNVN; GGKALNVNL; GKALNVNLP; KALNVNLPM; ALNVNLPME; LNVNLPMER;
NVNLPMERL; VNLPMERLT; NLPMERLTF; LPMERLTFE; PMERLTFEL; MERLTFELG;
ERLTFELGV; RLTFELGVA; LTFELGVAI; TFELGVAID; FELGVAIDQ; ELGVAIDQY;
LGVAIDQYM; GVAIDQYMV; VAIDQYMVV; AIDQYMVVF; IDQYMVVFE; DQYMVVFED;
QYMVVFEDV; YMVVFEDVK; MVVFEDVKG; VVFEDVKGT; VFEDVKGTG; FEDVKGTGA;
EDVKGTGAE; DVKGTGAES; VKGTGAESK; KGTGAESKD; GTGAESKDL; TGAESKDLP;
GAESKDLPS; AESKDLPSG; ESKDLPSGH; SKDLPSGHG; KDLPSGHGI; DLPSGHGIN;
LPSGHGINN; PSGHGINNL; SGHGINNLD; GHGINNLDS; HGINNLDSL; GINNLDSLR;
INNLDSLRD; NNLDSLRDY; NLDSLRDYL; LDSLRDYLD; DSLRDYLDG; SLRDYLDGS;
LRDYLDGSV; RDYLDGSVK; DYLDGSVKV; YLDGSVKVN; LDGSVKVNL; DGSVKVNLE;
GSVKVNLEK; SVKVNLEKK; VKVNLEKKH; KVNLEKKHL; VNLEKKHLN; NLEKKHLNK;
LEKKHLNKR; EKKHLNKRT; KKHLNKRTQ; KHLNKRTQI; HLNKRTQIF; LNKRTQIFP;
NKRTQIFPP; KRTQIFPPG; RTQIFPPGL; TQIFPPGLV; QIFPPGLVT; IFPPGLVTM;
FPPGLVTMN; PPGLVTMNE; PGLVTMNEY; GLVTMNEYP; LVTMNEYPV; VTMNEYPVP;
TMNEYPVPK; MNEYPVPKT; NEYPVPKTL; EYPVPKTLQ; YPVPKTLQA; PVPKTLQAR;
VPKTLQARF; PKTLQARFV; KTLQARFVR; TLQARFVRQ; LQARFVRQI; QARFVRQID;
ARFVRQIDF; RFVRQIDFR; FVRQIDFRP; VRQIDFRPK; RQIDFRPKI; QIDFRPKIY;
IDFRPKIYL; DFRPKIYLR; FRPKIYLRK; RPKIYLRKS; PKIYLRKSL; KIYLRKSLQ;
IYLRKSLQN; YLRKSLQNS; LRKSLQNSE; RKSLQNSEF; KSLQNSEFL; SLQNSEFLL;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

LQNSEFLLE; QNSEFLLEK; NSEFLLEKR; SEFLLEKRI; EFLLEKRIL; FLLEKRILQ;
LLEKRILQS; LEKRILQSG; EKRILQSGM; KRILQSGMT; RILQSGMTL; ILQSGMTLL;
LQSGMTLLL; QSGMTLLLL; SGMTLLLLL; GMTLLLLLI; MTLLLLLIW; TLLLLLIWF;
LLLLLIWFR; LLLLIWFRP; LLLIWFRPV; LLIWFRPVA; LIWFRPVAD; IWFRPVADF;
WFRPVADFA; FRPVADFAT; RPVADFATD; PVADFATDI; VADFATDIQ; ADFATDIQS;
DFATDIQSR; FATDIQSRI; ATDIQSRIV; TDIQSRIVE; DIQSRIVEW; IQSRIVEWK;
QSRIVEWKE; SRIVEWKER; RIVEWKERL; IVEWKERLD; VEWKERLDS; EWKERLDSE;
WKERLDSEI; KERLDSEIS; ERLDSEISM; RLDSEISMY; LDSEISMYT; DSEISMYTF;
SEISMYTFS; EISMYTFSR; ISMYTFSRM; SMYTFSRMK; MYTFSRMKY; YTFSRMKYN;
TFSRMKYNI; FSRMKYNIC; SRMKYNICM; RMKYNICMG; MKYNICMGK; KYNICMGKC;
YNICMGKCI; NICMGKCIL; ICMGKCILD; CMGKCILDI; MGKCILDIT; GKCILDITR;
KCILDITRE; CILDITREE; ILDITREED; LDITREEDS; DITREEDSE; ITREEDSET;
TREEDSETE; REEDSETED; EEDSETEDS; EDSETEDSG; DSETEDSGH; SETEDSGHG;
ETEDSGHGS; TEDSGHGSS; EDSGHGSST; DSGHGSSTE; SGHGSSTES; GHGSSTESQ;
HGSSTESQS; GSSTESQSQ; SSTESQSQC; STESQSQCS; TESQSQCSS; ESQSQCSSQ;
SQSQCSSQV; QSQCSSQVS; SQCSSQVSD; QCSSQVSDT; CSSQVSDTS; SSQVSDTSA;
SQVSDTSAP; QVSDTSAPA; VSDTSAPAE; SDTSAPAED; DTSAPAEDS; TSAPAEDSQ;
SAPAEDSQR; APAEDSQRS; PAEDSQRSD; AEDSQRSDP; EDSQRSDPH; DSQRSDPHS;
SQRSDPHSQ; QRSDPHSQE; RSDPHSQEL; SDPHSQELH; DPHSQELHL; PHSQELHLC;
HSQELHLCK; SQELHLCKG; QELHLCKGF; ELHLCKGFQ; LHLCKGFQC; HLCKGFQCF;
LCKGFQCFK; CKGFQCFKR; KGFQCFKRP; GFQCFKRPK; FQCFKRPKT; QCFKRPKTP;
CFKRPKTPP; FKRPKTPPP; KRPKTPPPK; HKLKSGLYK; KLKSGLYKS; LKSGLYKSS;
KSGLYKSSI; SGLYKSSIY; MYMYNKSTC; YMYNKSTCL; MYNKSTCLK; YNKSTCLKH;
NKSTCLKHF; KSTCLKHFG; STCLKHFGL; TCLKHFGLQ; CLKHFGLQL; LKHFGLQLS;
KHFGLQLSL; HFGLQLSLF; FGLQLSLFV; GLQLSLFVN; LQLSLFVNI; QLSLFVNIS;
LSLFVNISY; SLFVNISYH; LFVNISYHI; FVNISYHIW; VNISYHIWV; NISYHIWVP;
ISYHIWVPW; SYHIWVPWK; YHIWVPWKS; HIWVPWKSF; IWVPWKSFC; WVPWKSFCA;
VPWKSFCAI; PWKSFCAIK; WKSFCAIKH; KSFCAIKHP; SFCAIKHPN; FCAIKHPNL;
CAIKHPNLF; AIKHPNLFY; IKHPNLFYL; KHPNLFYLG; HPNLFYLGF; PNLFYLGFH;
NLFYLGFHT; LFYLGFHTI; FYLGFHTIH; YLGFHTIHR; LGFHTIHRL; GFHTIHRLP;
FHTIHRLPI; HTIHRLPIH; TIHRLPIHS; IHRLPIHSL; HRLPIHSLG; RLPIHSLGS;
LPIHSLGSP; PIHSLGSPV; IHSLGSPVY; HSLGSPVYK; SLGSPVYKV; LGSPVYKVT;
QKGNWVRIL; KGNWVRILY; GNWVRILYR; NWVRILYRS; WVRILYRSF; VRILYRSFS;
RILYRSFSQ; ILYRSFSQA; LYRSFSQAD; YRSFSQADL; RSFSQADLK; SFSQADLKI;
FSQADLKIS; SQADLKISC; QADLKISCK; ADLKISCKA; DLKISCKAS; LKISCKASP;
KISCKASPL; ISCKASPLL; SCKASPLLC; CKASPLLCS; KASPLLCSR; ASPLLCSRA;
SPLLCSRAV; PLLCSRAVS; LLCSRAVSK; LCSRAVSKQ; CSRAVSKQA; SRAVSKQAT;
RAVSKQATN; AVSKQATNI; VSKQATNIS; SKQATNISS; NIQAISFTK; IQAISFTKR;
QAISFTKRP; AISFTKRPH; ISFTKRPHT; SFTKRPHTL; FTKRPHTLF; TKRPHTLFI;
QHCGSCVGH; HCGSCVGHM; CGSCVGHMK; GSCVGHMKY; SCVGHMKYW; CVGHMKYWG;
VGHMKYWGN; GHMKYWGNI; HMKYWGNIF; MKYWGNIFP; KYWGNIFPS; YWGNIFPSC;
WGNIFPSCE; GNIFPSCES; NIFPSCESP; IFPSCESPK; FPSCESPKI; PSCESPKIP;
SCESPKIPS; CESPKIPSI; ESPKIPSIF; SPKIPSIFI; PKIPSIFIS; KIPSIFIST;
IPSIFISTG; PSIFISTGI; SIFISTGIR; IFISTGIRY; FISTGIRYP; ISTGIRYPA;
STGIRYPAL; TGIRYPALN; GIRYPALNW; IRYPALNWI; RYPALNWIS; YPALNWISI;
PALNWISIV; ALNWISIVF; LNWISIVFV; NWISIVFVQ; WISIVFVQI; ISIVFVQIG;
SIVFVQIGL; IVFVQIGLM; VFVQIGLMV; FVQIGLMVS; VQIGLMVSI; QIGLMVSIH;
IGLMVSIHY; GLMVSIHYL; LMVSIHYLG; MVSIHYLGL; VSIHYLGLG; SIHYLGLGC;
IHYLGLGCW; HYLGLGCWV; YLGLGCWVF; LGLGCWVFR; GLGCWVFRG; LGCWVFRGY;
GCWVFRGYS; CWVFRGYST; WVFRGYSTI; VFRGYSTIR; FRGYSTIRV; RGYSTIRVL;
HSLHFQGFS; SLHFQGFST; LHFQGFSTY; HFQGFSTYS; FQGFSTYSK; QGFSTYSKE;
GFSTYSKEV; FSTYSKEVE; STYSKEVEI; TYSKEVEIT; YSKEVEITA; SKEVEITAL;
KEVEITALN; EVEITALNR; VEITALNRF; EITALNRFS; ITALNRFSS; TALNRFSST;
ALNRFSSTM; LNRFSSTML; NRFSSTMLM; RFSSTMLMH; FSSTMLMHF; SSTMLMHFL;
PCMKVKHAS; CMKVKHASY; MKVKHASYS; KVKHASYSN; VKHASYSNN; KHASYSNNL;
HASYSNNLC; ASYSNNLCL; SYSNNLCLY; YSNNLCLYS; SNNLCLYSY; NNLCLYSYS;
NLCLYSYSL; LCLYSYSLP; CLYSYSLPH; LYSYSLPHQ; IGEGNSCCA; GEGNSCCAV;
EGNSCCAVT; GNSCCAVTG; NSCCAVTGK; SCCAVTGKH; CCAVTGKHF; CAVTGKHFS;
AVTGKHFSL; VTGKHFSLW; TGKHFSLWA; GKHFSLWAI; KHFSLWAIT; HFSLWAITA;
FSLWAITAK; SLWAITAKV; LWAITAKVI; WAITAKVIF; AITAKVIFS; ITAKVIFST;
TKAPKVPIW; KAPKVPIWI; APKVPIWIP; PKVPIWIPH; KVPIWIPHF; VPIWIPHFW;
FIWIPHFWV; EAFYLCNSI; AFYLCNSIY; FYLCNSIYP; YLCNSIYPS; LCNSIYPSF;
CNSIYPSFN; NSIYPSFNF; FWHLHGFLW; WHLHGFLWL; HLHGFLWLF; LHGFLWLFG;
HGFLWLFGS; GFLWLFGSC; FLWLFGSCP; LWLFGSCPW; WLFGSCPWT; LFGSCPWTL;
FGSCPWTLS; GSCPWTLSF; SCPWTLSFS; CPWTLSFSF; PWTLSFSFG; WTLSFSFGW;
TLSFSFGWG; LSFSFGWGH; SFSFGWGHL; FSFGWGHLH; SFGWGHLHM; FGWGHLHML;
GWGHLHMLQ; WGHLHMLQE; GHLHMLQEQ; HLHMLQEQV; LHMLQEQVL; HMLQEQVLQ;
MLQEQVLQS; LQEQVLQSR; QEQVLQSRT; EQVLQSRTG; QVLQSRTGL; VLQSRTGLE;
LQSRTGLEV; QSRTGLEVK; SRTGLEVKA; RTGLEVKAT; TGLEVKATS; GLEVKATSI;
LEVKATSIE; EVKATSIEE; VKATSIEEQ; KATSIEEQF; ATSIEEQFF; TSIEEQFFD;
TLLNVHFVD; LLNVHFVDF; LNVHFVDFL; NVHFVDFLS; VHFVDFLSP; HFVDFLSPF;
FVDFLSPFF; VDFLSPFFV; LLLYCQHHL; LLYCQHHLY; LYCQHHLYY; YCQHHLYYK;
CQHHLYYKY; QHHLYYKYG; HHLYYKYGQ; HLYYKYGQN; LYYKYGQNV; YYKYGQNVH;
YKYGQNVHG; KYGQNVHGY; YGQNVHGYL; GQNVHGYLP; QNVHGYLPF; NVHGYLPFQ;
VHGYLPFQL; HGYLPFQLL; GYLPFQLLV; GKDQNNIVE; KDQNNIVEY; DQNNIVEYN;
QNNIVEYNY; NNIVEYNYK; NIVEYNYKS; IVEYNYKSL; KIFLFFSAI; IFLFFSAIP;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

FLFFSAIPV; LFFSAIPVR; FFSAIPVRL; QKYLHQETE; KYLHQETEY; YLHQETEYH;
LHQETEYHS; HQETEYHST; QETEYHSTH; ETEYHSTHL; TEYHSTHLG; TIPKPCLIA;
IPKPCLIAD; PKPCLIADR; KPCLIADRG; PCLIADRGL; CLIADRGLQ; LIADRGLQW;
IADRGLQWK; ADRGLQWKL; DRGLQWKLC; RGLQWKLCD; GLQWKLCDP; LQWKLCDPN;
QWKLCDPNH; WKLCDPNHQ; KLCDPNHQR; LCDPNHQRT; CDPNHQRTY; DPNHQRTYT;
PNHQRTYTL; NHQRTYTLL; HQRTYTLLE; QRTYTLLEL; RTYTLLELR; TYTLLELRN;
QFELKQQTQ; FELKQQTQQ; PQEHQQLQH; QEHQQLQHM; EHQQLQHMF; HQQLQHMFE;
QQLQHMFEE; QLQHMFEEL; LQHMFEELG; QHMFEELGL; PLRYLLCPL; LRYLLCPLQ;
QQQPPQQQF; QQPPQQQFQ; QPPQQQFQP; PPQQQFQPL; PQQQFQPLK; QQQFQPLKI;
QQFQPLKIL; QFQPLKILW; FQPLKILWQ; QPLKILWQQ; PLKILWQQQ; LKILWQQQP;
KILWQQQPQ; ILWQQQPQI; LWQQQPQIH; WQQQPQIHW; QQQPQIHWQ; QQPQIHWQL;
QPQIHWQLG; PQIHWQLGP; QIHWQLGPP; IHWQLGPPK; HWQLGPPKV; WQLGPPKVL;
QLGPPKVLE; LGPPKVLEQ; GPPKVLEQH; PPKVLEQHP; TWKYKKKGI; WKYKKKGIT;
KYKKKGITY; YKKKGITYL; KKKGITYLG; KKGITYLGV; KGITYLGVF; GITYLGVFY;
ITYLGVFYR; TYLGVFYRV; YLGVFYRVF; LGVFYRVFY; GVFYRVFYS; VFYRVFYSR;
SSGTFVPPV; SGTFVPPVY; GTFVPPVYT; TFVPPVYTV; FVPPVYTVF; VPPVYTVFT;
FPVYTVFTS; PVYTVFTST; VYTVFTSTK; YTVFTSTKF; TVFTSTKFQ; VFTSTKFQQ;
FTSTKFQQK; TSTKFQQKL; NKNKNPLSS; KNKNPLSSF; NKNPLSSFF; KNPLSSFFC;
NPLSSFFCS; PLSSFFCSS; LSSFFCSSP; SSFFCSSPG; SFFCSSPGF; FFCSSPGFT;
FCSSPGFTN; CSSPGFTNF; SSPGFTNFH; QLAQNHGLC; LAQNHGLCP; AQNHGLCPV;
LGTRPRFLG; GTRPRFLGS; TRPRFLGSQ; RPRFLGSQN; PRFLGSQNM; RFLGSQNMS;
FLGSQNMSV; LGSQNMSVM; GSQNMSVMH; SQNMSVMHF; QNMSVMHFP; NMSVMHFPS;
GHGLAAFHG; AAPPCESCT; APPCESCTF; PPCESCTFL; PCESCTFLP; CESCTFLPE;
ESCTFLPEV; SCTFLPEVM; CTFLPEVMV; TFLPEVMVW; FLPEVMVWL; LPEVMVWLH;
PEVMVWLHS; EVMVWLHSP; VMVWLHSPV; MVWLHSPVS; VWLHSPVSH; WLHSPVSHA;
LHSPVSHAL; HSPVSHALS; SPVSHALSF; PVSHALSFL; VSHALSFLR; SHALSFLRS;
HALSFLRSW; ALSFLRSWF; LSFLRSWFG; SFLRSWFGC; FLRSWFGCI; LRSWFGCIP;
RSWFGCIPW; SWFGCIPWV; WFGCIPWVS; FGCIPWVSS; GCIPWVSSS; CIPWVSSSS;
IPWVSSSSL; PWVSSSSLW; WVSSSSLWP; VSSSSLWPF; SSSSLWPFF; SSSLWPFFL;
YIRGRGRLC; IRGRGRLCL; RGRGRLCLH; GRGRLCLHP; RGRLCLHPF; GRLCLHPFS;
RLCLHPFSQ; LCLHPFSQV; CLHPFSQVV; LHPFSQVVR; HPFSQVVRV; PFSQVVRVW;
FSQVVRVWR; SQVVRVWRL; QVVRVWRLF; VVRVWRLFL; VRVWRLFLR; RVWRLFLRP;
VWRLFLRPS; WRLFLRPSK; RLFLRPSKT; LFLRPSKTI; FLRPSKTIW; LRPSKTIWG;
RPSKTIWGN; PSKTIWGNP; SKTIWGNPY; KTIWGNPYS; TIWGNPYSF; IWGNPYSFA;
WGNPYSFAI; GNPYSFAIF; NPYSFAIFA; PYSFAIFAK 10 mers:

QGRIHGAHGP; GRIHGAHGPF; RIHGAHGPFR; IHGAHGPFRP; KSCLGKSSLN;
SCLGKSSLNE; CLGKSSLNEK; LGKSSLNEKS; GKSSLNEKSL; KSSLNEKSLF;
SSLNEKSLFK; SLNEKSLFKE; LNEKSLFKEV; KNGAGCKGSS; NGAGCKGSSS;
GAGCKGSSSA; FSSLPRYPVL; SSLPRYPVLQ; SLPRYPVLQG; LPRYPVLQGM;
PRYPVLQGMA; RYPVLQGMAY; YPVLQGMAYL; PVLQGMAYLF; VLQGMAYLFQ;
LQGMAYLFQK; QGMAYLFQKA; GMAYLFQKAF; MAYLFQKAFC; AYLFQKAFCA;
YLFQKAFCAL; LFQKAFCALP; FQKAFCALPL; QKAFCALPLH; KAFCALPLHA;
AFCALPLHAM; FCALPLHAMS; CALPLHAMSA; KIFKKRALGL; IFKKRALGLD;
FKKRALGLDR; KKRALGLDRL; KRALGLDRLL; RALGLDRLLL; ALGLDRLLLH;
LLHTVVWLRP; LHTVVWLRPN; RNSAMVGPNN; NSAMVGPNNW; SAMVGPNNWR;
AMVGPNNWRN; MVGPNNWRNS; VGPNNWRNSL; GPNNWRNSLQ; PNNWRNSLQR;
NNWRNSLQRS; NWRNSLQRSK; WRNSLQRSKA; RNSLQRSKAL; NSLQRSKALR;
INNKILKGPK; VPTYGTEEWE; PTYGTEEWES; TYGTEEWESW; YGTEEWESWW;
GTEEWESWWS; TEEWESWWSS; EEWESWWSSF; EWESWWSSFN; WESWWSSFNE;
ESWWSSFNEK; SWWSSFNEKW; WWSSFNEKWD; WSSFNEKWDE; SSFNEKWDED;
SFNEKWDEDL; FNEKWDEDLF; NEKWDEDLFC; EKWDEDLFCH; KWDEDLFCHE;
WDEDLFCHED; DEDLFCHEDM; EDLFCHEDMF; DLFCHEDMFA; LFCHEDMFAS;
FCHEDMFASD; CHEDMFASDE; HEDMFASDEE; EDMFASDEEA; DMFASDEEAT;
MFASDEEATA; FASDEEATAD; ASDEEATADS; SDEEATADSQ; DEEATADSQH;
EEATADSQHS; EATADSQHST; ATADSQHSTP; TADSQHSTPP; ADSQHSTPPK;
DSQHSTPPKK; SQHSTPPKKK; QHSTPPKKKR; HSTPPKKKRK; STPPKKKRKV;
TPPKKKRKVE; PPKKKRKVED; PKKKRKVEDP; KKKRKVEDPK; KKRKVEDPKD;
KRKVEDPKDF; RKVEDPKDFP; KVEDPKDFPS; VEDPKDFPSD; EDPKDFPSDL;
DPKDFPSDLH; PKDFPSDLHQ; KDFPSDLHQF; DFPSDLHQFL; FPSDLHQFLS;
PSDLHQFLSQ; SDLHQFLSQA; DLHQFLSQAV; LHQFLSQAVF; HQFLSQAVFS;
QFLSQAVFSN; FLSQAVFSNR; LSQAVFSNRT; SQAVFSNRTL; QAVFSNRTLA;
AVFSNRTLAC; VFSNRTLACF; FSNRTLACFA; SNRTLACFAV; NRTLACFAVY;
RTLACFAVYT; TLACFAVYTT; LACFAVYTTK; ACFAVYTTKE; CFAVYTTKEK;
FAVYTTKEKA; AVYTTKEKAQ; VYTTKEKAQI; YTTKEKAQIL; TTKEKAQILY;
TKEKAQILYK; KEKAQILYKK; EKAQILYKKL; KAQILYKKLM; AQILYKKLME;
QILYKKLMEK; ILYKKLMEKY; LYKKLMEKYS; YKKLMEKYSV; KKLMEKYSVT;
KLMEKYSVTF; LMEKYSVTFI; MEKYSVTFIS; EKYSVTFISR; KYSVTFISRH;
YSVTFISRHM; SVTFISRHMC; VTFISRHMCA; TFISRHMCAG; FISRHMCAGH;
ISRHMCAGHN; SRHMCAGHNI; RHMCAGHNII; HMCAGHNIIF; MCAGHNIIFF;
CAGHNIIFFL; AGHNIIFFLT; GHNIIFFLTP; HNIIFFLTPH; NIIFFLTPHR;
IIFFLTPHRH; IFFLTPHRHR; FFLTPHRHRV; FLTPHRHRVS; LTPHRHRVSA;
TPHRHRVSAI; PHRHRVSAIN; HRHRVSAINN; RHRVSAINNF; HRVSAINNFC;
RVSAINNFCQ; VSAINNFCQK; SAINNFCQKL; AINNFCQKLC; INNFCQKLCT;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

NNFCQKLCTF; NFCQKLCTFS; FCQKLCTFSF; CQKLCTFSFL; QKLCTFSFLI;
KLCTFSFLIC; LCTFSFLICK; CTFSFLICKG; TFSFLICKGV; FSFLICKGVN;
SFLICKGVNK; FLICKGVNKE; LICKGVNKEY; ICKGVNKEYL; CKGVNKEYLL;
KGVNKEYLLY; GVNKEYLLYS; VNKEYLLYSA; NKEYLLYSAL; KEYLLYSALT;
EYLLYSALTR; YLLYSALTRD; LLYSALTRDP; LYSALTRDPY; YSALTRDPYH;
SALTRDPYHT; ALTRDPYHTI; LTRDPYHTIE; TRDPYHTIEE; RDPYHTIEES;
DPYHTIEESI; PYHTIEESIQ; YHTIEESIQG; HTIEESIQGG; TIEESIQGGL;
IEESIQGGLK; EESIQGGLKE; ESIQGGLKEH; SIQGGLKEHD; IQGGLKEHDF;
QGGLKEHDFS; GGLKEHDFSP; GLKEHDFSPE; LKEHDFSPEE; KEHDFSPEEP;
EHDFSPEEPE; HDFSPEEPEE; DFSPEEPEET; FSPEEPEETK; SPEEPEETKQ;
PEEPEETKQV; EEPEETKQVS; EPEETKQVSW; PEETKQVSWK; EETKQVSWKL;
ETKQVSWKLI; TKQVSWKLIT; KQVSWKLITE; QVSWKLITEY; VSWKLITEYA;
SWKLITEYAV; WKLITEYAVE; KLITEYAVET; LITEYAVETK; ITEYAVETKC;
TEYAVETKCE; EYAVETKCED; YAVETKCEDV; AVETKCEDVF; VETKCEDVFL;
ETKCEDVFLL; TKCEDVFLLL; KCEDVFLLLG; CEDVFLLLGM; EDVFLLLGMY;
DVFLLLGMYL; VFLLLGMYLE; FLLLGMYLEF; LLLGMYLEFQ; LLGMYLEFQY;
LGMYLEFQYN; GMYLEFQYNV; MYLEFQYNVE; YLEFQYNVEE; LEFQYNVEEC;
EFQYNVEECK; FQYNVEECKK; QYNVEECKKC; YNVEECKKCQ; NVEECKKCQK;
VEECKKCQKK; EECKKCQKKD; ECKKCQKKDQ; CKKCQKKDQP; KKCQKKDQPY;
KCQKKDQPYH; CQKKDQPYHF; QKKDQPYHFK; KKDQPYHFKY; KDQPYHFKYH;
DQPYHFKYHE; QPYHFKYHEK; PYHFKYHEKH; YHFKYHEKHF; HFKYHEKHFA;
FKYHEKHFAN; KYHEKHFANA; YHEKHFANAI; HEKHFANAII; EKHFANAIIF;
KHFANAIIFA; HFANAIIFAE; FANAIIFAES; ANAIIFAESK; NAIIFAESKN;
AIIFAESKNQ; IIFAESKNQQ; IFAESKNQQK; FAESKNQKSI; AESKNQKSIC;
ESKNQKSICQ; SKNQKSICQQ; KNQKSICQQA; NQKSICQQAV; QKSICQQAVD;
KSICQQAVDT; SICQQAVDTV; ICQQAVDTVL; CQQAVDTVLA; QQAVDTVLAK;
QAVDTVLAKK; AVDTVLAKKR; VDTVLAKKRV; DTVLAKKRVD; TVLAKKRVDT;
VLAKKRVDTL; LAKKRVDTLH; AKKRVDTLHM; KKRVDTLHMT; KRVDTLHMTR;
RVDTLHMTRE; VDTLHMTREE; DTLHMTREEM; TLHMTREEML; LHMTREEMLT;
HMTREEMLTE; MTREEMLTER; TREEMLTERF; REEMLTERFN; EEMLTERFNH;
EMLTERFNHI; MLTERFNHIL; LTERFNHILD; TERFNHILDK; ERFNHILDKM;
RFNHILDKMD; FNHILDKMDL; NHILDKMDLI; HILDKMDLIF; ILDKMDLIFG;
LDKMDLIFGA; DKMDLIFGAH; KMDLIFGAHG; MDLIFGAHGN; DLIFGAHGNA;
LIFGAHGNAV; IFGAHGNAVL; FGAHGNAVLE; GAHGNAVLEQ; AHGNAVLEQY;
HGNAVLEQYM; GNAVLEQYMA; NAVLEQYMAG; AVLEQYMAGV; VLEQYMAGVA;
LEQYMAGVAW; EQYMAGVAWL; QYMAGVAWLH; YMAGVAWLHC; MAGVAWLHCL;
AGVAWLHCLL; GVAWLHCLLP; VAWLHCLLPK; AWLHCLLPKM; WLHCLLPKMD;
LHCLLPKMDS; HCLLPKMDSV; CLLPKMDSVI; LLPKMDSVIF; LPKMDSVIFD;
PKMDSVIFDF; KMDSVIFDFL; MDSVIFDFLH; DSVIFDFLHC; SVIFDFLHCI;
VIFDFLHCIV; IFDFLHCIVF; FDFLHCIVFN; DFLHCIVFNV; FLHCIVFNVP;
LHCIVFNVPK; HCIVFNVPKR; CIVFNVPKRR; IVFNVPKRRY; VFNVPKRRYW;
FNVPKRRYWL; NVPKRRYWLF; VPKRRYWLFK; PKRRYWLFKG; KRRYWLFKGP;
RRYWLFKGPI; RYWLFKGPID; YWLFKGPIDS; WLFKGPIDSG; LFKGPIDSGK;
FKGPIDSGKT; KGPIDSGKTT; GPIDSGKTTL; PIDSGKTTLA; IDSGKTTLAA;
DSGKTTLAAG; SGKTTLAAGL; GKTTLAAGLL; KTTLAAGLLD; TTLAAGLLDL;
TLAAGLLDLC; LAAGLLDLCG; AAGLLDLCGG; AGLLDLCGGK; GLLDLCGGKA;
LLDLCGGKAL; LDLCGGKALN; DLCGGKALNV; LCGGKALNVN; CGGKALNVNL;
GGKALNVNLP; GKALNVNLPM; KALNVNLPME; ALNVNLPMER; LNVNLPMERL;
NVNLPMERLT; VNLPMERLTF; NLPMERLTFE; LPMERLTFEL; PMERLTFELG;
MERLTFELGV; ERLTFELGVA; RLTFELGVAI; LTFELGVAID; TFELGVAIDQ;
FELGVAIDQY; ELGVAIDQYM; LGVAIDQYMV; GVAIDQYMVV; VAIDQYMVVF;
AIDQYMVVFE; IDQYMVVFED; DQYMVVFEDV; QYMVVFEDVK; YMVVFEDVKG;
MVVFEDVKGT; VVFEDVKGTG; VFEDVKGTGA; FEDVKGTGAE; EDVKGTGAES;
DVKGTGAESK; VKGTGAESKD; KGTGAESKDL; GTGAESKDLP; TGAESKDLPS;
GAESKDLPSG; AESKDLPSGH; ESKDLPSGHG; SKDLPSGHGI; KDLPSGHGIN;
DLPSGHGINN; LPSGHGINNL; PSGHGINNLD; SGHGINNLDS; GHGINNLDSL;
HGINNLDSLR; GINNLDSLRD; INNLDSLRDY; NNLDSLRDYL; NLDSLRDYLD;
LDSLRDYLDG; DSLRDYLDGS; SLRDYLDGSV; LRDYLDGSVK; RDYLDGSVKV;
DYLDGSVKVN; YLDGSVKVNL; LDGSVKVNLE; DGSVKVNLEK; GSVKVNLEKK;
SVKVNLEKKH; VKVNLEKKHL; KVNLEKKHLN; VNLEKKHLNK; NLEKKHLNKR;
LEKKHLNKRT; EKKHLNKRTQ; KKHLNKRTQI; KHLNKRTQIF; HLNKRTQIFP;
LNKRTQIFPP; NKRTQIFPPG; KRTQIFPPGL; RTQIFPPGLV; TQIFPPGLVT;
QIFPPGLVTM; IFPPGLVTMN; FPPGLVTMNE; PPGLVTMNEY; PGLVTMNEYP;
GLVTMNEYPV; LVTMNEYPVP; VTMNEYPVPK; TMNEYPVPKT; MNEYPVPKTL;
NEYPVPKTLQ; EYPVPKTLQA; YPVPKTLQAR; PVPKTLQARF; VPKTLQARFV;
PKTLQARFVR; KTLQARFVRQ; TLQARFVRQI; LQARFVRQID; QARFVRQIDF;
ARFVRQIDFR; RFVRQIDFRP; FVRQIDFRPK; VRQIDFRPKI; RQIDFRPKIY;
QIDFRPKIYL; IDFRPKIYLR; DFRPKIYLRK; FRPKIYLRKS; RPKIYLRKSL;
PKIYLRKSLQ; KIYLRKSLQN; IYLRKSLQNS; YLRKSLQNSE; LRKSLQNSEF;
RKSLQNSEFL; KSLQNSEFLL; SLQNSEFLLE; LQNSEFLLEK; QNSEFLLEKR;
NSEFLLEKRI; SEFLLEKRIL; EFLLEKRILQ; FLLEKRILQS; LLEKRILQSG;
LEKRILQSGM; EKRILQSGMT; KRILQSGMTL; RILQSGMTLL; ILQSGMTLLL;
LQSGMTLLLL; QSGMTLLLLL; SGMTLLLLLI; GMTLLLLLIW; MTLLLLLIWF;
TLLLLLIWFR; LLLLLIWFRP; LLLLIWFRPV; LLLIWFRPVA; LLIWFRPVAD;
LIWFRPVADF; IWFRPVADFA; WFRPVADFAT; FRPVADFATD; RPVADFATDI;
PVADFATDIQ; VADFATDIQS; ADFATDIQSR; DFATDIQSRI; FATDIQSRIV;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

ATDIQSRIVE; TDIQSRIVEW; DIQSRIVEWK; IQSRIVEWKE; QSRIVEWKER;
SRIVEWKERL; RIVEWKERLD; IVEWKERLDS; VEWKERLDSE; EWKERLDSEI;
WKERLDSEIS; KERLDSEISM; ERLDSEISMY; RLDSEISMYT; LDSEISMYTF;
DSEISMYTFS; SEISMYTFSR; EISMYTFSRM; ISMYTFSRMK; SMYTFSRMKY;
MYTFSRMKYN; YTFSRMKYNI; TFSRMKYNIC; FSRMKYNICM; SRMKYNICMG;
RMKYNICMGK; MKYNICMGKC; KYNICMGKCI; YNICMGKCIL; NICMGKCILD;
ICMGKCILDI; CMGKCILDIT; MGKCILDITR; GKCILDITRE; KCILDITREE;
CILDITREED; ILDITREEDS; LDITREEDSE; DITREEDSET; ITREEDSETE;
TREEDSETED; REEDSETEDS; EEDSETEDSG; EDSETEDSGH; DSETEDSGHG;
SETEDSGHGS; ETEDSGHGSS; TEDSGHGSST; EDSGHGSSTE; DSGHGSSTES;
SGHGSSTESQ; GHGSSTESQS; HGSSTESQSQ; GSSTESQSQC; SSTESQSQCS;
STESQSQCSS; TESQSQCSSQ; ESQSQCSSQV; SQSQCSSQVS; QSQCSSQVSD;
SQCSSQVSDT; QCSSQVSDTS; CSSQVSDTSA; SSQVSDTSAP; SQVSDTSAPA;
QVSDTSAPAE; VSDTSAPAED; SDTSAPAEDS; DTSAPAEDSQ; TSAPAEDSQR;
SAPAEDSQRS; APAEDSQRSD; PAEDSQRSDP; AEDSQRSDPH; EDSQRSDPHS;
DSQRSDPHSQ; SQRSDPHSQE; QRSDPHSQEL; RSDPHSQELH; SDPHSQELHL;
DPHSQELHLC; PHSQELHLCK; HSQELHLCKG; SQELHLCKGF; QELHLCKGFQ;
ELHLCKGFQC; LHLCKGFQCF; HLCKGFQCFK; LCKGFQCFKR; CKGFQCFKRP;
KGFQCFKRPK; GFQCFKRPKT; FQCFKRPKTP; QCFKRPKTPP; CFKRPKTPPP;
FKRPKTPPPK; HKLKSGLYKS; KLKSGLYKSS; LKSGLYKSSI; KSGLYKSSIY;
MYMYNKSTCL; YMYNKSTCLK; MYNKSTCLKH; YNKSTCLKHF; NKSTCLKHFG;
KSTCLKHFGL; STCLKHFGLQ; TCLKHFGLQL; CLKHFGLQLS; LKHFGLQLSL;
KHFGLQLSLF; HFGLQLSLFV; FGLQLSLFVN; GLQLSLFVNI; LQLSLFVNIS;
QLSLFVNISY; LSLFVNISYH; SLFVNISYHI; LFVNISYHIW; FVNISYHIWV;
VNISYHIWVP; NISYHIWVPW; ISYHIWVPWK; SYHIWVPWKS; YHIWVPWKSF;
HIWVPWKSFC; IWVPWKSFCA; WVPWKSFCAI; VPWKSFCAIK; PWKSFCAIKH;
WKSFCAIKHP; KSFCAIKHPN; SFCAIKHPNL; FCAIKHPNLF; CAIKHPNLFY;
AIKHPNLFYL; IKHPNLFYLG; KHPNLFYLGF; HPNLFYLGFH; PNLFYLGFHT;
NLFYLGFHTI; LFYLGFHTIH; FYLGFHTIHR; YLGFHTIHRL; LGFHTIHRLP;
GFHTIHRLPI; FHTIHRLPIH; HTIHRLPIHS; TIHRLPIHSL; IHRLPIHSLG;
HRLPIHSLGS; RLPIHSLGSP; LPIHSLGSPV; PIHSLGSPVY; IHSLGSPVYK;
HSLGSPVYKV; SLGSPVYKVT; QKGNWVRILY; KGNWVRILYR; GNWVRILYRS;
NWVRILYRSF; WVRILYRSFS; VRILYRSFSQ; RILYRSFSQA; ILYRSFSQAD;
LYRSFSQADL; YRSFSQADLK; RSFSQADLKI; SFSQADLKIS; FSQADLKISC;
SQADLKISCK; QADLKISCKA; ADLKISCKAS; DLKISCKASP; LKISCKASPL;
KISCKASPLL; ISCKASPLLC; SCKASPLLCS; CKASPLLCSR; KASPLLCSRA;
ASPLLCSRAV; SPLLCSRAVS; PLLCSRAVSK; LLCSRAVSKQ; LCSRAVSKQA;
CSRAVSKQAT; SRAVSKQATN; RAVSKQATNI; AVSKQATNIS; VSKQATNISS;
NIQAISFTKR; IQAISFTKRP; QAISFTKRPH; AISFTKRPHT; ISFTKRPHTL;
SFTKRPHTLF; FTKRPHTLFI; QHCGSCVGHM; HCGSCVGHMK; CGSCVGHMKY;
GSCVGHMKYW; SCVGHMKYWG; CVGHMKYWGN; VGHMKYWGNI; GHMKYWGNIF;
HMKYWGNIFP; MKYWGNIFPS; KYWGNIFPSC; YWGNIFPSCE; WGNIFPSCES;
GNIFPSCESP; NIFPSCESPK; IFPSCESPKI; FPSCESPKIP; PSCESPKIPS;
SCESPKIPSI; CESPKIPSIF; ESPKIPSIFI; SPKIPSIFIS; PKIPSIFIST;
KIPSIFISTG; IPSIFISTGI; PSIFISTGIR; SIFISTGIRY; IFISTGIRYP;
FISTGIRYPA; ISTGIRYPAL; STGIRYPALN; TGIRYPALNW; GIRYPALNWI;
IRYPALNWIS; RYPALNWISI; YPALNWISIV; PALNWISIVF; ALNWISIVFV;
LNWISIVFVQ; NWISIVFVQI; WISIVFVQIG; ISIVFVQIGL; SIVFVQIGLM;
IVFVQIGLMV; VFVQIGLMVS; FVQIGLMVSI; VQIGLMVSIH; QIGLMVSIHY;
IGLMVSIHYL; GLMVSIHYLG; LMVSIHYLGL; MVSIHYLGLG; VSIHYLGLGC;
SIHYLGLGCW; IHYLGLGCWV; HYLGLGCWVF; YLGLGCWVFR; LGLGCWVFRG;
GLGCWVFRGY; LGCWVFRGYS; GCWVFRGYST; CWVFRGYSTI; WVFRGYSTIR;
VFRGYSTIRV; FRGYSTIRVL; HSLHFQGFST; SLHFQGFSTY; LHFQGFSTYS;
HFQGFSTYSK; FQGFSTYSKE; QGFSTYSKEV; GFSTYSKEVE; FSTYSKEVEI;
STYSKEVEIT; TYSKEVEITA; YSKEVEITAL; SKEVEITALN; KEVEITALNR;
EVEITALNRF; VEITALNRFS; EITALNRFSS; ITALNRFSST; TALNRFSSTM;
ALNRFSSTML; LNRFSSTMLM; NRFSSTMLMH; RFSSTMLMHF; FSSTMLMHFL;
PCMKVKHASY; CMKVKHASYS; MKVKHASYSN; KVKHASYSNN; VKHASYSNNL;
KHASYSNNLC; HASYSNNLCL; ASYSNNLCLY; SYSNNLCLYS; YSNNLCLYSY;
SNNLCLYSYS; NNLCLYSYSL; NLCLYSYSLP; LCLYSYSLPH; CLYSYSLPHQ;
IGEGNSCCAV; GEGNSCCAVT; EGNSCCAVTG; GNSCCAVTGK; NSCCAVTGKH;
SCCAVTGKHF; CCAVTGKHFS; CAVTGKHFSL; AVTGKHFSLW; VTGKHFSLWA;
TGKHFSLWAI; GKHFSLWAIT; KHFSLWAITA; HFSLWAITAK; FSLWAITAKV;
SLWAITAKVI; LWAITAKVIF; WAITAKVIFS; AITAKVIFST; TKAPKVFIWI;
KAPKVFIWIP; APKVFIWIPH; PKVFIWIPHF; KVFIWIPHFW; VFIWIPHFWV;
EAFYLCNSIY; AFYLCNSIYP; FYLCNSIYPS; YLCNSIYPSF; LCNSIYPSFN;
CNSIYPSFNF; FWHLHGFLWL; WHLHGFLWLF; HLHGFLWLFG; LHGFLWLFGS;
HGFLWLFGSC; GFLWLFGSCP; FLWLFGSCPW; LWLFGSCPWT; WLFGSCPWTL;
LFGSCPWTLS; FGSCPWTLSF; GSCPWTLSFS; SCPWTLSFSF; CPWTLSFSFG;
PWTLSFSFGW; WTLSFSFGWG; TLSFSFGWGH; LSFSFGWGHL; SFSFGWGHLH;
FSFGWGHLHM; SFGWGHLHML; FGWGHLHMLQ; GWGHLHMLQE; WGHLHMLQEQ;
GHLHMLQEQV; HLHMLQEQVL; LHMLQEQVLQ; HMLQEQVLQS; MLQEQVLQSR;
LQEQVLQSRT; QEQVLQSRTG; EQVLQSRTGL; QVLQSRTGLE; VLQSRTGLEV;
LQSRTGLEVK; QSRTGLEVKA; SRTGLEVKAT; RTGLEVKATS; TGLEVKATSI;
GLEVKATSIE; LEVKATSIEE; EVKATSIEEQ; VKATSIEEQF; KATSIEEQFF;
ATSIEEQFFD; TLLNVHFVDF; LLNVHFVDFL; LNVHFVDFLS; NVHFVDFLSP;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

VHFVDFLSPF; HFVDFLSPFF; FVDFLSPFFV; LLLYCQHHLY; LLYCQHHLYY;
LYCQHHLYYK; YCQHHLYYKY; CQHHLYYKYG; QHHLYYKYGQ; HHLYYKYGQN;
HLYYKYGQNV; LYYKYGQNVH; YYKYGQNVHG; YKYGQNVHGY; KYGQNVHGYL;
YGQNVHGYLP; GQNVHGYLPF; QNVHGYLPFQ; NVHGYLPFQL; VHGYLPFQLL;
HGYLPFQLLV; GKDQNNIVEY; KDQNNIVEYN; DQNNIVEYNY; QNNIVEYNYK;
NNIVEYNYKS; NIVEYNYKSL; KIFLFFSAIP; IFLFFSAIPV; FLFFSAIPVR;
LFFSAIPVRL; QKYLHQETEY; KYLHQETEYH; YLHQETEYHS; LHQETEYHST;
HQETEYHSTH; QETEYHSTHL; ETEYHSTHLG; TIPKPCLIAD; IPKPCLIADR;
PKPCLIADRG; KPCLIADRGL; PCLIADRGLQ; CLIADRGLQW; LIADRGLQWK;
IADRGLQWKL; ADRGLQWKLC; DRGLQWKLCD; RGLQWKLCDP; GLQWKLCDPN;
LQWKLCDPNH; QWKLCDPNHQ; WKLCDPNHQR; KLCDPNHQRT; LCDPNHQRTY;
CDPNHQRTYT; DPNHQRTYTL; PNHQRTYTLL; NHQRTYTLLE; HQRTYTLLEL;
QRTYTLLELR; RTYTLLELRN; QFELKQQTQQ; PQEHQQLQHM; QEHQQLQHMF;
EHQQLQHMFE; HQQLQHMFEE; QQLQHMFEEL; QLQHMFEELG; LQHMFEELGL;
PLRYLLCPLQ; QQQPPQQQFQ; QQPPQQQFQP; PPQQQFQPL; PPQQQFQPLK;
PQQQFQPLKI; QQQFQPLKIL; QQFQPLKILW; QFQPLKILWQ; FQPLKILWQQ;
QPLKILWQQQ; PLKILWQQQP; LKILWQQQPQ; KILWQQQPQI; ILWQQQPQIH;
LWQQQPQIHW; WQQQPQIHWQ; QQQPQIHWQL; QQPQIHWQLG; QPQIHWQLGP;
PQIHWQLGPP; QIHWQLGPPK; IHWQLGPPKV; HWQLGPPKVL; WQLGPPKVLE;
QLGPPKVLEQ; LGPPKVLEQH; GPPKVLEQHP; TWKYKKKGIT; WKYKKKGITY;
KYKKKGITYL; YKKKGITYLG; KKKGITYLGV; KKGITYLGVF; KGITYLGVFY;
GITYLGVFYR; ITYLGVFYRV; TYLGVFYRVF; YLGVFYRVFY; LGVFYRVFYS;
GVFYRVFYSR; SSGTFVFPVY; SGTFVFPVYT; GTFVFPVYTV; TFVFPVYTVF;
FVFPVYTVFT; VFPVYTVFTS; FPVYTVFTST; PVYTVFTSTK; VYTVFTSTKF;
YTVFTSTKFQ; TVFTSTKFQQ; VFTSTKFQQK; FTSTKFQQKL; NKNKNPLSSF;
KNKNPLSSFF; NKNPLSSFFC; KNPLSSFFCS; NPLSSFFCSS; PLSSFFCSSP;
LSSFFCSSPG; SSFFCSSPGF; SFFCSSPGFT; FFCSSPGFTN; FCSSPGFTNF;
CSSPGFTNFH; QLAQNHGLCP; LAQNHGLCPV; LGTRPRFLGS; GTRPRFLGSQ;
TRPRFLGSQN; RPRFLGSQNM; PRFLGSQNMS; RFLGSQNMSV; FLGSQNMSVM;
LGSQNMSVMH; GSQNMSVMHF; SQNMSVMHFP; QNMSVMHFPS; AAPPCESCTF;
APPCESCTFL; PPCESCTFLP; PCESCTFLPE; CESCTFLPEV; ESCTFLPEVM;
SCTFLPEVMV; CTFLPEVMVW; TFLPEVMVWL; FLPEVMVWLH; LPEVMVWLHS;
PEVMVWLHSP; EVMVWLHSPV; VMWLHSPVS; MVWLHSPVSH; VWLHSPVSHA;
WLHSPVSHAL; LHSPVSHALS; HSPVSHALSF; SPVSHALSFL; PVSHALSFLR;
VSHALSFLRS; SHALSFLRSW; HALSFLRSWF; ALSFLRSWFG; LSFLRSWFGC;
SFLRSWFGCI; FLRSWFGCIP; LRSWFGCIPW; RSWFGCIPWV; SWFGCIPWVS;
WFGCIPWVSS; FGCIPWVSSS; GCIPWVSSSS; CIPWVSSSSL; IPWVSSSSLW;
PWVSSSSLWP; WVSSSSLWPF; VSSSSLWPFF; SSSSLWPFFL; YIRGRGRLCL;
IRGRGRLCLH; RGRGRLCLHP; GRGRLCLHPF; RGRLCLHPFS; GRLCLHPFSQ;
RLCLHPFSQV; LCLHPFSQVV; CLHPFSQVVR; LHPFSQVVRV; HPFSQVVRVW;
PFSQVVRVWR; FSQVVRVWRL; SQVVRVWRLF; QVVRVWRLFL; VVRVWRLFLR;
VRVWRLFLRP; RVWRLFLRPS; VWRLFLRPSK; WRLFLRPSKT; RLFLRPSKTI;
LFLRPSKTIW; FLRPSKTIWG; LRPSKTIWGN; RPSKTIWGNP; PSKTIWGNPY;
SKTIWGNPYS; KTIWGNPYSF; TIWGNPYSFA; IWGNPYSFAI; WGNPYSFAIF;
GNPYSFAIFA; NPYSFAIFAK 11 mers:

QGRIHGAHGPF; GRIHGAHGPFR; RIHGAHGPFRP; KSCLGKSSLNE; SCLGKSSLNEK;
CLGKSSLNEKS; LGKSSLNEKSL; GKSSLNEKSLF; KSSLNEKSLFK; SSLNEKSLFKE;
SLNEKSLFKEV; KNGAGCKGSSS; NGAGCKGSSSA; FSSLPRYPVLQ; SSLPRYPVLQG;
SLPRYPVLQGM; LPRYPVLQGMA; PRYPVLQGMAY; RYPVLQGMAYL; YPVLQGMAYLF;
PVLQGMAYLFQ; VLQGMAYLFQK; LQGMAYLFQKA; QGMAYLFQKAF; GMAYLFQKAFC;
MAYLFQKAFCA; AYLFQKAFCAL; YLFQKAFCALP; LFQKAFCALPL; FQKAFCALPLH;
QKAFCALPLHA; KAFCALPLHAM; AFCALPLHAMS; FCALPLHAMSA; KIFKKRALGLD;
IFKKRALGLDR; FKKRALGLDRL; KKRALGLDRLL; KRALGLDRLLL; RALGLDRLLLH;
LLHTVVWLRPN; RNSAMVGPNNW; NSAMVGPNNWR; SAMVGPNNWRN; AMVGPNNWRNS;
MVGPNNWRNSL; VGPNNWRNSLQ; GPNNWRNSLQR; PNNWRNSLQRS; NNWRNSLQRSK;
NWRNSLQRSKA; WRNSLQRSKAL; RNSLQRSKALR; VPTYGTEEWES; PTYGTEEWESW;
TYGTEEWESWW; YGTEEWESWWS; GTEEWESWWSS; TEEWESWWSSF; EEWESWWSSFN;
EWESWWSSFNE; WESWWSSFNEK; ESWWSSFNEKW; SWWSSFNEKWD; WWSSFNEKWDE;
WSSFNEKWDED; SSFNEKWDEDL; SFNEKWDEDLF; FNEKWDEDLFC; NEKWDEDLFCH;
EKWDEDLFCHE; KWDEDLFCHED; WDEDLFCHEDM; DEDLFCHEDMF; EDLFCHEDMFA;
DLFCHEDMFAS; LFCHEDMFASD; FCHEDMFASDE; CHEDMFASDEE; HEDMFASDEEA;
EDMFASDEEAT; DMFASDEEATA; MFASDEEATAD; FASDEEATADS; ASDEEATADSQ;
SDEEATADSQH; DEEATADSQHS; EEATADSQHST; EATADSQHSTP; ATADSQHSTPP;
TADSQHSTPPK; ADSQHSTPPKK; DSQHSTPPKKK; SQHSTPPKKKR; QHSTPPKKKRK;
HSTPPKKKRKV; STPPKKKRKVE; TPPKKKRKVED; PPKKKRKVEDP; PKKKRKVEDPK;
KKKRKVEDPKD; KKRKVEDPKDF; KRKVEDPKDFP; RKVEDPKDFPS; KVEDPKDFPSD;
VEDPKDFPSDL; EDPKDFPSDLH; DPKDFPSDLHQ; PKDFPSDLHQF; KDFPSDLHQFL;
DFPSDLHQFLS; FPSDLHQFLSQ; PSDLHQFLSQA; SDLHQFLSQAV; DLHQFLSQAVF;
LHQFLSQAVFS; HQFLSQAVFSN; QFLSQAVFSNR; FLSQAVFSNRT; LSQAVFSNRTL;
SQAVFSNRTLA; QAVFSNRTLAC; AVFSNRTLACF; VFSNRTLACFA; FSNRTLACFAV;
SNRTLACFAVY; NRTLACFAVYT; RTLACFAVYTT; TLACFAVYTTK; LACFAVYTTKE;
ACFAVYTTKEK; CFAVYTTKEKA; FAVYTTKEKAQ; AVYTTKEKAQI; VYTTKEKAQIL;
YTTKEKAQILY; TTKEKAQILYK; TKEKAQILYKK; KEKAQILYKKL; EKAQILYKKLM;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

KAQILYKKLME; AQILYKKLMEK; QILYKKLMEKY; ILYKKLMEKYS; LYKKLMEKYSV;
YKKLMEKYSVT; KKLMEKYSVTF; KLMEKYSVTFI; LMEKYSVTFIS; MEKYSVTFISR;
EKYSVTFISRH; KYSVTFISRHM; YSVTFISRHMC; SVTFISRHMCA; VTFISRHMCAG;
TFISRHMCAGH; FISRHMCAGHN; ISRHMCAGHNI; SRHMCAGHNII; RHMCAGHNIIF;
HMCAGHNIIFF; MCAGHNIIFFL; CAGHNIIFFLT; AGHNIIFFLTP; GHNIIFFLTPH;
HNIIFFLTPHR; NIIFFLTPHRH; IIFFLTPHRHR; IFFLTPHRHRV; FFLTPHRHRVS;
FLTPHRHRVSA; LTPHRHRVSAI; TPHRHRVSAIN; PHRHRVSAINN; HRHRVSAINNF;
RHRVSAINNFC; HRVSAINNFCQ; RVSAINNFCQK; VSAINNFCQKL; SAINNFCQKLC;
AINNFCQKLCT; INNFCQKLCTF; NNFCQKLCTFS; NFCQKLCTFSF; FCQKLCTFSFL;
CQKLCTFSFLI; QKLCTFSFLIC; KLCTFSFLICK; LCTFSFLICKG; CTFSFLICKGV;
TFSFLICKGVN; FSFLICKGVNK; SFLICKGVNKE; FLICKGVNKEY; LICKGVNKEYL;
ICKGVNKEYLL; CKGVNKEYLLY; KGVNKEYLLYS; GVNKEYLLYSA; VNKEYLLYSAL;
NKEYLLYSALT; KEYLLYSALTR; EYLLYSALTRD; YLLYSALTRDP; LLYSALTRDPY;
LYSALTRDPYH; YSALTRDPYHT; SALTRDPYHTI; ALTRDPYHTIE; LTRDPYHTIEE;
TRDPYHTIEES; RDPYHTIEESI; DPYHTIEESIQ; PYHTIEESIQG; YHTIEESIQGG;
HTIEESIQGGL; TIEESIQGGLK; IEESIQGGLKE; EESIQGGLKEH; ESIQGGLKEHD;
SIQGGLKEHDF; IQGGLKEHDFS; QGGLKEHDFSP; GGLKEHDFSPE; GLKEHDFSPEE;
LKEHDFSPEEP; KEHDFSPEEPE; EHDFSPEEPEE; HDFSPEEPEET; DFSPEEPEETK;
FSPEEPEETKQ; SPEEPEETKQV; PEEPEETKQVS; EEPEETKQVSW; EPEETKQVSWK;
PEETKQVSWKL; EETKQVSWKLI; ETKQVSWKLIT; TKQVSWKLITE; KQVSWKLITEY;
QVSWKLITEYA; VSWKLITEYAV; SWKLITEYAVE; WKLITEYAVET; KLITEYAVETK;
LITEYAVETKC; ITEYAVETKCE; TEYAVETKCED; EYAVETKCEDV; YAVETKCEDVF;
AVETKCEDVFL; VETKCEDVFLL; ETKCEDVFLLL; TKCEDVFLLLG; KCEDVFLLLGM;
CEDVFLLLGMY; EDVFLLLGMYL; DVFLLLGMYLE; VFLLLGMYLEF; FLLLGMYLEFQ;
LLLGMYLEFQY; LLGMYLEFQYN; LGMYLEFQYNV; GMYLEFQYNVE; MYLEFQYNVEE;
YLEFQYNVEEC; LEFQYNVEECK; EFQYNVEECKK; FQYNVEECKKC; QYNVEECKKCQ;
YNVEECKKCQK; NVEECKKCQKK; VEECKKCQKKD; EECKKCQKKDQ; ECKKCQKKDQP;
CKKCQKKDQPY; KKCQKKDQPYH; KCQKKDQPYHF; CQKKDQPYHFK; QKKDQPYHFKY;
KKDQPYHFKYH; KDQPYHFKYHE; DQPYHFKYHEK; QPYHFKYHEKH; PYHFKYHEKHF;
YHFKYHEKHFA; HFKYHEKHFAN; FKYHEKHFANA; KYHEKHFANAI; YHEKHFANAII;
HEKHFANAIIF; EKHFANAIIFA; KHFANAIIFAE; HFANAIIFAES; FANAIIFAESK;
ANAIIFAESKN; NAIIFAESKNQ; AIIFAESKNQK; IIFAESKNQKS; IFAESKNQKSI;
FAESKNQKSIC; AESKNQKSICQ; ESKNQKSICQQ; SKNQKSICQQA; KNQKSICQQAV;
NQKSICQQAVD; QKSICQQAVDT; KSICQQAVDTV; SICQQAVDTVL; ICQQAVDTVLA;
CQQAVDTVLAK; QQAVDTVLAKK; QAVDTVLAKKR; AVDTVLAKKRV; VDTVLAKKRVD;
DTVLAKKRVDT; TVLAKKRVDTL; VLAKKRVDTLH; LAKKRVDTLHM; AKKRVDTLHMT;
KKRVDTLHMTR; KRVDTLHMTRE; RVDTLHMTREE; VDTLHMTREEM; DTLHMTREEML;
TLHMTREEMLT; LHMTREEMLTE; HMTREEMLTER; MTREEMLTERF; TREEMLTERFN;
REEMLTERFNH; EEMLTERFNHI; EMLTERFNHIL; MLTERFNHILD; LTERFNHILDK;
TERFNHILDKM; ERFNHILDKMD; RFNHILDKMDL; FNHILDKMDLI; NHILDKMDLIF;
HILDKMDLIFG; ILDKMDLIFGA; LDKMDLIFGAH; DKMDLIFGAHG; KMDLIFGAHGN;
MDLIFGAHGNA; DLIFGAHGNAV; LIFGAHGNAVL; IFGAHGNAVLE; FGAHGNAVLEQ;
GAHGNAVLEQY; AHGNAVLEQYM; HGNAVLEQYMA; GNAVLEQYMAG; NAVLEQYMAGV;
AVLEQYMAGVA; VLEQYMAGVAW; LEQYMAGVAWL; EQYMAGVAWLH; QYMAGVAWLHC;
YMAGVAWLHCL; MAGVAWLHCLL; AGVAWLHCLLP; GVAWLHCLLPK; VAWLHCLLPKM;
AWLHCLLPKMD; WLHCLLPKMDS; LHCLLPKMDSV; HCLLPKMDSVI; CLLPKMDSVIF;
LLPKMDSVIFD; LPKMDSVIFDF; PKMDSVIFDFL; KMDSVIFDFLH; MDSVIFDFLHC;
DSVIFDFLHCI; SVIFDFLHCIV; VIFDFLHCIVF; IFDFLHCIVFN; FDFLHCIVFNV;
DFLHCIVFNVP; FLHCIVFNVPK; LHCIVFNVPKR; HCIVFNVPKRR; CIVFNVPKRRY;
IVFNVPKRRYW; VFNVPKRRYWL; FNVPKRRYWLF; NVPKRRYWLFK; VPKRRYWLFKG;
PKRRYWLFKGP; KRRYWLFKGPI; RRYWLFKGPID; RYWLFKGPIDS; YWLFKGPIDSG;
WLFKGPIDSGK; LFKGPIDSGKT; FKGPIDSGKTT; KGPIDSGKTTL; GPIDSGKTTLA;
PIDSGKTTLAA; IDSGKTTLAAG; DSGKTTLAAGL; SGKTTLAAGLL; GKTTLAAGLLD;
KTTLAAGLLDL; TTLAAGLLDLC; TLAAGLLDLCG; LAAGLLDLCGG; AAGLLDLCGGK;
AGLLDLCGGKA; GLLDLCGGKAL; LLDLCGGKALN; LDLCGGKALNV; DLCGGKALNVN;
LCGGKALNVNL; CGGKALNVNLP; GGKALNVNLPM; GKALNVNLPME; KALNVNLPMER;
ALNVNLPMERL; LNVNLPMERLT; NVNLPMERLTF; VNLPMERLTFE; NLPMERLTFEL;
LPMERLTFELG; PMERLTFELGV; MERLTFELGVA; ERLTFELGVAI; RLTFELGVAID;
LTFELGVAIDQ; TFELGVAIDQY; FELGVAIDQYM; ELGVAIDQYMV; LGVAIDQYMVV;
GVAIDQYMVVF; VAIDQYMVVFE; AIDQYMVVFED; IDQYMVVFEDV; DQYMVVFEDVK;
QYMVVFEDVKG; YMVVFEDVKGT; MVVFEDVKGTG; VVFEDVKGTGA; VFEDVKGTGAE;
FEDVKGTGAES; EDVKGTGAESK; DVKGTGAESKD; VKGTGAESKDL; KGTGAESKDLP;
GTGAESKDLPS; TGAESKDLPSG; GAESKDLPSGH; AESKDLPSGHI; ESKDLPSGHIG;
SKDLPSGHGIN; KDLPSGHGINN; DLPSGHGINNL; LPSGHGINNLD; PSGHGINNLDS;
SGHGINNLDSL; GHGINNLDSLR; HGINNLDSLRD; GINNLDSLRDY; INNLDSLRDYL;
NNLDSLRDYLD; NLDSLRDYLDG; LDSLRDYLDGS; DSLRDYLDGSV; SLRDYLDGSVK;
LRDYLDGSVKV; RDYLDGSVKVN; DYLDGSVKVNL; YLDGSVKVNLE; LDGSVKVNLEK;
DGSVKVNLEKK; GSVKVNLEKKH; SVKVNLEKKHL; VKVNLEKKHLN; KVNLEKKHLNK;
VNLEKKHLNKR; NLEKKHLNKRT; LEKKHLNKRTQ; EKKHLNKRTQI; KKHLNKRTQIF;
KHLNKRTQIFP; HLNKRTQIFPP; LNKRTQIFPPP; NKRTQIFPPGL; KRTQIFPPGLV;
RTQIFPPGLVT; TQIFPPGLVTM; QIFPPGLVTMN; IFPPGLVTMNE; FPPGLVTMNEY;
PPGLVTMNEYP; PGLVTMNEYPV; GLVTMNEYPVP; LVTMNEYPVPK; VTMNEYPVPKT;
TMNEYPVPKTL; MNEYPVPKTLQ; NEYPVPKTLQA; EYPVPKTLQAR; YPVPKTLQARF;
PVPKTLQARFV; VPKTLQARFVR; PKTLQARFVRQ; KTLQARFVRQI; TLQARFVRQID;
LQARFVRQIDF; QARFVRQIDFR; ARFVRQIDFRP; RFVRQIDFRPK; FVRQIDFRPKI;
VRQIDFRPKIY; RQIDFRPKIYL; QIDFRPKIYLR; IDFRPKIYLRK; DFRPKIYLRKS;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

FRPKIYLRKSL; RPKIYLRKSLQ; PKIYLRKSLQN; KIYLRKSLQNS; IYLRKSLQNSE;
YLRKSLQNSEF; LRKSLQNSEFL; RKSLQNSEFLL; KSLQNSEFLLE; SLQNSEFLLEK;
LQNSEFLLEKR; QNSEFLLEKRI; NSEFLLEKRIL; SEFLLEKRILQ; EFLLEKRILQS;
FLLEKRILQSG; LLEKRILQSGM; LEKRILQSGMT; EKRILQSGMTL; KRILQSGMTLL;
RILQSGMTLLL; ILQSGMTLLLL; LQSGMTLLLLL; QSGMTLLLLLI; SGMTLLLLLIW;
GMTLLLLLIWF; MTLLLLLIWFR; TLLLLLIWFRP; LLLLLIWFRPV; LLLLIWFRPVA;
LLLIWFRPVAD; LLIWFRPVADF; LIWFRPVADFA; IWFRPVADFAT; WFRPVADFATD;
FRPVADFATDI; RPVADFATDIQ; PVADFATDIQS; VADFATDIQSR; ADFATDIQSRI;
DFATDIQSRIV; FATDIQSRIVE; ATDIQSRIVEW; TDIQSRIVEWK; DIQSRIVEWKE;
IQSRIVEWKER; QSRIVEWKERL; SRIVEWKERLD; RIVEWKERLDS; IVEWKERLDSE;
VEWKERLDSEI; EWKERLDSEIS; WKERLDSEISM; KERLDSEISMY; ERLDSEISMYT;
RLDSEISMYTF; LDSEISMYTFS; DSEISMYTFSR; SEISMYTFSRM; EISMYTFSRMK;
ISMYTFSRMKY; SMYTFSRMKYN; MYTFSRMKYNI; YTFSRMKYNIC; TFSRMKYNICM;
FSRMKYNICMG; SRMKYNICMGK; RMKYNICMGKC; MKYNICMGKCI; KYNICMGKCIL;
YNICMGKCILD; NICMGKCILDI; ICMGKCILDIT; CMGKCILDITR; MGKCILDITRE;
GKCILDITREE; KCILDITREED; CILDITREEDS; ILDITREEDSE; LDITREEDSET;
DITREEDSETE; ITREEDSETED; TREEDSETEDS; REEDSETEDSG; EEDSETEDSGH;
EDSETEDSGHG; DSETEDSGHGS; SETEDSGHGSS; ETEDSGHGSST; TEDSGHGSSTE;
EDSGHGSSTES; DSGHGSSTESQ; SGHGSSTESQS; GHGSSTESQSQ; HGSSTESQSQC;
GSSTESQSQCS; SSTESQSQCSS; STESQSQCSSQ; TESQSQCSSQV; ESQSQCSSQVS;
SQSQCSSQVSD; QSQCSSQVSDT; SQCSSQVSDTS; QCSSQVSDTSA; CSSQVSDTSAP;
SSQVSDTSAPA; SQVSDTSAPAE; QVSDTSAPAED; VSDTSAPAEDS; SDTSAPAEDSQ;
DTSAPAEDSQR; TSAPAEDSQRS; SAPAEDSQRSD; APAEDSQRSDP; PAEDSQRSDPH;
AEDSQRSDPHS; EDSQRSDPHSQ; DSQRSDPHSQE; SQRSDPHSQEL; QRSDPHSQELH;
RSDPHSQELHL; SDPHSQELHLC; DPHSQELHLCK; PHSQELHLCKG; HSQELHLCKGF;
SQELHLCKGFQ; QELHLCKGFQC; ELHLCKGFQCF; LHLCKGFQCFK; HLCKGFQCFKR;
LCKGFQCFKRP; CKGFQCFKRPK; KGFQCFKRPKT; GFQCFKRPKTP; FQCFKRPKTPP;
QCFKRPKTPPP; CFKRPKTPPPK; HKLKSGLYKSS; KLKSGLYKSSI; LKSGLYKSSIY;
MYMYNKSTCLK; YMYNKSTCLKH; MYNKSTCLKHF; YNKSTCLKHFG; NKSTCLKHFGL;
KSTCLKHFGLQ; STCLKHFGLQL; TCLKHFGLQLS; CLKHFGLQLSL; LKHFGLQLSLF;
KHFGLQLSLFV; HFGLQLSLFVN; FGLQLSLFVNI; GLQLSLFVNIS; LQLSLFVNISY;
QLSLFVNISYH; LSLFVNISYHI; SLFVNISYHIW; LFVNISYHIWV; FVNISYHIWVP;
VNISYHIWVPW; NISYHIWVPWK; ISYHIWVPWKS; SYHIWVPWKSF; YHIWVPWKSFC;
HIWVPWKSFCA; IWVPWKSFCAI; WVPWKSFCAIK; VPWKSFCAIKH; PWKSFCAIKHP;
WKSFCAIKHPN; KSFCAIKHPNL; SFCAIKHPNLF; FCAIKHPNLFY; CAIKHPNLFYL;
AIKHPNLFYLG; IKHPNLFYLGF; KHPNLFYLGFH; HPNLFYLGFHT; PNLFYLGFHTI;
NLFYLGFHTIH; LFYLGFHTIHR; FYLGFHTIHRL; YLGFHTIHRLP; LGFHTIHRLPI;
GFHTIHRLPIH; FHTIHRLPIHS; HTIHRLPIHSL; TIHRLPIHSLG; IHRLPIHSLGS;
HRLPIHSLGSP; RLPIHSLGSPV; LPIHSLGSPVY; PIHSLGSPVYK; IHSLGSPVYKV;
HSLGSPVYKVT; QKGNWVRILYR; KGNWVRILYRS; GNWVRILYRSF; NWVRILYRSFS;
WVRILYRSFSQ; VRILYRSFSQA; RILYRSFSQAD; ILYRSFSQADL; LYRSFSQADLK;
YRSFSQADLKI; RSFSQADLKIS; SFSQADLKISC; FSQADLKISCK; SQADLKISCKA;
QADLKISCKAS; ADLKISCKASP; DLKISCKASPL; LKISCKASPLL; KISCKASPLLC;
ISCKASPLLCS; SCKASPLLCSR; CKASPLLCSRA; KASPLLCSRAV; ASPLLCSRAVS;
SPLLCSRAVSK; PLLCSRAVSKQ; LLCSRAVSKQA; LCSRAVSKQAT; CSRAVSKQATN;
SRAVSKQATNI; RAVSKQATNIS; AVSKQATNISS; NIQAISFTKRP; IQAISFTKRPH;
QAISFTKRPHT; AISFTKRPHTL; ISFTKRPHTLF; SFTKRPHTLFI; QHCGSCVGHMK;
HCGSCVGHMKY; CGSCVGHMKYW; GSCVGHMKYWG; SCVGHMKYWGN; CVGHMKYWGNI;
VGHMKYWGNIF; GHMKYWGNIFP; HMKYWGNIFPS; MKYWGNIFPSC; KYWGNIFPSCE;
YWGNIFPSCES; WGNIFPSCESP; GNIFPSCESPK; NIFPSCESPKI; IFPSCESPKIP;
FPSCESPKIPS; PSCESPKIPSI; SCESPKIPSIF; CESPKIPSIFI; ESPKIPSIFIS;
SPKIPSIFIST; PKIPSIFISTG; KIPSIFISTGI; IPSIFISTGIR; PSIFISTGIRY;
SIFISTGIRYP; IFISTGIRYPA; FISTGIRYPAL; ISTGIRYPALN; STGIRYPALNW;
TGIRYPALNWI; GIRYPALNWIS; IRYPALNWISI; RYPALNWISIV; YPALNWISIVF;
PALNWISIVFV; ALNWISIVFVQ; LNWISIVFVQI; NWISIVFVQIG; WISIVFVQIGL;
ISIVFVQIGLM; SIVFVQIGLMV; IVFVQIGLMVS; VFVQIGLMVSI; FVQIGLMVSIH;
VQIGLMVSIHY; QIGLMVSIHYL; IGLMVSIHYLG; GLMVSIHYLGL; LMVSIHYLGLG;
MVSIHYLGLGC; VSIHYLGLGCW; SIHYLGLGCWV; IHYLGLGCWVF; HYLGLGCWVFR;
YLGLGCWVFRG; LGLGCWVFRGY; GLGCWVFRGYS; LGCWVFRGYST; GCWVFRGYSTI;
CWVFRGYSTIR; WVFRGYSTIRV; VFRGYSTIRVL; HSLHFQGFSTY; SLHFQGFSTYS;
LHFQGFSTYSK; HFQGFSTYSKE; FQGFSTYSKEV; QGFSTYSKEVE; GFSTYSKEVEI;
FSTYSKEVEIT; STYSKEVEITA; TYSKEVEITAL; YSKEVEITALN; SKEVEITALNR;
KEVEITALNRF; EVEITALNRFS; VEITALNRFSS; EITALNRFSST; ITALNRFSSTM;
TALNRFSSTML; ALNRFSSTMLM; LNRFSSTMLMH; NRFSSTMLMHF; RFSSTMLMHFL;
PCMKVKHASYS; CMKVKHASYSN; MKVKHASYSNN; KVKHASYSNNL; VKHASYSNNLC;
KHASYSNNLCL; HASYSNNLCLY; ASYSNNLCLYS; SYSNNLCLYSY; YSNNLCLYSYS;
SNNLCLYSYSL; NNLCLYSYSLP; NLCLYSYSLPH; LCLYSYSLPHQ; IGEGNSCCAVT;
GEGNSCCAVTG; EGNSCCAVTGK; GNSCCAVTGKH; NSCCAVTGKHF; SCCAVTGKHFS;
CCAVTGKHFSL; CAVTGKHFSLW; AVTGKHFSLWA; VTGKHFSLWAI; TGKHFSLWAIT;
GKHFSLWAITA; KHFSLWAITAK; HFSLWAITAKV; FSLWAITAKVI; SLWAITAKVIF;
LWAITAKVIFS; WAITAKVIFST; TKAPKVFIWIP; KAPKVFIWIPH; APKVFIWIPHF;
PKVFIWIPHFW; KVFIWIPHFWV; EAFYLCNSIYP; AFYLCNSIYPS; FYLCNSIYPSF;
YLCNSIYPSFN; LCNSIYPSFNF; FWHLHGFLWLF; WHLHGFLWLFG; HLHGFLWLFGS;
LHGFLWLFGSC; HGFLWLFGSCP; GFLWLFGSCPW; FLWLFGSCPWT; LWLFGSCPWTL;
WLFGSCPWTLS; LFGSCPWTLSF; FGSCPWTLSFS; GSCPWTLSFSF; SCPWTLSFSFG;
CPWTLSFSFGW; PWTLSFSFGWG; WTLSFSFGWGH; TLSFSFGWGHL; LSFSFGWGHLH;

TABLE I-continued

Predicted MHC class 1 BK virus peptide sequences. Prediction of 8-, 9-, 10-, 11-mers from all 6 reading frames of the genome (access no #V01108) obtained using the program displayed in FIG. 2.

SFSFGWGHLHM; FSFGWGHLHML; SFGWGHLHMLQ; FGWGHLHMLQE; GWGHLHMLQEQ;
WGHLHMLQEQV; GHLHMLQEQVL; HLHMLQEQVLQ; LHMLQEQVLQS; HMLQEQVLQSR;
MLQEQVLQSRT; LQEQVLQSRTG; QEQVLQSRTGL; EQVLQSRTGLE; QVLQSRTGLEV;
VLQSRTGLEVK; LQSRTGLEVKA; QSRTGLEVKAT; SRTGLEVKATS; RTGLEVKATSI;
TGLEVKATSIE; GLEVKATSIEE; LEVKATSIEEQ; EVKATSIEEQF; VKATSIEEQFF;
KATSIEEQFFD; TLLNVHFVDFL; LLNVHFVDFLS; LNVHFVDFLSP; NVHFVDFLSPF;
VHFVDFLSPFF; HFVDFLSPFFV; LLLYCQHHLYY; LLYCQHHLYYK; LYCQHHLYYKY;
YCQHHLYYKYG; CQHHLYYKYGQ; QHHLYYKYGQN; HHLYYKYGQNV; HLYYKYGQNVH;
LYYKYGQNVHG; YYKYGQNVHGY; YKYGQNVHGYL; KYGQNVHGYLP; YGQNVHGYLPF;
GQNVHGYLPFQ; QNVHGYLPFQL; NVHGYLPFQLL; VHGYLPFQLLV; GKDQNNIVEYN;
KDQNNIVEYNY; DQNNIVEYNYK; QNNIVEYNYKS; NNIVEYNYKSL; KIFLFFSAIPV;
IFLFFSAIPVR; FLFFSAIPVRL; QKYLHQETEYH; KYLHQETEYHS; YLHQETEYHST;
LHQETEYHSTH; HQETEYHSTHL; QETEYHSTHLG; TIPKPCLIADR; IPKPCLIADRG;
PKPCLIADRGL; KPCLIADRGLQ; PCLIADRGLQW; CLIADRGLQWK; LIADRGLQWKL;
IADRGLQWKLC; ADRGLQWKLCD; DRGLQWKLCDP; RGLQWKLCDPN; GLQWKLCDPNH;
LQWKLCDPNHQ; QWKLCDPNHQR; WKLCDPNHQRT; KLCDPNHQRTY; LCDPNHQRTYT;
CDPNHQRTYTL; DPNHQRTYTLL; PNHQRTYTLLE; NHQRTYTLLEL; HQRTYTLLELR;
QRTYTLLELRN; PQEHQQLQHMF; QEHQQLQHMFE; EHQQLQHMFEE; HQQLQHMFEEL;
QQLQHMFEELG; QLQHMFEELGL; QQQPPQQQFQP; QQPPQQQFQPL; QPPQQQFQPLK;
PPQQQFQPLKI; PQQQFQPLKIL; QQQFQPLKILW; QQFQPLKILWQ; QFQPLKILWQQ;
FQPLKILWQQQ; QPLKILWQQQP; PLKILWQQQPQ; LKILWQQQPQI; KILWQQQPQIH;
ILWQQQPQIHW; LWQQQPQIHWQ; WQQQPQIHWQL; QQQPQIHWQLG; QQPQIHWQLGP;
QPQIHWQLGPP; PQIHWQLGPPK; QIHWQLGPPKV; IHWQLGPPKVL; HWQLGPPKVLE;
WQLGPPKVLEQ; QLGPPKVLEQH; LGPPKVLEQHP; TWKYKKKGITY; WKYKKKGITYL;
KYKKKGITYLG; YKKKGITYLGV; KKKGITYLGVF; KKGITYLGVFY; KGITYLGVFYR;
GITYLGVFYRV; ITYLGVFYRVF; TYLGVFYRVFY; YLGVFYRVFYS; LGVFYRVFYSR;
SSGTFVFPVYT; SGTFVFPVYTV; GTFVFPVYTVF; TFVFPVYTVFT; FVFPVYTVFTS;
VFPVYTVFTST; FPVYTVFTSTK; PVYTVFTSTKF; VYTVFTSTKFQ; YTVFTSTKFQQ;
TVFTSTKFQQK; VFTSTKFQQKL; NKNKNPLSSFF; KNKNPLSSFFC; NKNPLSSFFCS;
KNPLSSFFCSS; NPLSSFFCSSP; PLSSFFCSSPG; LSSFFCSSPGF; SSFFCSSPGFT;
SFFCSSPGFTN; FFCSSPGFTNF; FCSSPGFTNFH; QLAQNHGLCPV; LGTRPRFLGSQ;
GTRPRFLGSQN; TRPRFLGSQNM; RPRFLGSQNMS; PRFLGSQNMSV; RFLGSQNMSVM;
FLGSQNMSVMH; LGSQNMSVMHF; GSQNMSVMHFP; SQNMSVMHFPS; AAPPCESCTFL;
APPCESCTFLP; PPCESCTFLPE; PCESCTFLPEV; CESCTFLPEVM; ESCTFLPEVMV;
SCTFLPEVMVW; CTFLPEVMVWL; TFLPEVMVWLH; FLPEVMVWLHS; LPEVMVWLHSP;
PEVMVWLHSPV; EVMVWLHSPVS; VMVWLHSPVSH; MVWLHSPVSHA; VWLHSPVSHAL;
WLHSPVSHALS; LHSPVSHALSF; HSPVSHALSFL; SPVSHALSFLR; PVSHALSFLRS;
VSHALSFLRSW; SHALSFLRSWF; HALSFLRSWFG; ALSFLRSWFGC; LSFLRSWFGCI;
SFLRSWFGCIP; FLRSWFGCIPW; LRSWFGCIPWV; RSWFGCIPWVS; SWFGCIPWVSS;
WFGCIPWVSSS; FGCIPWVSSSS; GCIPWVSSSSL; CIPWVSSSSLW; IPWVSSSSLWP;
PWVSSSSLWPF; WVSSSSLWPFF; VSSSSLWPFFL; YIRGRGRLCLH; IRGRGRLCLHP;
RGRGRLCLHPF; GRGRLCLHPFS; RGRLCLHPFSQ; GRLCLHPFSQV; RLCLHPFSQVV;
LCLHPFSQVVR; CLHPFSQVVRV; LHPFSQVVRVW; HPFSQVVRVWR; PFSQVVRVWRL;
FSQVVRVWRLF; SQVVRVWRLFL; QVVRVWRLFLR; VVRVWRLFLRP; VRVWRLFLRPS;
RVWRLFLRPSK; VWRLFLRPSKT; WRLFLRPSKTI; RLFLRPSKTIW; LFLRPSKTIWG;
FLRPSKTIWGN; LRPSKTIWGNP; RPSKTIWGNPY; PSKTIWGNPYS; SKTIWGNPYSF;
KTIWGNPYSFA; TIWGNPYSFAI; IWGNPYSFAIF; WGNPYSFAIFA; GNPYSFAIFAK

SEQ ID NOS.: 7-24956

Preferred BK virus fragments of VP2-3 capable of interacting with one or more MHC class 1 molecules are listed in Table J.

TABLE J

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| | | | 8-mers | | | |
| 107 | KVSTVGLY | 0.435 | 454 | WB | VP2-3 | A0101 |
| 140 | FVNNIQYL | 0.674 | 33 | SB | VP2-3 | A0201 |
| 80 | FAALIQTV | 0.581 | 93 | WB | VP2-3 | A0201 |
| 195 | FLEETTWT | 0.576 | 98 | WB | VP2-3 | A0201 |
| 5 | ALLGDLVA | 0.564 | 111 | WB | VP2-3 | A0201 |
| 43 | SLATVEGI | 0.559 | 118 | WB | VP2-3 | A0201 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 293 | MLPLLLGL | 0.552 | 127 | WB | VP2-3 | A0201 |
| 40 | QIASLATV | 0.533 | 155 | WB | VP2-3 | A0201 |
| 61 | GLTPQTYA | 0.533 | 155 | WB | VP2-3 | A0201 |
| 296 | LLLGLYGT | 0.529 | 163 | WB | VP2-3 | A0201 |
| 76 | AIAGFAAL | 0.469 | 311 | WB | VP2-3 | A0201 |
| 89 | GISSLAQV | 0.456 | 358 | WB | VP2-3 | A0201 |
| 297 | LLGLYGTV | 0.439 | 433 | WB | VP2-3 | A0201 |
| 132 | ILFPGVNT | 0.434 | 457 | WB | VP2-3 | A0201 |
| 140 | FVNNIQYL | 0.869 | 4 | SB | VP2-3 | A0202 |
| 293 | MLPLLLGL | 0.799 | 8 | SB | VP2-3 | A0202 |
| 80 | FAALIQTV | 0.745 | 15 | SB | VP2-3 | A0202 |
| 43 | SLATVEGI | 0.730 | 18 | SB | VP2-3 | A0202 |
| 61 | GLTPQTYA | 0.709 | 23 | SB | VP2-3 | A0202 |
| 195 | FLEETTWT | 0.686 | 29 | SB | VP2-3 | A0202 |
| 76 | AIAGFAAL | 0.667 | 36 | SB | VP2-3 | A0202 |
| 89 | GISSLAQV | 0.640 | 49 | SB | VP2-3 | A0202 |
| 3 | ALALLGDL | 0.630 | 54 | WB | VP2-3 | A0202 |
| 297 | LLGLYGTV | 0.607 | 69 | WB | VP2-3 | A0202 |
| 40 | QIASLATV | 0.606 | 71 | WB | VP2-3 | A0202 |
| 0 | MGAALALL | 0.581 | 92 | WB | VP2-3 | A0202 |
| 112 | GLYQQSGM | 0.575 | 99 | WB | VP2-3 | A0202 |
| 287 | RTAPQWML | 0.543 | 139 | WB | VP2-3 | A0202 |
| 6 | LLGDLVAS | 0.539 | 146 | WB | VP2-3 | A0202 |
| 157 | FATISQAL | 0.530 | 162 | WB | VP2-3 | A0202 |
| 10 | LVASVSEA | 0.524 | 173 | WB | VP2-3 | A0202 |
| 296 | LLLGLYGT | 0.477 | 287 | WB | VP2-3 | A0202 |
| 155 | SLFATISQ | 0.473 | 298 | WB | VP2-3 | A0202 |
| 86 | TVTGISSL | 0.461 | 341 | WB | VP2-3 | A0202 |
| 62 | LTPQTYAV | 0.458 | 352 | WB | VP2-3 | A0202 |
| 114 | YQQSGMAL | 0.445 | 405 | WB | VP2-3 | A0202 |
| 13 | SVSEAAAA | 0.433 | 461 | WB | VP2-3 | A0202 |
| 18 | AAATGFSV | 0.427 | 490 | WB | VP2-3 | A0202 |
| 132 | ILFPGVNT | 0.427 | 491 | WB | VP2-3 | A0202 |
| 43 | SLATVEGI | 0.798 | 8 | SB | VP2-3 | A0203 |
| 140 | FVNNIQYL | 0.775 | 11 | SB | VP2-3 | A0203 |
| 297 | LLGLYGTV | 0.773 | 11 | SB | VP2-3 | A0203 |
| 40 | QIASLATV | 0.748 | 15 | SB | VP2-3 | A0203 |
| 80 | FAALIQTV | 0.730 | 18 | SB | VP2-3 | A0203 |
| 61 | GLTPQTYA | 0.706 | 24 | SB | VP2-3 | A0203 |
| 89 | GISSLAQV | 0.701 | 25 | SB | VP2-3 | A0203 |
| 76 | AIAGFAAL | 0.701 | 25 | SB | VP2-3 | A0203 |
| 83 | LIQTVTGI | 0.666 | 37 | SB | VP2-3 | A0203 |
| 18 | AAATGFSV | 0.649 | 44 | SB | VP2-3 | A0203 |
| 3 | ALALLGDL | 0.643 | 47 | SB | VP2-3 | A0203 |
| 112 | GLYQQSGM | 0.624 | 58 | WB | VP2-3 | A0203 |
| 10 | LVASVSEA | 0.604 | 72 | WB | VP2-3 | A0203 |
| 114 | YQQSGMAL | 0.558 | 119 | WB | VP2-3 | A0203 |
| 296 | LLLGLYGT | 0.552 | 127 | WB | VP2-3 | A0203 |
| 195 | FLEETTWT | 0.540 | 144 | WB | VP2-3 | A0203 |
| 132 | ILFPGVNT | 0.534 | 154 | WB | VP2-3 | A0203 |
| 62 | LTPQTYAV | 0.523 | 175 | WB | VP2-3 | A0203 |
| 69 | VIAGAPGA | 0.516 | 187 | WB | VP2-3 | A0203 |
| 161 | SQALWHVI | 0.493 | 241 | WB | VP2-3 | A0203 |
| 86 | TVTGISSL | 0.464 | 330 | WB | VP2-3 | A0203 |
| 5 | ALLGDLVA | 0.455 | 364 | WB | VP2-3 | A0203 |
| 13 | SVSEAAAA | 0.454 | 368 | WB | VP2-3 | A0203 |
| 268 | SVHSGEFI | 0.440 | 426 | WB | VP2-3 | A0203 |
| 167 | VIRDDIPA | 0.435 | 450 | WB | VP2-3 | A0203 |
| 297 | LLGLYGTV | 0.613 | 66 | WB | VP2-3 | A0204 |
| 43 | SLATVEGI | 0.584 | 90 | WB | VP2-3 | A0204 |
| 140 | FVNNIQYL | 0.522 | 175 | WB | VP2-3 | A0204 |
| 80 | FAALIQTV | 0.522 | 176 | WB | VP2-3 | A0204 |
| 287 | RTAPQWML | 0.509 | 203 | WB | VP2-3 | A0204 |
| 114 | YQQSGMAL | 0.793 | 9 | SB | VP2-3 | A0206 |
| 80 | FAALIQTV | 0.748 | 15 | SB | VP2-3 | A0206 |
| 18 | AAATGFSV | 0.743 | 16 | SB | VP2-3 | A0206 |
| 140 | FVNNIQYL | 0.719 | 20 | SB | VP2-3 | A0206 |

TABLE J-continued

Prediction of BK virus VP2-3 protein specific MHC
class1, 8-, 9-, 10-, 11-mer peptide binders for
42 MHC class 1 alleles (see FIG. 11) using the
www.cbs.dtu.dk/services/NetMHC/ database.
The MHC class 1 molecules for which no binders were
found are not listed.

| pos | peptide | logscore | affinity(nM) | Bind Level | Protein Name | Allele |
|---|---|---|---|---|---|---|
| 39 | VQIASLAT | 0.713 | 22 | SB | VP2-3 | A0206 |
| 161 | SQALWHVI | 0.700 | 25 | SB | VP2-3 | A0206 |
| 40 | QIASLATV | 0.665 | 37 | SB | VP2-3 | A0206 |
| 75 | GAIAGFAA | 0.665 | 37 | SB | VP2-3 | A0206 |
| 76 | AIAGFAAL | 0.657 | 40 | SB | VP2-3 | A0206 |
| 293 | MLPLLLGL | 0.644 | 47 | SB | VP2-3 | A0206 |
| 94 | AQVGYRFF | 0.637 | 50 | WB | VP2-3 | A0206 |
| 62 | LTPQTYAV | 0.598 | 77 | WB | VP2-3 | A0206 |
| 214 | IQDYYSNL | 0.578 | 96 | WB | VP2-3 | A0206 |
| 201 | WTIVNAPI | 0.563 | 112 | WB | VP2-3 | A0206 |
| 195 | FLEETTWT | 0.551 | 129 | WB | VP2-3 | A0206 |
| 296 | LLGLYGT | 0.550 | 129 | WB | VP2-3 | A0206 |
| 89 | GISSLAQV | 0.537 | 149 | WB | VP2-3 | A0206 |
| 5 | ALLGDLVA | 0.535 | 153 | WB | VP2-3 | A0206 |
| 157 | FATISQAL | 0.507 | 207 | WB | VP2-3 | A0206 |
| 13 | SVSEAAAA | 0.502 | 217 | WB | VP2-3 | A0206 |
| 287 | RTAPQWML | 0.501 | 221 | WB | VP2-3 | A0206 |
| 61 | GLTPQTYA | 0.499 | 226 | WB | VP2-3 | A0206 |
| 23 | FSVAEIAA | 0.479 | 279 | WB | VP2-3 | A0206 |
| 297 | LLGLYGTV | 0.477 | 286 | WB | VP2-3 | A0206 |
| 45 | ATVEGITT | 0.475 | 292 | WB | VP2-3 | A0206 |
| 4 | LALLGDLV | 0.460 | 346 | WB | VP2-3 | A0206 |
| 101 | FSDWDHKV | 0.454 | 366 | WB | VP2-3 | A0206 |
| 10 | LVASVSEA | 0.443 | 412 | WB | VP2-3 | A0206 |
| 132 | ILFPGVNT | 0.441 | 425 | WB | VP2-3 | A0206 |
| 247 | SIDNADSI | 0.437 | 440 | WB | VP2-3 | A0206 |
| 303 | TVTPALEA | 0.437 | 443 | WB | VP2-3 | A0206 |
| 43 | SLATVEGI | 0.433 | 463 | WB | VP2-3 | A0206 |
| 35 | AAIEVQIA | 0.427 | 493 | WB | VP2-3 | A0206 |
| 5 | ALLGDLVA | 0.884 | 3 | SB | VP2-3 | A0211 |
| 293 | MLPLLLGL | 0.861 | 4 | SB | VP2-3 | A0211 |
| 61 | GLTPQTYA | 0.856 | 4 | SB | VP2-3 | A0211 |
| 297 | LLGLYGTV | 0.852 | 4 | SB | VP2-3 | A0211 |
| 146 | YLDPRHWG | 0.842 | 5 | SB | VP2-3 | A0211 |
| 89 | GISSLAQV | 0.841 | 5 | SB | VP2-3 | A0211 |
| 155 | SLFATISQ | 0.823 | 6 | SB | VP2-3 | A0211 |
| 76 | AIAGFAAL | 0.819 | 7 | SB | VP2-3 | A0211 |
| 43 | SLATVEGI | 0.812 | 7 | SB | VP2-3 | A0211 |
| 40 | QIASLATV | 0.801 | 8 | SB | VP2-3 | A0211 |
| 296 | LLGLYGT | 0.762 | 13 | SB | VP2-3 | A0211 |
| 140 | FVNNIQYL | 0.727 | 19 | SB | VP2-3 | A0211 |
| 132 | ILFPGVNT | 0.718 | 21 | SB | VP2-3 | A0211 |
| 80 | FAALIQTV | 0.692 | 27 | SB | VP2-3 | A0211 |
| 195 | FLEETTWT | 0.687 | 29 | SB | VP2-3 | A0211 |
| 86 | TVTGISSL | 0.686 | 29 | SB | VP2-3 | A0211 |
| 101 | FSDWDHKV | 0.685 | 30 | SB | VP2-3 | A0211 |
| 62 | LTPQTYAV | 0.680 | 32 | SB | VP2-3 | A0211 |
| 18 | AAATGFSV | 0.673 | 34 | SB | VP2-3 | A0211 |
| 112 | GLYQQSGM | 0.663 | 38 | SB | VP2-3 | A0211 |
| 287 | RTAPQWML | 0.657 | 40 | SB | VP2-3 | A0211 |
| 247 | SIDNADSI | 0.657 | 40 | SB | VP2-3 | A0211 |
| 250 | NADSIEEV | 0.652 | 43 | SB | VP2-3 | A0211 |
| 262 | DLRNKESV | 0.628 | 56 | WB | VP2-3 | A0211 |
| 299 | GLYGTVTP | 0.595 | 79 | WB | VP2-3 | A0211 |
| 6 | LLGDLVAS | 0.595 | 79 | WB | VP2-3 | A0211 |
| 292 | WMLPLLLG | 0.555 | 123 | WB | VP2-3 | A0211 |
| 268 | SVHSGEFI | 0.540 | 145 | WB | VP2-3 | A0211 |
| 303 | TVTPALEA | 0.519 | 182 | WB | VP2-3 | A0211 |
| 3 | ALALLGDL | 0.514 | 191 | WB | VP2-3 | A0211 |
| 32 | EAAAAIEV | 0.514 | 192 | WB | VP2-3 | A0211 |
| 191 | SLARFLEE | 0.502 | 217 | WB | VP2-3 | A0211 |
| 13 | SVSEAAAA | 0.493 | 240 | WB | VP2-3 | A0211 |
| 69 | VIAGAPGA | 0.467 | 317 | WB | VP2-3 | A0211 |
| 4 | LALLGDLV | 0.450 | 382 | WB | VP2-3 | A0211 |
| 167 | VIRDDIPA | 0.450 | 384 | WB | VP2-3 | A0211 |
| 293 | MLPLLLGL | 0.799 | 8 | SB | VP2-3 | A0212 |
| 297 | LLGLYGTV | 0.778 | 11 | SB | VP2-3 | A0212 |
| 5 | ALLGDLVA | 0.772 | 11 | SB | VP2-3 | A0212 |
| 76 | AIAGFAAL | 0.741 | 16 | SB | VP2-3 | A0212 |

TABLE J-continued

Prediction of BK virus VP2-3 protein specific MHC
class1, 8-, 9-, 10-, 11-mer peptide binders for
42 MHC class 1 alleles (see FIG. 11) using the
www.cbs.dtu.dk/services/NetMHC/ database.
The MHC class 1 molecules for which no binders were
found are not listed.

| pos | peptide | logscore | affinity(nM) | Bind Level | Protein Name | Allele |
|---|---|---|---|---|---|---|
| 146 | YLDPRHWG | 0.731 | 18 | SB | VP2-3 | A0212 |
| 43 | SLATVEGI | 0.730 | 18 | SB | VP2-3 | A0212 |
| 296 | LLLGLYGT | 0.725 | 19 | SB | VP2-3 | A0212 |
| 140 | FVNNIQYL | 0.685 | 30 | SB | VP2-3 | A0212 |
| 40 | QIASLATV | 0.664 | 37 | SB | VP2-3 | A0212 |
| 112 | GLYQQSGM | 0.661 | 39 | SB | VP2-3 | A0212 |
| 132 | ILFPGVNT | 0.661 | 39 | SB | VP2-3 | A0212 |
| 80 | FAALIQTV | 0.654 | 42 | SB | VP2-3 | A0212 |
| 155 | SLFATISQ | 0.649 | 44 | SB | VP2-3 | A0212 |
| 62 | LTPQTYAV | 0.635 | 51 | WB | VP2-3 | A0212 |
| 61 | GLTPQTYA | 0.635 | 51 | WB | VP2-3 | A0212 |
| 195 | FLEETTWT | 0.616 | 63 | WB | VP2-3 | A0212 |
| 89 | GISSLAQV | 0.615 | 64 | WB | VP2-3 | A0212 |
| 262 | DLRNKESV | 0.607 | 70 | WB | VP2-3 | A0212 |
| 6 | LLGDLVAS | 0.562 | 114 | WB | VP2-3 | A0212 |
| 114 | YQQSGMAL | 0.562 | 114 | WB | VP2-3 | A0212 |
| 69 | VIAGAPGA | 0.521 | 178 | WB | VP2-3 | A0212 |
| 101 | FSDWDHKV | 0.505 | 211 | WB | VP2-3 | A0212 |
| 18 | AAATGFSV | 0.490 | 249 | WB | VP2-3 | A0212 |
| 287 | RTAPQWML | 0.482 | 270 | WB | VP2-3 | A0212 |
| 299 | GLYGTVTP | 0.463 | 335 | WB | VP2-3 | A0212 |
| 3 | ALALLGDL | 0.450 | 383 | WB | VP2-3 | A0212 |
| 213 | YIQDYYSN | 0.440 | 430 | WB | VP2-3 | A0212 |
| 297 | LLGLYGTV | 0.869 | 4 | SB | VP2-3 | A0216 |
| 61 | GLTPQTYA | 0.801 | 8 | SB | VP2-3 | A0216 |
| 89 | GISSLAQV | 0.801 | 8 | SB | VP2-3 | A0216 |
| 40 | QIASLATV | 0.770 | 11 | SB | VP2-3 | A0216 |
| 262 | DLRNKESV | 0.743 | 16 | SB | VP2-3 | A0216 |
| 76 | AIAGFAAL | 0.723 | 20 | SB | VP2-3 | A0216 |
| 155 | SLFATISQ | 0.689 | 28 | SB | VP2-3 | A0216 |
| 140 | FVNNIQYL | 0.684 | 30 | SB | VP2-3 | A0216 |
| 293 | MLPLLLGL | 0.670 | 35 | SB | VP2-3 | A0216 |
| 5 | ALLGDLVA | 0.656 | 41 | SB | VP2-3 | A0216 |
| 80 | FAALIQTV | 0.647 | 45 | SB | VP2-3 | A0216 |
| 195 | FLEETTWT | 0.641 | 48 | SB | VP2-3 | A0216 |
| 43 | SLATVEGI | 0.614 | 64 | WB | VP2-3 | A0216 |
| 18 | AAATGFSV | 0.614 | 65 | WB | VP2-3 | A0216 |
| 86 | TVTGISSL | 0.612 | 66 | WB | VP2-3 | A0216 |
| 112 | GLYQQSGM | 0.597 | 78 | WB | VP2-3 | A0216 |
| 132 | ILFPGVNT | 0.596 | 79 | WB | VP2-3 | A0216 |
| 62 | LTPQTYAV | 0.580 | 93 | WB | VP2-3 | A0216 |
| 250 | NADSIEEV | 0.545 | 136 | WB | VP2-3 | A0216 |
| 296 | LLLGLYGT | 0.536 | 152 | WB | VP2-3 | A0216 |
| 146 | YLDPRHWG | 0.527 | 167 | WB | VP2-3 | A0216 |
| 32 | EAAAAIEV | 0.507 | 206 | WB | VP2-3 | A0216 |
| 247 | SIDNADSI | 0.502 | 219 | WB | VP2-3 | A0216 |
| 268 | SVHSGEFI | 0.451 | 380 | WB | VP2-3 | A0216 |
| 250 | NADSIEEV | 0.620 | 61 | WB | VP2-3 | A0219 |
| 40 | QIASLATV | 0.614 | 65 | WB | VP2-3 | A0219 |
| 18 | AAATGFSV | 0.612 | 66 | WB | VP2-3 | A0219 |
| 293 | MLPLLLGL | 0.609 | 68 | WB | VP2-3 | A0219 |
| 43 | SLATVEGI | 0.596 | 78 | WB | VP2-3 | A0219 |
| 146 | YLDPRHWG | 0.579 | 95 | WB | VP2-3 | A0219 |
| 80 | FAALIQTV | 0.579 | 95 | WB | VP2-3 | A0219 |
| 296 | LLLGLYGT | 0.567 | 108 | WB | VP2-3 | A0219 |
| 140 | FVNNIQYL | 0.565 | 110 | WB | VP2-3 | A0219 |
| 89 | GISSLAQV | 0.562 | 114 | WB | VP2-3 | A0219 |
| 297 | LLGLYGTV | 0.543 | 139 | WB | VP2-3 | A0219 |
| 61 | GLTPQTYA | 0.537 | 150 | WB | VP2-3 | A0219 |
| 76 | AIAGFAAL | 0.526 | 168 | WB | VP2-3 | A0219 |
| 5 | ALLGDLVA | 0.523 | 174 | WB | VP2-3 | A0219 |
| 62 | LTPQTYAV | 0.508 | 205 | WB | VP2-3 | A0219 |
| 86 | TVTGISSL | 0.502 | 220 | WB | VP2-3 | A0219 |
| 195 | FLEETTWT | 0.500 | 223 | WB | VP2-3 | A0219 |
| 32 | EAAAAIEV | 0.455 | 364 | WB | VP2-3 | A0219 |
| 132 | ILFPGVNT | 0.452 | 374 | WB | VP2-3 | A0219 |
| 114 | YQQSGMAL | 0.451 | 378 | WB | VP2-3 | A0219 |
| 262 | DLRNKESV | 0.442 | 418 | WB | VP2-3 | A0219 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 107 | KVSTVGLY | 0.604 | 72 | WB | VP2-3 | A0301 |
| 322 | VSRGSSQK | 0.592 | 83 | WB | VP2-3 | A0301 |
| 335 | ASAKTTNK | 0.580 | 93 | WB | VP2-3 | A0301 |
| 239 | HVNFGHTY | 0.472 | 302 | WB | VP2-3 | A0301 |
| 335 | ASAKTTNK | 0.732 | 18 | SB | VP2-3 | A1101 |
| 270 | HSGEFIEK | 0.611 | 67 | WB | VP2-3 | A1101 |
| 257 | VTQRMDLR | 0.584 | 90 | WB | VP2-3 | A1101 |
| 107 | KVSTVGLY | 0.575 | 98 | WB | VP2-3 | A1101 |
| 339 | TTNKRRSR | 0.528 | 165 | WB | VP2-3 | A1101 |
| 92 | SLAQVGYR | 0.509 | 202 | WB | VP2-3 | A1101 |
| 175 | ITSQELQR | 0.479 | 280 | WB | VP2-3 | A1101 |
| 91 | SSLAQVGY | 0.475 | 293 | WB | VP2-3 | A1101 |
| 322 | VSRGSSQK | 0.474 | 297 | WB | VP2-3 | A1101 |
| 176 | TSQELQRR | 0.469 | 312 | WB | VP2-3 | A1101 |
| 97 | GYRFFSDW | 0.582 | 91 | WB | VP2-3 | A2301 |
| 145 | QYLDPRHW | 0.515 | 190 | WB | VP2-3 | A2301 |
| 133 | LFPGVNTF | 0.508 | 205 | WB | VP2-3 | A2301 |
| 100 | FFSDWDHK | 0.478 | 283 | WB | VP2-3 | A2301 |
| 217 | YYSNLSPI | 0.443 | 412 | WB | VP2-3 | A2301 |
| 194 | RFLEETTW | 0.435 | 453 | WB | VP2-3 | A2301 |
| 217 | YYSNLSPI | 0.742 | 16 | SB | VP2-3 | A2402 |
| 133 | LFPGVNTF | 0.635 | 51 | WB | VP2-3 | A2402 |
| 291 | QWMLPLLL | 0.529 | 163 | WB | VP2-3 | A2402 |
| 97 | GYRFFSDW | 0.659 | 40 | SB | VP2-3 | A2403 |
| 194 | RFLEETTW | 0.644 | 47 | SB | VP2-3 | A2403 |
| 217 | YYSNLSPI | 0.636 | 51 | WB | VP2-3 | A2403 |
| 133 | LFPGVNTF | 0.624 | 58 | WB | VP2-3 | A2403 |
| 145 | QYLDPRHW | 0.611 | 67 | WB | VP2-3 | A2403 |
| 304 | VTPALEAY | 0.815 | 7 | SB | VP2-3 | A2602 |
| 256 | EVTQRMDL | 0.685 | 30 | SB | VP2-3 | A2602 |
| 122 | ELFNPDEY | 0.657 | 40 | SB | VP2-3 | A2602 |
| 287 | RTAPQWML | 0.612 | 66 | WB | VP2-3 | A2602 |
| 239 | HVNFGHTY | 0.607 | 69 | WB | VP2-3 | A2602 |
| 107 | KVSTVGLY | 0.569 | 105 | WB | VP2-3 | A2602 |
| 76 | AIAGFAAL | 0.544 | 138 | WB | VP2-3 | A2602 |
| 267 | ESVHSGEF | 0.496 | 232 | WB | VP2-3 | A2602 |
| 158 | ATISQALW | 0.474 | 296 | WB | VP2-3 | A2602 |
| 140 | FVNNIQYL | 0.465 | 324 | WB | VP2-3 | A2602 |
| 210 | FYNYIQDY | 0.674 | 34 | SB | VP2-3 | A2902 |
| 239 | HVNFGHTY | 0.663 | 38 | SB | VP2-3 | A2902 |
| 123 | LFNPDEYY | 0.588 | 86 | WB | VP2-3 | A2902 |
| 139 | TFVNNIQY | 0.582 | 91 | WB | VP2-3 | A2902 |
| 122 | ELFNPDEY | 0.546 | 136 | WB | VP2-3 | A2902 |
| 211 | YNYIQDYY | 0.522 | 177 | WB | VP2-3 | A2902 |
| 107 | KVSTVGLY | 0.502 | 219 | WB | VP2-3 | A2902 |
| 204 | VNAPINFY | 0.450 | 383 | WB | VP2-3 | A2902 |
| 322 | VSRGSSQK | 0.699 | 26 | SB | VP2-3 | A3001 |
| 331 | KGTRASAK | 0.573 | 101 | WB | VP2-3 | A3001 |
| 228 | MVRQVAER | 0.521 | 178 | WB | VP2-3 | A3001 |
| 342 | KRRSRSSR | 0.469 | 312 | WB | VP2-3 | A3001 |
| 335 | ASAKTTNK | 0.448 | 393 | WB | VP2-3 | A3001 |
| 324 | RGSSQKAK | 0.442 | 420 | WB | VP2-3 | A3001 |
| 107 | KVSTVGLY | 0.586 | 88 | WB | VP2-3 | A3002 |
| 210 | FYNYIQDY | 0.499 | 226 | WB | VP2-3 | A3002 |
| 339 | TTNKRRSR | 0.798 | 8 | SB | VP2-3 | A3101 |
| 228 | MVRQVAER | 0.756 | 13 | SB | VP2-3 | A3101 |
| 327 | SQKAKGTR | 0.755 | 14 | SB | VP2-3 | A3101 |
| 257 | VTQRMDLR | 0.637 | 50 | WB | VP2-3 | A3101 |
| 336 | SAKTTNKR | 0.631 | 53 | WB | VP2-3 | A3101 |
| 187 | FFRDSLAR | 0.594 | 80 | WB | VP2-3 | A3101 |
| 92 | SLAQVGYR | 0.593 | 81 | WB | VP2-3 | A3101 |
| 218 | YSNLSPIR | 0.579 | 95 | WB | VP2-3 | A3101 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 162 | QALWHVIR | 0.557 | 120 | WB | VP2-3 | A3101 |
| 176 | TSQELQRR | 0.511 | 198 | WB | VP2-3 | A3101 |
| 179 | ELQRRTER | 0.476 | 288 | WB | VP2-3 | A3101 |
| 182 | RRTERFFR | 0.473 | 299 | WB | VP2-3 | A3101 |
| 143 | NIQYLDPR | 0.430 | 474 | WB | VP2-3 | A3101 |
| 179 | ELQRRTER | 0.741 | 16 | SB | VP2-3 | A3301 |
| 228 | MVRQVAER | 0.701 | 25 | SB | VP2-3 | A3301 |
| 187 | FFRDSLAR | 0.688 | 29 | SB | VP2-3 | A3301 |
| 339 | TTNKRRSR | 0.662 | 38 | SB | VP2-3 | A3301 |
| 143 | NIQYLDPR | 0.508 | 205 | WB | VP2-3 | A3301 |
| 228 | MVRQVAER | 0.823 | 6 | SB | VP2-3 | A6801 |
| 339 | TTNKRRSR | 0.774 | 11 | SB | VP2-3 | A6801 |
| 175 | ITSQELQR | 0.722 | 20 | SB | VP2-3 | A6801 |
| 92 | SLAQVGYR | 0.704 | 24 | SB | VP2-3 | A6801 |
| 218 | YSNLSPIR | 0.701 | 25 | SB | VP2-3 | A6801 |
| 253 | SIEEVTQR | 0.642 | 48 | SB | VP2-3 | A6801 |
| 143 | NIQYLDPR | 0.634 | 52 | WB | VP2-3 | A6801 |
| 162 | QALWHVIR | 0.599 | 76 | WB | VP2-3 | A6801 |
| 179 | ELQRRTER | 0.592 | 82 | WB | VP2-3 | A6801 |
| 257 | VTQRMDLR | 0.581 | 92 | WB | VP2-3 | A6801 |
| 336 | SAKTTNKR | 0.571 | 103 | WB | VP2-3 | A6801 |
| 176 | TSQELQRR | 0.567 | 107 | WB | VP2-3 | A6801 |
| 270 | HSGEFIEK | 0.558 | 119 | WB | VP2-3 | A6801 |
| 239 | HVNFGHTY | 0.520 | 180 | WB | VP2-3 | A6801 |
| 138 | NTFVNNIQ | 0.471 | 305 | WB | VP2-3 | A6801 |
| 122 | ELFNPDEY | 0.441 | 425 | WB | VP2-3 | A6801 |
| 100 | FFSDWDHK | 0.434 | 458 | WB | VP2-3 | A6801 |
| 32 | EAAAAIEV | 0.852 | 4 | SB | VP2-3 | A6802 |
| 80 | FAALIQTV | 0.773 | 11 | SB | VP2-3 | A6802 |
| 86 | TVTGISSL | 0.765 | 12 | SB | VP2-3 | A6802 |
| 201 | WTIVNAPI | 0.749 | 15 | SB | VP2-3 | A6802 |
| 55 | EAIAAIGL | 0.732 | 18 | SB | VP2-3 | A6802 |
| 140 | FVNNIQYL | 0.714 | 22 | SB | VP2-3 | A6802 |
| 199 | TTWTIVNA | 0.686 | 29 | SB | VP2-3 | A6802 |
| 62 | LTPQTYAV | 0.667 | 36 | SB | VP2-3 | A6802 |
| 244 | HTYSIDNA | 0.652 | 43 | SB | VP2-3 | A6802 |
| 287 | RTAPQWML | 0.650 | 44 | SB | VP2-3 | A6802 |
| 40 | QIASLATV | 0.640 | 49 | SB | VP2-3 | A6802 |
| 0 | MGAALALL | 0.635 | 51 | WB | VP2-3 | A6802 |
| 52 | TTSEAIAA | 0.624 | 58 | WB | VP2-3 | A6802 |
| 27 | EIAAGEAA | 0.616 | 63 | WB | VP2-3 | A6802 |
| 21 | TGFSVAEI | 0.588 | 86 | WB | VP2-3 | A6802 |
| 10 | LVASVSEA | 0.583 | 90 | WB | VP2-3 | A6802 |
| 18 | AAATGFSV | 0.561 | 115 | WB | VP2-3 | A6802 |
| 76 | AIAGFAAL | 0.537 | 149 | WB | VP2-3 | A6802 |
| 53 | TSEAIAAI | 0.500 | 223 | WB | VP2-3 | A6802 |
| 303 | TVTPALEA | 0.475 | 293 | WB | VP2-3 | A6802 |
| 185 | ERFFRDSL | 0.472 | 301 | WB | VP2-3 | A6802 |
| 256 | EVTQRMDL | 0.455 | 363 | WB | VP2-3 | A6802 |
| 157 | FATISQAL | 0.452 | 375 | WB | VP2-3 | A6802 |
| 23 | FSVAEIAA | 0.451 | 380 | WB | VP2-3 | A6802 |
| 13 | SVSEAAAA | 0.446 | 400 | WB | VP2-3 | A6802 |
| 38 | EVQIASLA | 0.440 | 427 | WB | VP2-3 | A6802 |
| 43 | SLATVEGI | 0.440 | 430 | WB | VP2-3 | A6802 |
| 250 | NADSIEEV | 0.433 | 460 | WB | VP2-3 | A6802 |
| 32 | EAAAAIEV | 0.788 | 9 | SB | VP2-3 | A6901 |
| 199 | TTWTIVNA | 0.689 | 28 | SB | VP2-3 | A6901 |
| 201 | WTIVNAPI | 0.671 | 35 | SB | VP2-3 | A6901 |
| 40 | QIASLATV | 0.635 | 52 | WB | VP2-3 | A6901 |
| 55 | EAIAAIGL | 0.619 | 61 | WB | VP2-3 | A6901 |
| 134 | FPGVNTFV | 0.612 | 66 | WB | VP2-3 | A6901 |
| 80 | FAALIQTV | 0.611 | 67 | WB | VP2-3 | A6901 |
| 101 | FSDWDHKV | 0.563 | 112 | WB | VP2-3 | A6901 |
| 27 | EIAAGEAA | 0.546 | 135 | WB | VP2-3 | A6901 |
| 62 | LTPQTYAV | 0.541 | 143 | WB | VP2-3 | A6901 |
| 140 | FVNNIQYL | 0.534 | 154 | WB | VP2-3 | A6901 |
| 244 | HTYSIDNA | 0.533 | 156 | WB | VP2-3 | A6901 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 250 | NADSIEEV | 0.521 | 178 | WB | VP2-3 | A6901 |
| 52 | TTSEAIAA | 0.511 | 198 | WB | VP2-3 | A6901 |
| 18 | AAATGFSV | 0.493 | 241 | WB | VP2-3 | A6901 |
| 287 | RTAPQWML | 0.476 | 289 | WB | VP2-3 | A6901 |
| 222 | SPIRPSMV | 0.469 | 313 | WB | VP2-3 | A6901 |
| 289 | APQWMLPL | 0.773 | 11 | SB | VP2-3 | B0702 |
| 225 | RPSMVRQV | 0.705 | 24 | SB | VP2-3 | B0702 |
| 222 | SPIRPSMV | 0.604 | 72 | WB | VP2-3 | B0702 |
| 153 | GPSLFATI | 0.482 | 272 | WB | VP2-3 | B0702 |
| 134 | FPGVNTFV | 0.477 | 287 | WB | VP2-3 | B0702 |
| 63 | TPQTYAVI | 0.476 | 289 | WB | VP2-3 | B0702 |
| 73 | APGAIAGF | 0.460 | 343 | WB | VP2-3 | B0702 |
| 114 | YQQSGMAL | 0.579 | 94 | WB | VP2-3 | B1501 |
| 180 | LQRRTERF | 0.557 | 120 | WB | VP2-3 | B1501 |
| 94 | AQVGYRFF | 0.550 | 129 | WB | VP2-3 | B1501 |
| 239 | HVNFGHTY | 0.550 | 130 | WB | VP2-3 | B1501 |
| 203 | IVNAPINF | 0.498 | 228 | WB | VP2-3 | B1501 |
| 39 | VQIASLAT | 0.466 | 321 | WB | VP2-3 | B1501 |
| 107 | KVSTVGLY | 0.464 | 331 | WB | VP2-3 | B1501 |
| 161 | SQALWHVI | 0.446 | 400 | WB | VP2-3 | B1501 |
| 127 | DEYYDILF | 0.753 | 14 | SB | VP2-3 | B1801 |
| 37 | IEVQIASL | 0.745 | 15 | SB | VP2-3 | B1801 |
| 233 | AEREGTHV | 0.477 | 286 | WB | VP2-3 | B1801 |
| 182 | RRTERFFR | 0.519 | 182 | WB | VP2-3 | B2705 |
| 342 | KRRSRSSR | 0.514 | 192 | WB | VP2-3 | B2705 |
| 259 | QRMDLRNK | 0.511 | 197 | WB | VP2-3 | B2705 |
| 320 | RRVSRGSS | 0.459 | 349 | WB | VP2-3 | B2705 |
| 294 | LPLLLGLY | 0.729 | 18 | SB | VP2-3 | B3501 |
| 16 | EAAAATGF | 0.672 | 34 | SB | VP2-3 | B3501 |
| 239 | HVNFGHTY | 0.639 | 49 | SB | VP2-3 | B3501 |
| 206 | APINFYNY | 0.606 | 71 | WB | VP2-3 | B3501 |
| 157 | FATISQAL | 0.598 | 77 | WB | VP2-3 | B3501 |
| 289 | APQWMLPL | 0.579 | 95 | WB | VP2-3 | B3501 |
| 139 | TFVNNIQY | 0.501 | 221 | WB | VP2-3 | B3501 |
| 93 | LAQVGYRF | 0.486 | 261 | WB | VP2-3 | B3501 |
| 123 | LFNPDEYY | 0.476 | 289 | WB | VP2-3 | B3501 |
| 73 | APGAIAGF | 0.469 | 313 | WB | VP2-3 | B3501 |
| 114 | YQQSGMAL | 0.547 | 134 | WB | VP2-3 | B3901 |
| 37 | IEVQIASL | 0.623 | 59 | WB | VP2-3 | B4001 |
| 272 | GEFIEKTI | 0.558 | 118 | WB | VP2-3 | B4001 |
| 127 | DEYYDILF | 0.459 | 346 | WB | VP2-3 | B4001 |
| 235 | REGTHVNF | 0.445 | 404 | WB | VP2-3 | B4001 |
| 233 | AEREGTHV | 0.430 | 476 | WB | VP2-3 | B4001 |
| 235 | REGTHVNF | 0.564 | 111 | WB | VP2-3 | B4002 |
| 197 | EETTWTIV | 0.485 | 263 | WB | VP2-3 | B4002 |
| 272 | GEFIEKTI | 0.467 | 318 | WB | VP2-3 | B4002 |
| 26 | AEIAAGEA | 0.493 | 240 | WB | VP2-3 | B4403 |
| 235 | REGTHVNF | 0.426 | 497 | WB | VP2-3 | B4403 |
| 26 | AEIAAGEA | 0.624 | 58 | WB | VP2-3 | B4501 |
| 233 | AEREGTHV | 0.483 | 269 | WB | VP2-3 | B4501 |
| 197 | EETTWTIV | 0.443 | 413 | WB | VP2-3 | B4501 |
| 153 | GPSLFATI | 0.494 | 238 | WB | VP2-3 | B5101 |
| 63 | TPQTYAVI | 0.493 | 241 | WB | VP2-3 | B5101 |
| 294 | LPLLLGLY | 0.483 | 269 | WB | VP2-3 | B5101 |
| 134 | FPGVNTFV | 0.466 | 321 | WB | VP2-3 | B5101 |
| 222 | SPIRPSMV | 0.440 | 427 | WB | VP2-3 | B5101 |
| 206 | APINFYNY | 0.677 | 32 | SB | VP2-3 | B5301 |
| 134 | FPGVNTFV | 0.594 | 81 | WB | VP2-3 | B5301 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 63 | TPQTYAVI | 0.488 | 254 | WB | VP2-3 | B5301 |
| 153 | GPSLFATI | 0.467 | 320 | WB | VP2-3 | B5301 |
| 134 | FPGVNTFV | 0.703 | 24 | SB | VP2-3 | B5401 |
| 294 | LPLLLGLY | 0.526 | 168 | WB | VP2-3 | B5401 |
| 80 | FAALIQTV | 0.437 | 443 | WB | VP2-3 | B5401 |
| 158 | ATISQALW | 0.681 | 31 | SB | VP2-3 | B5801 |
| 194 | RFLEETTW | 0.580 | 93 | WB | VP2-3 | B5801 |
| 287 | RTAPQWML | 0.551 | 129 | WB | VP2-3 | B5801 |
| 203 | IVNAPINF | 0.463 | 332 | WB | VP2-3 | B5801 |

9-mers

| pos | peptide | logscore | affinity(nM) | Bind Level | Protein Name | Allele |
|---|---|---|---|---|---|---|
| 138 | NTFVNNIQY | 0.453 | 373 | WB | VP2-3 | A0101 |
| 195 | FLEETTWTI | 0.822 | 6 | SB | VP2-3 | A0201 |
| 6 | LLGDLVASV | 0.810 | 7 | SB | VP2-3 | A0201 |
| 292 | WMLPLLLGL | 0.786 | 10 | SB | VP2-3 | A0201 |
| 213 | YIQDYYSNL | 0.758 | 13 | SB | VP2-3 | A0201 |
| 61 | GLTPQTYAV | 0.678 | 32 | SB | VP2-3 | A0201 |
| 82 | ALIQTVTGI | 0.643 | 47 | SB | VP2-3 | A0201 |
| 299 | GLYGTVTPA | 0.622 | 59 | WB | VP2-3 | A0201 |
| 159 | TISQALWHV | 0.608 | 69 | WB | VP2-3 | A0201 |
| 39 | VQIASLATV | 0.593 | 81 | WB | VP2-3 | A0201 |
| 296 | LLLGLYGTV | 0.532 | 157 | WB | VP2-3 | A0201 |
| 155 | SLFATISQA | 0.509 | 203 | WB | VP2-3 | A0201 |
| 3 | ALALLGDLV | 0.509 | 203 | WB | VP2-3 | A0201 |
| 76 | AIAGFAALI | 0.477 | 288 | WB | VP2-3 | A0201 |
| 17 | AAAATGFSV | 0.471 | 307 | WB | VP2-3 | A0201 |
| 100 | FFSDWDHKV | 0.465 | 327 | WB | VP2-3 | A0201 |
| 191 | SLARFLEET | 0.427 | 492 | WB | VP2-3 | A0201 |
| 61 | GLTPQTYAV | 0.877 | 3 | SB | VP2-3 | A0202 |
| 6 | LLGDLVASV | 0.801 | 8 | SB | VP2-3 | A0202 |
| 195 | FLEETTWTI | 0.800 | 8 | SB | VP2-3 | A0202 |
| 3 | ALALLGDLV | 0.789 | 9 | SB | VP2-3 | A0202 |
| 213 | YIQDYYSNL | 0.759 | 13 | SB | VP2-3 | A0202 |
| 159 | TISQALWHV | 0.692 | 27 | SB | VP2-3 | A0202 |
| 155 | SLFATISQA | 0.675 | 33 | SB | VP2-3 | A0202 |
| 292 | WMLPLLLGL | 0.671 | 35 | SB | VP2-3 | A0202 |
| 299 | GLYGTVTPA | 0.656 | 41 | SB | VP2-3 | A0202 |
| 82 | ALIQTVTGI | 0.656 | 41 | SB | VP2-3 | A0202 |
| 191 | SLARFLEET | 0.649 | 44 | SB | VP2-3 | A0202 |
| 10 | LVASVSEAA | 0.578 | 96 | WB | VP2-3 | A0202 |
| 52 | TTSEAIAAI | 0.559 | 118 | WB | VP2-3 | A0202 |
| 76 | AIAGFAALI | 0.550 | 130 | WB | VP2-3 | A0202 |
| 296 | LLLGLYGTV | 0.537 | 149 | WB | VP2-3 | A0202 |
| 39 | VQIASLATV | 0.505 | 211 | WB | VP2-3 | A0202 |
| 33 | AAAAIEVQI | 0.497 | 231 | WB | VP2-3 | A0202 |
| 220 | NLSPIRPSM | 0.483 | 269 | WB | VP2-3 | A0202 |
| 80 | FAALIQTVT | 0.482 | 272 | WB | VP2-3 | A0202 |
| 112 | GLYQQSGMA | 0.457 | 356 | WB | VP2-3 | A0202 |
| 75 | GAIAGFAAL | 0.449 | 388 | WB | VP2-3 | A0202 |
| 17 | AAAATGFSV | 0.447 | 396 | WB | VP2-3 | A0202 |
| 65 | QTYAVIAGA | 0.445 | 405 | WB | VP2-3 | A0202 |
| 36 | AIEVQIASL | 0.443 | 413 | WB | VP2-3 | A0202 |
| 136 | GVNTFVNNI | 0.436 | 444 | WB | VP2-3 | A0202 |
| 132 | ILFPGVNTF | 0.435 | 454 | WB | VP2-3 | A0202 |
| 100 | FFSDWDHKV | 0.428 | 488 | WB | VP2-3 | A0202 |
| 6 | LLGDLVASV | 0.941 | 1 | SB | VP2-3 | A0203 |
| 299 | GLYGTVTPA | 0.900 | 2 | SB | VP2-3 | A0203 |
| 61 | GLTPQTYAV | 0.878 | 3 | SB | VP2-3 | A0203 |
| 82 | ALIQTVTGI | 0.870 | 4 | SB | VP2-3 | A0203 |
| 39 | VQIASLATV | 0.845 | 5 | SB | VP2-3 | A0203 |
| 213 | YIQDYYSNL | 0.840 | 5 | SB | VP2-3 | A0203 |
| 292 | WMLPLLLGL | 0.787 | 10 | SB | VP2-3 | A0203 |
| 296 | LLLGLYGTV | 0.779 | 10 | SB | VP2-3 | A0203 |
| 195 | FLEETTWTI | 0.757 | 13 | SB | VP2-3 | A0203 |
| 112 | GLYQQSGMA | 0.739 | 16 | SB | VP2-3 | A0203 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 155 | SLFATISQA | 0.730 | 18 | SB | VP2-3 | A0203 |
| 65 | QTYAVIAGA | 0.690 | 28 | SB | VP2-3 | A0203 |
| 3 | ALALLGDLV | 0.687 | 29 | SB | VP2-3 | A0203 |
| 69 | VIAGAPGAI | 0.670 | 35 | SB | VP2-3 | A0203 |
| 136 | GVNTFVNNI | 0.666 | 37 | SB | VP2-3 | A0203 |
| 76 | AIAGFAALI | 0.664 | 37 | SB | VP2-3 | A0203 |
| 191 | SLARFLEET | 0.663 | 38 | SB | VP2-3 | A0203 |
| 159 | TISQALWHV | 0.608 | 69 | WB | VP2-3 | A0203 |
| 85 | QTVTGISSL | 0.606 | 70 | WB | VP2-3 | A0203 |
| 52 | TTSEAIAAI | 0.586 | 88 | WB | VP2-3 | A0203 |
| 167 | VIRDDIPAI | 0.553 | 125 | WB | VP2-3 | A0203 |
| 17 | AAAATGFSV | 0.540 | 145 | WB | VP2-3 | A0203 |
| 75 | GAIAGFAAL | 0.515 | 190 | WB | VP2-3 | A0203 |
| 10 | LVASVSEAA | 0.487 | 258 | WB | VP2-3 | A0203 |
| 18 | AAATGFSVA | 0.483 | 269 | WB | VP2-3 | A0203 |
| 20 | ATGFSVAEI | 0.460 | 344 | WB | VP2-3 | A0203 |
| 79 | GFAALIQTV | 0.447 | 396 | WB | VP2-3 | A0203 |
| 220 | NLSPIRPSM | 0.428 | 485 | WB | VP2-3 | A0203 |
| 6 | LLGDLVASV | 0.693 | 27 | SB | VP2-3 | A0204 |
| 195 | FLEETTWTI | 0.675 | 33 | SB | VP2-3 | A0204 |
| 61 | GLTPQTYAV | 0.670 | 35 | SB | VP2-3 | A0204 |
| 82 | ALIQTVTGI | 0.615 | 64 | WB | VP2-3 | A0204 |
| 155 | SLFATISQA | 0.590 | 84 | WB | VP2-3 | A0204 |
| 296 | LLLGLYGTV | 0.582 | 91 | WB | VP2-3 | A0204 |
| 100 | FFSDWDHKV | 0.570 | 104 | WB | VP2-3 | A0204 |
| 17 | AAAATGFSV | 0.494 | 238 | WB | VP2-3 | A0204 |
| 292 | WMLPLLLGL | 0.493 | 241 | WB | VP2-3 | A0204 |
| 213 | YIQDYYSNL | 0.491 | 246 | WB | VP2-3 | A0204 |
| 299 | GLYGTVTPA | 0.468 | 317 | WB | VP2-3 | A0204 |
| 159 | TISQALWHV | 0.463 | 333 | WB | VP2-3 | A0204 |
| 191 | SLARFLEET | 0.455 | 365 | WB | VP2-3 | A0204 |
| 39 | VQIASLATV | 0.928 | 2 | SB | VP2-3 | A0206 |
| 292 | WMLPLLLGL | 0.907 | 2 | SB | VP2-3 | A0206 |
| 195 | FLEETTWTI | 0.894 | 3 | SB | VP2-3 | A0206 |
| 61 | GLTPQTYAV | 0.849 | 5 | SB | VP2-3 | A0206 |
| 159 | TISQALWHV | 0.830 | 6 | SB | VP2-3 | A0206 |
| 6 | LLGDLVASV | 0.811 | 7 | SB | VP2-3 | A0206 |
| 75 | GAIAGFAAL | 0.805 | 8 | SB | VP2-3 | A0206 |
| 68 | AVIAGAPGA | 0.768 | 12 | SB | VP2-3 | A0206 |
| 17 | AAAATGFSV | 0.719 | 20 | SB | VP2-3 | A0206 |
| 82 | ALIQTVTGI | 0.701 | 25 | SB | VP2-3 | A0206 |
| 296 | LLLGLYGTV | 0.688 | 29 | SB | VP2-3 | A0206 |
| 45 | ATVEGITTT | 0.678 | 32 | SB | VP2-3 | A0206 |
| 94 | AQVGYRFFS | 0.625 | 57 | WB | VP2-3 | A0206 |
| 146 | YLDPRHWGP | 0.622 | 59 | WB | VP2-3 | A0206 |
| 213 | YIQDYYSNL | 0.593 | 81 | WB | VP2-3 | A0206 |
| 52 | TTSEAIAAI | 0.579 | 94 | WB | VP2-3 | A0206 |
| 10 | LVASVSEAA | 0.547 | 133 | WB | VP2-3 | A0206 |
| 129 | YYDILFPGV | 0.545 | 137 | WB | VP2-3 | A0206 |
| 288 | TAPQWMLPL | 0.544 | 139 | WB | VP2-3 | A0206 |
| 114 | YQQSGMALE | 0.542 | 141 | WB | VP2-3 | A0206 |
| 246 | YSIDNADSI | 0.520 | 180 | WB | VP2-3 | A0206 |
| 18 | AAATGFSVA | 0.517 | 186 | WB | VP2-3 | A0206 |
| 299 | GLYGTVTPA | 0.516 | 189 | WB | VP2-3 | A0206 |
| 85 | QTVTGISSL | 0.511 | 198 | WB | VP2-3 | A0206 |
| 76 | AIAGFAALI | 0.511 | 198 | WB | VP2-3 | A0206 |
| 29 | AAGEAAAAI | 0.508 | 205 | WB | VP2-3 | A0206 |
| 132 | ILFPGVNTF | 0.505 | 210 | WB | VP2-3 | A0206 |
| 230 | RQVAEREGT | 0.497 | 230 | WB | VP2-3 | A0206 |
| 3 | ALALLGDLV | 0.496 | 234 | WB | VP2-3 | A0206 |
| 65 | QTYAVIAGA | 0.478 | 282 | WB | VP2-3 | A0206 |
| 5 | ALLGDLVAS | 0.462 | 337 | WB | VP2-3 | A0206 |
| 167 | VIRDDIPAI | 0.444 | 409 | WB | VP2-3 | A0206 |
| 115 | QQSGMALEL | 0.438 | 437 | WB | VP2-3 | A0206 |
| 61 | GLTPQTYAV | 0.969 | 1 | SB | VP2-3 | A0211 |
| 6 | LLGDLVASV | 0.968 | 1 | SB | VP2-3 | A0211 |
| 296 | LLLGLYGTV | 0.950 | 1 | SB | VP2-3 | A0211 |
| 292 | WMLPLLLGL | 0.944 | 1 | SB | VP2-3 | A0211 |
| 195 | FLEETTWTI | 0.936 | 2 | SB | VP2-3 | A0211 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 159 | TISQALWHV | 0.904 | 2 | SB | VP2-3 | A0211 |
| 155 | SLFATISQA | 0.891 | 3 | SB | VP2-3 | A0211 |
| 299 | GLYGTVTPA | 0.884 | 3 | SB | VP2-3 | A0211 |
| 100 | FFSDWDHKV | 0.872 | 4 | SB | VP2-3 | A0211 |
| 146 | YLDPRHWGP | 0.871 | 4 | SB | VP2-3 | A0211 |
| 3 | ALALLGDLV | 0.860 | 4 | SB | VP2-3 | A0211 |
| 213 | YIQDYYSNL | 0.850 | 5 | SB | VP2-3 | A0211 |
| 220 | NLSPIRPSM | 0.829 | 6 | SB | VP2-3 | A0211 |
| 132 | ILFPGVNTF | 0.826 | 6 | SB | VP2-3 | A0211 |
| 76 | AIAGFAALI | 0.816 | 7 | SB | VP2-3 | A0211 |
| 191 | SLARFLEET | 0.802 | 8 | SB | VP2-3 | A0211 |
| 82 | ALIQTVTGI | 0.775 | 11 | SB | VP2-3 | A0211 |
| 129 | YYDILFPGV | 0.734 | 17 | SB | VP2-3 | A0211 |
| 92 | SLAQVGYRF | 0.679 | 32 | SB | VP2-3 | A0211 |
| 79 | GFAALIQTV | 0.662 | 38 | SB | VP2-3 | A0211 |
| 5 | ALLGDLVAS | 0.660 | 39 | SB | VP2-3 | A0211 |
| 112 | GLYQQSGMA | 0.658 | 40 | SB | VP2-3 | A0211 |
| 17 | AAAATGFSV | 0.657 | 41 | SB | VP2-3 | A0211 |
| 295 | PLLLGLYGT | 0.632 | 53 | WB | VP2-3 | A0211 |
| 133 | LFPGVNTFV | 0.594 | 80 | WB | VP2-3 | A0211 |
| 167 | VIRDDIPAI | 0.594 | 81 | WB | VP2-3 | A0211 |
| 253 | SIEEVTQRM | 0.567 | 108 | WB | VP2-3 | A0211 |
| 86 | TVTGISSLA | 0.472 | 303 | WB | VP2-3 | A0211 |
| 288 | TAPQWMLPL | 0.472 | 304 | WB | VP2-3 | A0211 |
| 27 | EIAAGEAAA | 0.450 | 383 | WB | VP2-3 | A0211 |
| 6 | LLGDLVASV | 0.931 | 2 | SB | VP2-3 | A0212 |
| 61 | GLTPQTYAV | 0.924 | 2 | SB | VP2-3 | A0212 |
| 296 | LLLGLYGTV | 0.910 | 2 | SB | VP2-3 | A0212 |
| 292 | WMLPLLLGL | 0.910 | 2 | SB | VP2-3 | A0212 |
| 213 | YIQDYYSNL | 0.894 | 3 | SB | VP2-3 | A0212 |
| 195 | FLEETTWTI | 0.892 | 3 | SB | VP2-3 | A0212 |
| 146 | YLDPRHWGP | 0.842 | 5 | SB | VP2-3 | A0212 |
| 100 | FFSDWDHKV | 0.833 | 6 | SB | VP2-3 | A0212 |
| 299 | GLYGTVTPA | 0.769 | 12 | SB | VP2-3 | A0212 |
| 159 | TISQALWHV | 0.717 | 21 | SB | VP2-3 | A0212 |
| 132 | ILFPGVNTF | 0.716 | 21 | SB | VP2-3 | A0212 |
| 167 | VIRDDIPAI | 0.698 | 26 | SB | VP2-3 | A0212 |
| 155 | SLFATISQA | 0.679 | 32 | SB | VP2-3 | A0212 |
| 82 | ALIQTVTGI | 0.678 | 32 | SB | VP2-3 | A0212 |
| 191 | SLARFLEET | 0.662 | 38 | SB | VP2-3 | A0212 |
| 3 | ALALLGDLV | 0.654 | 42 | SB | VP2-3 | A0212 |
| 129 | YYDILFPGV | 0.650 | 43 | SB | VP2-3 | A0212 |
| 220 | NLSPIRPSM | 0.622 | 59 | WB | VP2-3 | A0212 |
| 5 | ALLGDLVAS | 0.593 | 82 | WB | VP2-3 | A0212 |
| 79 | GFAALIQTV | 0.532 | 157 | WB | VP2-3 | A0212 |
| 133 | LFPGVNTFV | 0.528 | 164 | WB | VP2-3 | A0212 |
| 295 | PLLLGLYGT | 0.485 | 261 | WB | VP2-3 | A0212 |
| 27 | EIAAGEAAA | 0.471 | 306 | WB | VP2-3 | A0212 |
| 17 | AAAATGFSV | 0.450 | 383 | WB | VP2-3 | A0212 |
| 76 | AIAGFAALI | 0.448 | 393 | WB | VP2-3 | A0212 |
| 253 | SIEEVTQRM | 0.430 | 475 | WB | VP2-3 | A0212 |
| 6 | LLGDLVASV | 0.934 | 2 | SB | VP2-3 | A0216 |
| 61 | GLTPQTYAV | 0.916 | 2 | SB | VP2-3 | A0216 |
| 296 | LLLGLYGTV | 0.886 | 3 | SB | VP2-3 | A0216 |
| 159 | TISQALWHV | 0.864 | 4 | SB | VP2-3 | A0216 |
| 195 | FLEETTWTI | 0.847 | 5 | SB | VP2-3 | A0216 |
| 155 | SLFATISQA | 0.847 | 5 | SB | VP2-3 | A0216 |
| 299 | GLYGTVTPA | 0.835 | 5 | SB | VP2-3 | A0216 |
| 213 | YIQDYYSNL | 0.801 | 8 | SB | VP2-3 | A0216 |
| 100 | FFSDWDHKV | 0.789 | 9 | SB | VP2-3 | A0216 |
| 133 | LFPGVNTFV | 0.782 | 10 | SB | VP2-3 | A0216 |
| 292 | WMLPLLLGL | 0.764 | 12 | SB | VP2-3 | A0216 |
| 3 | ALALLGDLV | 0.763 | 12 | SB | VP2-3 | A0216 |
| 191 | SLARFLEET | 0.721 | 20 | SB | VP2-3 | A0216 |
| 82 | ALIQTVTGI | 0.677 | 33 | SB | VP2-3 | A0216 |
| 220 | NLSPIRPSM | 0.650 | 44 | SB | VP2-3 | A0216 |
| 76 | AIAGFAALI | 0.635 | 51 | WB | VP2-3 | A0216 |
| 17 | AAAATGFSV | 0.610 | 67 | WB | VP2-3 | A0216 |
| 132 | ILFPGVNTF | 0.584 | 90 | WB | VP2-3 | A0216 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 112 | GLYQQSGMA | 0.570 | 104 | WB | VP2-3 | A0216 |
| 92 | SLAQVGYRF | 0.552 | 127 | WB | VP2-3 | A0216 |
| 79 | GFAALIQTV | 0.522 | 176 | WB | VP2-3 | A0216 |
| 6 | LLGDLVASV | 0.930 | 2 | SB | VP2-3 | A0219 |
| 292 | WMLPLLLGL | 0.899 | 2 | SB | VP2-3 | A0219 |
| 61 | GLTPQTYAV | 0.888 | 3 | SB | VP2-3 | A0219 |
| 195 | FLEETTWTI | 0.848 | 5 | SB | VP2-3 | A0219 |
| 159 | TISQALWHV | 0.840 | 5 | SB | VP2-3 | A0219 |
| 100 | FFSDWDHKV | 0.782 | 10 | SB | VP2-3 | A0219 |
| 213 | YIQDYYSNL | 0.736 | 17 | SB | VP2-3 | A0219 |
| 296 | LLLGLYGTV | 0.726 | 19 | SB | VP2-3 | A0219 |
| 146 | YLDPRHWGP | 0.682 | 31 | SB | VP2-3 | A0219 |
| 82 | ALIQTVTGI | 0.643 | 47 | SB | VP2-3 | A0219 |
| 17 | AAAATGFSV | 0.629 | 55 | WB | VP2-3 | A0219 |
| 155 | SLFATISQA | 0.603 | 73 | WB | VP2-3 | A0219 |
| 299 | GLYGTVTPA | 0.564 | 111 | WB | VP2-3 | A0219 |
| 295 | PLLLGLYGT | 0.553 | 125 | WB | VP2-3 | A0219 |
| 129 | YYDILFPGV | 0.529 | 163 | WB | VP2-3 | A0219 |
| 220 | NLSPIRPSM | 0.528 | 164 | WB | VP2-3 | A0219 |
| 167 | VIRDDIPAI | 0.507 | 208 | WB | VP2-3 | A0219 |
| 132 | ILFPGVNTF | 0.504 | 214 | WB | VP2-3 | A0219 |
| 3 | ALALLGDLV | 0.475 | 291 | WB | VP2-3 | A0219 |
| 321 | RVSRGSSQK | 0.719 | 20 | SB | VP2-3 | A0301 |
| 334 | RASAKTTNK | 0.651 | 43 | SB | VP2-3 | A0301 |
| 203 | IVNAPINFY | 0.555 | 123 | WB | VP2-3 | A0301 |
| 293 | MLPLLLGLY | 0.473 | 299 | WB | VP2-3 | A0301 |
| 334 | RASAKTTNK | 0.729 | 18 | SB | VP2-3 | A1101 |
| 321 | RVSRGSSQK | 0.724 | 19 | SB | VP2-3 | A1101 |
| 91 | SSLAQVGYR | 0.688 | 29 | SB | VP2-3 | A1101 |
| 203 | IVNAPINFY | 0.666 | 37 | SB | VP2-3 | A1101 |
| 99 | RFFSDWDHK | 0.496 | 234 | WB | VP2-3 | A1101 |
| 158 | ATISQALWH | 0.460 | 345 | WB | VP2-3 | A1101 |
| 161 | SQALWHVIR | 0.457 | 356 | WB | VP2-3 | A1101 |
| 174 | AITSQELQR | 0.448 | 392 | WB | VP2-3 | A1101 |
| 139 | TFVNNIQYL | 0.584 | 90 | WB | VP2-3 | A2301 |
| 187 | FFRDSLARF | 0.577 | 97 | WB | VP2-3 | A2301 |
| 113 | LYQQSGMAL | 0.564 | 111 | WB | VP2-3 | A2301 |
| 132 | ILFPGVNTF | 0.521 | 178 | WB | VP2-3 | A2301 |
| 300 | LYGTVTPAL | 0.518 | 183 | WB | VP2-3 | A2301 |
| 216 | DYYSNLSPI | 0.482 | 271 | WB | VP2-3 | A2301 |
| 310 | AYEDGPNQK | 0.478 | 283 | WB | VP2-3 | A2301 |
| 202 | TIVNAPINF | 0.466 | 322 | WB | VP2-3 | A2301 |
| 99 | RFFSDWDHK | 0.466 | 323 | WB | VP2-3 | A2301 |
| 92 | SLAQVGYRF | 0.459 | 348 | WB | VP2-3 | A2301 |
| 300 | LYGTVTPAL | 0.661 | 39 | SB | VP2-3 | A2402 |
| 216 | DYYSNLSPI | 0.637 | 50 | WB | VP2-3 | A2402 |
| 156 | LFATISQAL | 0.560 | 116 | WB | VP2-3 | A2402 |
| 113 | LYQQSGMAL | 0.530 | 160 | WB | VP2-3 | A2402 |
| 200 | TWTIVNAPI | 0.452 | 374 | WB | VP2-3 | A2402 |
| 113 | LYQQSGMAL | 0.743 | 16 | SB | VP2-3 | A2403 |
| 139 | TFVNNIQYL | 0.591 | 83 | WB | VP2-3 | A2403 |
| 187 | FFRDSLARF | 0.572 | 102 | WB | VP2-3 | A2403 |
| 300 | LYGTVTPAL | 0.502 | 218 | WB | VP2-3 | A2403 |
| 292 | WMLPLLLGL | 0.426 | 498 | WB | VP2-3 | A2403 |
| 122 | ELFNPDEYY | 0.557 | 120 | WB | VP2-3 | A2601 |
| 303 | TVTPALEAY | 0.843 | 5 | SB | VP2-3 | A2602 |
| 203 | IVNAPINFY | 0.823 | 6 | SB | VP2-3 | A2602 |
| 122 | ELFNPDEYY | 0.792 | 9 | SB | VP2-3 | A2602 |
| 85 | QTVTGISSL | 0.778 | 11 | SB | VP2-3 | A2602 |
| 213 | YIQDYYSNL | 0.629 | 55 | WB | VP2-3 | A2602 |
| 293 | MLPLLLGLY | 0.578 | 96 | WB | VP2-3 | A2602 |
| 179 | ELQRRTERF | 0.551 | 128 | WB | VP2-3 | A2602 |
| 36 | AIEVQIASL | 0.518 | 183 | WB | VP2-3 | A2602 |
| 138 | NTFVNNIQY | 0.503 | 215 | WB | VP2-3 | A2602 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 187 | FFRDSLARF | 0.468 | 316 | WB | VP2-3 | A2602 |
| 202 | TIVNAPINF | 0.447 | 398 | WB | VP2-3 | A2602 |
| 62 | LTPQTYAVI | 0.442 | 416 | WB | VP2-3 | A2602 |
| 210 | FYNYIQDYY | 0.765 | 12 | SB | VP2-3 | A2902 |
| 122 | ELFNPDEYY | 0.716 | 21 | SB | VP2-3 | A2902 |
| 138 | NTFVNNIQY | 0.580 | 94 | WB | VP2-3 | A2902 |
| 203 | IVNAPINFY | 0.465 | 327 | WB | VP2-3 | A2902 |
| 209 | NFYNYIQDY | 0.457 | 357 | WB | VP2-3 | A2902 |
| 293 | MLPLLLGLY | 0.446 | 402 | WB | VP2-3 | A2902 |
| 99 | RFFSDWDHK | 0.765 | 12 | SB | VP2-3 | A3001 |
| 321 | RVSRGSSQK | 0.639 | 49 | SB | VP2-3 | A3001 |
| 334 | RASAKTTNK | 0.593 | 81 | WB | VP2-3 | A3001 |
| 186 | RFFRDSLAR | 0.501 | 222 | WB | VP2-3 | A3001 |
| 329 | KAKGTRASA | 0.446 | 401 | WB | VP2-3 | A3001 |
| 210 | FYNYIQDYY | 0.594 | 80 | WB | VP2-3 | A3002 |
| 203 | IVNAPINFY | 0.508 | 205 | WB | VP2-3 | A3002 |
| 293 | MLPLLLGLY | 0.466 | 321 | WB | VP2-3 | A3002 |
| 338 | KTTNKRRSR | 0.829 | 6 | SB | VP2-3 | A3101 |
| 316 | NQKKRRVSR | 0.804 | 8 | SB | VP2-3 | A3101 |
| 227 | SMVRQVAER | 0.772 | 11 | SB | VP2-3 | A3101 |
| 186 | RFFRDSLAR | 0.765 | 12 | SB | VP2-3 | A3101 |
| 91 | SSLAQVGYR | 0.756 | 13 | SB | VP2-3 | A3101 |
| 161 | SQALWHVIR | 0.641 | 48 | SB | VP2-3 | A3101 |
| 326 | SSQKAKGTR | 0.632 | 53 | WB | VP2-3 | A3101 |
| 334 | RASAKTTNK | 0.583 | 91 | WB | VP2-3 | A3101 |
| 217 | YYSNLSPIR | 0.570 | 105 | WB | VP2-3 | A3101 |
| 336 | SAKTTNKRR | 0.537 | 149 | WB | VP2-3 | A3101 |
| 99 | RFFSDWDHK | 0.504 | 214 | WB | VP2-3 | A3101 |
| 335 | ASAKTTNKR | 0.479 | 280 | WB | VP2-3 | A3101 |
| 321 | RVSRGSSQK | 0.435 | 453 | WB | VP2-3 | A3101 |
| 256 | EVTQRMDLR | 0.709 | 23 | SB | VP2-3 | A3301 |
| 316 | NQKKRRVSR | 0.703 | 24 | SB | VP2-3 | A3301 |
| 252 | DSIEEVTQR | 0.585 | 89 | WB | VP2-3 | A3301 |
| 341 | NKRRSRSSR | 0.463 | 333 | WB | VP2-3 | A3301 |
| 256 | EVTQRMDLR | 0.844 | 5 | SB | VP2-3 | A6801 |
| 252 | DSIEEVTQR | 0.787 | 10 | SB | VP2-3 | A6801 |
| 138 | NTFVNNIQY | 0.711 | 22 | SB | VP2-3 | A6801 |
| 175 | ITSQELQRR | 0.650 | 44 | SB | VP2-3 | A6801 |
| 279 | IAPGGANQR | 0.616 | 63 | WB | VP2-3 | A6801 |
| 217 | YYSNLSPIR | 0.607 | 70 | WB | VP2-3 | A6801 |
| 91 | SSLAQVGYR | 0.605 | 71 | WB | VP2-3 | A6801 |
| 227 | SMVRQVAER | 0.599 | 76 | WB | VP2-3 | A6801 |
| 335 | ASAKTTNKR | 0.531 | 160 | WB | VP2-3 | A6801 |
| 122 | ELFNPDEYY | 0.510 | 201 | WB | VP2-3 | A6801 |
| 210 | FYNYIQDYY | 0.503 | 217 | WB | VP2-3 | A6801 |
| 174 | AITSQELQR | 0.462 | 338 | WB | VP2-3 | A6801 |
| 142 | NNIQYLDPR | 0.461 | 341 | WB | VP2-3 | A6801 |
| 326 | SSQKAKGTR | 0.457 | 357 | WB | VP2-3 | A6801 |
| 321 | RVSRGSSQK | 0.456 | 360 | WB | VP2-3 | A6801 |
| 303 | TVTPALEAY | 0.454 | 367 | WB | VP2-3 | A6801 |
| 161 | SQALWHVIR | 0.451 | 379 | WB | VP2-3 | A6801 |
| 203 | IVNAPINFY | 0.449 | 388 | WB | VP2-3 | A6801 |
| 338 | KTTNKRRSR | 0.428 | 487 | WB | VP2-3 | A6801 |
| 336 | SAKTTNKRR | 0.427 | 493 | WB | VP2-3 | A6801 |
| 65 | QTYAVIAGA | 0.846 | 5 | SB | VP2-3 | A6802 |
| 52 | TTSEAIAAI | 0.827 | 6 | SB | VP2-3 | A6802 |
| 86 | TVTGISSLA | 0.764 | 12 | SB | VP2-3 | A6802 |
| 10 | LVASVSEAA | 0.709 | 23 | SB | VP2-3 | A6802 |
| 198 | ETTWTIVNA | 0.691 | 28 | SB | VP2-3 | A6802 |
| 85 | QTVTGISSL | 0.677 | 32 | SB | VP2-3 | A6802 |
| 16 | EAAAATGFS | 0.649 | 44 | SB | VP2-3 | A6802 |
| 267 | ESVHSGEFI | 0.602 | 73 | WB | VP2-3 | A6802 |
| 27 | EIAAGEAAA | 0.596 | 79 | WB | VP2-3 | A6802 |
| 17 | AAAATGFSV | 0.574 | 100 | WB | VP2-3 | A6802 |

TABLE J-continued

Prediction of BK virus VP2-3 protein specific MHC
class1, 8-, 9-, 10-, 11-mer peptide binders for
42 MHC class 1 alleles (see FIG. 11) using the
www.cbs.dtu.dk/services/NetMHC/ database.
The MHC class 1 molecules for which no binders were
found are not listed.

| pos | peptide | logscore | affinity(nM) | Bind Level | Protein Name | Allele |
|---|---|---|---|---|---|---|
| 249 | DNADSIEEV | 0.562 | 114 | WB | VP2-3 | A6802 |
| 166 | HVIRDDIPA | 0.561 | 115 | WB | VP2-3 | A6802 |
| 159 | TISQALWHV | 0.550 | 130 | WB | VP2-3 | A6802 |
| 88 | TGISSLAQV | 0.536 | 151 | WB | VP2-3 | A6802 |
| 48 | EGITTTSEA | 0.535 | 152 | WB | VP2-3 | A6802 |
| 246 | YSIDNADSI | 0.523 | 174 | WB | VP2-3 | A6802 |
| 76 | AIAGFAALI | 0.521 | 177 | WB | VP2-3 | A6802 |
| 55 | EAIAAIGLT | 0.484 | 267 | WB | VP2-3 | A6802 |
| 80 | FAALIQTVT | 0.481 | 273 | WB | VP2-3 | A6802 |
| 152 | WGPSLFATI | 0.478 | 284 | WB | VP2-3 | A6802 |
| 33 | AAAAIEVQI | 0.458 | 353 | WB | VP2-3 | A6802 |
| 288 | TAPQWMLPL | 0.443 | 416 | WB | VP2-3 | A6802 |
| 51 | TTTSEAIAA | 0.433 | 463 | WB | VP2-3 | A6802 |
| 65 | QTYAVIAGA | 0.710 | 23 | SB | VP2-3 | A6901 |
| 198 | ETTWTIVNA | 0.703 | 24 | SB | VP2-3 | A6901 |
| 52 | TTSEAIAAI | 0.684 | 30 | SB | VP2-3 | A6901 |
| 159 | TISQALWHV | 0.622 | 59 | WB | VP2-3 | A6901 |
| 292 | WMLPLLLGL | 0.604 | 72 | WB | VP2-3 | A6901 |
| 17 | AAAATGFSV | 0.601 | 74 | WB | VP2-3 | A6901 |
| 27 | EIAAGEAAA | 0.579 | 94 | WB | VP2-3 | A6901 |
| 195 | FLEETTWTI | 0.570 | 104 | WB | VP2-3 | A6901 |
| 288 | TAPQWMLPL | 0.545 | 137 | WB | VP2-3 | A6901 |
| 6 | LLGDLVASV | 0.506 | 209 | WB | VP2-3 | A6901 |
| 296 | LLLGLYGTV | 0.472 | 301 | WB | VP2-3 | A6901 |
| 100 | FFSDWDHKV | 0.429 | 484 | WB | VP2-3 | A6901 |
| 225 | RPSMVRQVA | 0.705 | 24 | SB | VP2-3 | B0702 |
| 172 | IPAITSQEL | 0.628 | 55 | WB | VP2-3 | B0702 |
| 148 | DPRHWGPSL | 0.610 | 67 | WB | VP2-3 | B0702 |
| 289 | APQWMLPLL | 0.598 | 77 | WB | VP2-3 | B0702 |
| 314 | GPNQKKRRV | 0.530 | 162 | WB | VP2-3 | B0702 |
| 206 | APINFYNYI | 0.475 | 294 | WB | VP2-3 | B0702 |
| 132 | ILFPGVNTF | 0.606 | 70 | WB | VP2-3 | B1501 |
| 203 | IVNAPINFY | 0.578 | 96 | WB | VP2-3 | B1501 |
| 180 | LQRRTERFF | 0.558 | 118 | WB | VP2-3 | B1501 |
| 115 | QQSGMALEL | 0.503 | 216 | WB | VP2-3 | B1501 |
| 39 | VQIASLATV | 0.477 | 287 | WB | VP2-3 | B1501 |
| 122 | ELFNPDEYY | 0.439 | 432 | WB | VP2-3 | B1501 |
| 92 | SLAQVGYRF | 0.428 | 489 | WB | VP2-3 | B1501 |
| 184 | TERFFRDSL | 0.622 | 59 | WB | VP2-3 | B1801 |
| 292 | WMLPLLLGL | 0.590 | 84 | WB | VP2-3 | B1801 |
| 148 | DPRHWGPSL | 0.584 | 90 | WB | VP2-3 | B1801 |
| 54 | SEAIAAIGL | 0.546 | 135 | WB | VP2-3 | B1801 |
| 255 | EEVTQRMDL | 0.451 | 380 | WB | VP2-3 | B1801 |
| 15 | SEAAATGF | 0.435 | 449 | WB | VP2-3 | B1801 |
| 320 | RRVSRGSSQ | 0.507 | 206 | WB | VP2-3 | B2705 |
| 303 | TVTPALEAY | 0.686 | 29 | SB | VP2-3 | B3501 |
| 172 | IPAITSQEL | 0.611 | 67 | WB | VP2-3 | B3501 |
| 125 | NPDEYYDIL | 0.606 | 71 | WB | VP2-3 | B3501 |
| 238 | THVNFGHTY | 0.550 | 130 | WB | VP2-3 | B3501 |
| 156 | LFATISQAL | 0.521 | 178 | WB | VP2-3 | B3501 |
| 67 | YAVIAGAPG | 0.510 | 199 | WB | VP2-3 | B3501 |
| 288 | TAPQWMLPL | 0.508 | 204 | WB | VP2-3 | B3501 |
| 289 | APQWMLPLL | 0.499 | 225 | WB | VP2-3 | B3501 |
| 132 | ILFPGVNTF | 0.484 | 265 | WB | VP2-3 | B3501 |
| 80 | FAALIQTVT | 0.470 | 310 | WB | VP2-3 | B3501 |
| 63 | TPQTYAVIA | 0.453 | 372 | WB | VP2-3 | B3501 |
| 28 | IAAGEAAAA | 0.446 | 400 | WB | VP2-3 | B3501 |
| 134 | FPGVNTFVN | 0.445 | 405 | WB | VP2-3 | B3501 |
| 205 | NAPINFYNY | 0.437 | 442 | WB | VP2-3 | B3501 |
| 13 | SVSEAAAAT | 0.433 | 461 | WB | VP2-3 | B3501 |
| 75 | GAIAGFAAL | 0.429 | 483 | WB | VP2-3 | B3501 |
| 54 | SEAIAAIGL | 0.703 | 24 | SB | VP2-3 | B4001 |
| 31 | GEAAAAIEV | 0.632 | 53 | WB | VP2-3 | B4001 |
| 255 | EEVTQRMDL | 0.542 | 141 | WB | VP2-3 | B4001 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 15 | SEAAAATGF | 0.509 | 202 | WB | VP2-3 | B4001 |
| 184 | TERFFRDSL | 0.467 | 319 | WB | VP2-3 | B4001 |
| | | | | | | |
| 266 | KESVHSGEF | 0.574 | 99 | WB | VP2-3 | B4002 |
| 255 | EEVTQRMDL | 0.532 | 158 | WB | VP2-3 | B4002 |
| 272 | GEFIEKTIA | 0.496 | 232 | WB | VP2-3 | B4002 |
| 15 | SEAAAATGF | 0.495 | 235 | WB | VP2-3 | B4002 |
| 54 | SEAIAAIGL | 0.445 | 405 | WB | VP2-3 | B4002 |
| | | | | | | |
| 54 | SEAIAAIGL | 0.492 | 243 | WB | VP2-3 | B4403 |
| 15 | SEAAAATGF | 0.476 | 288 | WB | VP2-3 | B4403 |
| 26 | AEIAAGEAA | 0.466 | 322 | WB | VP2-3 | B4403 |
| | | | | | | |
| 26 | AEIAAGEAA | 0.639 | 49 | SB | VP2-3 | B4501 |
| 255 | EEVTQRMDL | 0.521 | 178 | WB | VP2-3 | B4501 |
| 31 | GEAAAAIEV | 0.456 | 361 | WB | VP2-3 | B4501 |
| 197 | EETTWTIVN | 0.432 | 464 | WB | VP2-3 | B4501 |
| | | | | | | |
| 206 | APINFYNYI | 0.497 | 230 | WB | VP2-3 | B5101 |
| 294 | LPLLLGLYG | 0.451 | 381 | WB | VP2-3 | B5101 |
| | | | | | | |
| 206 | APINFYNYI | 0.608 | 69 | WB | VP2-3 | B5301 |
| 289 | APQWMLPLL | 0.545 | 136 | WB | VP2-3 | B5301 |
| 157 | FATISQALW | 0.522 | 176 | WB | VP2-3 | B5301 |
| | | | | | | |
| 206 | APINFYNYI | 0.614 | 64 | WB | VP2-3 | B5401 |
| 73 | APGAIAGFA | 0.573 | 100 | WB | VP2-3 | B5401 |
| 119 | MALELFNPD | 0.511 | 199 | WB | VP2-3 | B5401 |
| 134 | FPGVNTFVN | 0.502 | 218 | WB | VP2-3 | B5401 |
| 294 | LPLLLGLYG | 0.488 | 254 | WB | VP2-3 | B5401 |
| 63 | TPQTYAVIA | 0.478 | 282 | WB | VP2-3 | B5401 |
| 80 | FAALIQTVT | 0.464 | 329 | WB | VP2-3 | B5401 |
| | | | | | | |
| 157 | FATISQALW | 0.723 | 19 | SB | VP2-3 | B5801 |
| 90 | ISSLAQVGY | 0.546 | 136 | WB | VP2-3 | B5801 |
| 96 | VGYRFFSDW | 0.481 | 274 | WB | VP2-3 | B5801 |
| | | | 10-mers | | | |
| 237 | GTHVNFGHTY | 0.517 | 185 | WB | VP2-3 | A0101 |
| | | | | | | |
| 5 | ALLGDLVASV | 0.820 | 6 | SB | VP2-3 | A0201 |
| 132 | ILFPGVNTFV | 0.785 | 10 | SB | VP2-3 | A0201 |
| 299 | GLYGTVTPAL | 0.721 | 20 | SB | VP2-3 | A0201 |
| 195 | FLEETTWTIV | 0.703 | 24 | SB | VP2-3 | A0201 |
| 155 | SLFATISQAL | 0.632 | 53 | WB | VP2-3 | A0201 |
| 114 | YQQSGMALEL | 0.529 | 162 | WB | VP2-3 | A0201 |
| 158 | ATISQALWHV | 0.476 | 288 | WB | VP2-3 | A0201 |
| 199 | TTWTIVNAPI | 0.473 | 298 | WB | VP2-3 | A0201 |
| 61 | GLTPQTYAVI | 0.471 | 305 | WB | VP2-3 | A0201 |
| 112 | GLYQQSGMAL | 0.455 | 364 | WB | VP2-3 | A0201 |
| 260 | RMDLRNKESV | 0.442 | 418 | WB | VP2-3 | A0201 |
| 220 | NLSPIRPSMV | 0.436 | 445 | WB | VP2-3 | A0201 |
| 163 | ALWHVIRDDI | 0.430 | 476 | WB | VP2-3 | A0201 |
| | | | | | | |
| 132 | ILFPGVNTFV | 0.798 | 8 | SB | VP2-3 | A0202 |
| 5 | ALLGDLVASV | 0.785 | 10 | SB | VP2-3 | A0202 |
| 155 | SLFATISQAL | 0.742 | 16 | SB | VP2-3 | A0202 |
| 299 | GLYGTVTPAL | 0.680 | 32 | SB | VP2-3 | A0202 |
| 112 | GLYQQSGMAL | 0.654 | 42 | SB | VP2-3 | A0202 |
| 195 | FLEETTWTIV | 0.589 | 85 | WB | VP2-3 | A0202 |
| 3 | ALALLGDLVA | 0.583 | 91 | WB | VP2-3 | A0202 |
| 191 | SLARFLEETT | 0.557 | 120 | WB | VP2-3 | A0202 |
| 114 | YQQSGMALEL | 0.554 | 124 | WB | VP2-3 | A0202 |
| 296 | LLLGLYGTVT | 0.537 | 149 | WB | VP2-3 | A0202 |
| 138 | NTFVNNIQYL | 0.525 | 170 | WB | VP2-3 | A0202 |
| 220 | NLSPIRPSMV | 0.519 | 182 | WB | VP2-3 | A0202 |
| 158 | ATISQALWHV | 0.501 | 222 | WB | VP2-3 | A0202 |
| 10 | LVASVSEAAA | 0.479 | 280 | WB | VP2-3 | A0202 |
| 61 | GLTPQTYAVI | 0.466 | 322 | WB | VP2-3 | A0202 |
| 124 | FNPDEYYDIL | 0.461 | 342 | WB | VP2-3 | A0202 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 295 | PLLLGLYGTV | 0.450 | 382 | WB | VP2-3 | A0202 |
| 260 | RMDLRNKESV | 0.447 | 397 | WB | VP2-3 | A0202 |
| 293 | MLPLLLGLYG | 0.427 | 492 | WB | VP2-3 | A0202 |
| 2 | AALALLGDLV | 0.426 | 498 | WB | VP2-3 | A0202 |
| 132 | ILFPGVNTFV | 0.888 | 3 | SB | VP2-3 | A0203 |
| 5 | ALLGDLVASV | 0.868 | 4 | SB | VP2-3 | A0203 |
| 195 | FLEETTWTIV | 0.820 | 7 | SB | VP2-3 | A0203 |
| 299 | GLYGTVTPAL | 0.803 | 8 | SB | VP2-3 | A0203 |
| 220 | NLSPIRPSMV | 0.788 | 9 | SB | VP2-3 | A0203 |
| 112 | GLYQQSGMAL | 0.756 | 14 | SB | VP2-3 | A0203 |
| 61 | GLTPQTYAVI | 0.703 | 24 | SB | VP2-3 | A0203 |
| 155 | SLFATISQAL | 0.700 | 25 | SB | VP2-3 | A0203 |
| 239 | HVNFGHTYSI | 0.663 | 38 | SB | VP2-3 | A0203 |
| 287 | RTAPQWMLPL | 0.629 | 55 | WB | VP2-3 | A0203 |
| 260 | RMDLRNKESV | 0.533 | 156 | WB | VP2-3 | A0203 |
| 191 | SLARFLEETT | 0.530 | 161 | WB | VP2-3 | A0203 |
| 68 | AVIAGAPGAI | 0.529 | 163 | WB | VP2-3 | A0203 |
| 158 | ATISQALWHV | 0.516 | 187 | WB | VP2-3 | A0203 |
| 24 | SVAEIAAGEA | 0.513 | 193 | WB | VP2-3 | A0203 |
| 114 | YQQSGMALEL | 0.513 | 194 | WB | VP2-3 | A0203 |
| 35 | AAIEVQIASL | 0.509 | 203 | WB | VP2-3 | A0203 |
| 295 | PLLLGLYGTV | 0.503 | 217 | WB | VP2-3 | A0203 |
| 69 | VIAGAPGAIA | 0.490 | 248 | WB | VP2-3 | A0203 |
| 3 | ALALLGDLVA | 0.472 | 303 | WB | VP2-3 | A0203 |
| 10 | LVASVSEAAA | 0.471 | 304 | WB | VP2-3 | A0203 |
| 75 | GAIAGFAALI | 0.453 | 373 | WB | VP2-3 | A0203 |
| 85 | QTVTGISSLA | 0.440 | 425 | WB | VP2-3 | A0203 |
| 43 | SLATVEGITT | 0.431 | 473 | WB | VP2-3 | A0203 |
| 132 | ILFPGVNTFV | 0.738 | 17 | SB | VP2-3 | A0204 |
| 195 | FLEETTWTIV | 0.686 | 30 | SB | VP2-3 | A0204 |
| 5 | ALLGDLVASV | 0.678 | 32 | SB | VP2-3 | A0204 |
| 155 | SLFATISQAL | 0.630 | 54 | WB | VP2-3 | A0204 |
| 158 | ATISQALWHV | 0.567 | 108 | WB | VP2-3 | A0204 |
| 299 | GLYGTVTPAL | 0.485 | 263 | WB | VP2-3 | A0204 |
| 112 | GLYQQSGMAL | 0.468 | 317 | WB | VP2-3 | A0204 |
| 287 | RTAPQWMLPL | 0.457 | 356 | WB | VP2-3 | A0204 |
| 5 | ALLGDLVASV | 0.873 | 3 | SB | VP2-3 | A0206 |
| 195 | FLEETTWTIV | 0.869 | 4 | SB | VP2-3 | A0206 |
| 132 | ILFPGVNTFV | 0.865 | 4 | SB | VP2-3 | A0206 |
| 114 | YQQSGMALEL | 0.803 | 8 | SB | VP2-3 | A0206 |
| 158 | ATISQALWHV | 0.779 | 10 | SB | VP2-3 | A0206 |
| 35 | AAIEVQIASL | 0.711 | 22 | SB | VP2-3 | A0206 |
| 75 | GAIAGFAALI | 0.649 | 44 | SB | VP2-3 | A0206 |
| 287 | RTAPQWMLPL | 0.626 | 57 | WB | VP2-3 | A0206 |
| 299 | GLYGTVTPAL | 0.599 | 76 | WB | VP2-3 | A0206 |
| 68 | AVIAGAPGAI | 0.591 | 83 | WB | VP2-3 | A0206 |
| 67 | YAVIAGAPGA | 0.588 | 86 | WB | VP2-3 | A0206 |
| 84 | IQTVTGISSL | 0.569 | 105 | WB | VP2-3 | A0206 |
| 2 | AALALLGDLV | 0.550 | 129 | WB | VP2-3 | A0206 |
| 94 | AQVGYRFFSD | 0.537 | 150 | WB | VP2-3 | A0206 |
| 146 | YLDPRHWGPS | 0.525 | 169 | WB | VP2-3 | A0206 |
| 260 | RMDLRNKESV | 0.525 | 170 | WB | VP2-3 | A0206 |
| 166 | HVIRDDIPAI | 0.513 | 193 | WB | VP2-3 | A0206 |
| 288 | TAPQWMLPLL | 0.507 | 208 | WB | VP2-3 | A0206 |
| 155 | SLFATISQAL | 0.500 | 223 | WB | VP2-3 | A0206 |
| 39 | VQIASLATVE | 0.488 | 254 | WB | VP2-3 | A0206 |
| 24 | SVAEIAAGEA | 0.488 | 255 | WB | VP2-3 | A0206 |
| 194 | RFLEETTWTI | 0.480 | 276 | WB | VP2-3 | A0206 |
| 10 | LVASVSEAAA | 0.470 | 309 | WB | VP2-3 | A0206 |
| 112 | GLYQQSGMAL | 0.466 | 322 | WB | VP2-3 | A0206 |
| 220 | NLSPIRPSMV | 0.460 | 344 | WB | VP2-3 | A0206 |
| 159 | TISQALWHVI | 0.458 | 353 | WB | VP2-3 | A0206 |
| 17 | AAAATGFSVA | 0.457 | 354 | WB | VP2-3 | A0206 |
| 45 | ATVEGITTTS | 0.454 | 365 | WB | VP2-3 | A0206 |
| 231 | QVAEREGTHV | 0.453 | 371 | WB | VP2-3 | A0206 |
| 78 | AGFAALIQTV | 0.448 | 394 | WB | VP2-3 | A0206 |
| 115 | QQSGMALELF | 0.438 | 437 | WB | VP2-3 | A0206 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 81 | AALIQTVTGI | 0.433 | 460 | WB | VP2-3 | A0206 |
| 61 | GLTPQTYAVI | 0.432 | 466 | WB | VP2-3 | A0206 |
| 132 | ILFPGVNTFV | 0.975 | 1 | SB | VP2-3 | A0211 |
| 5 | ALLGDLVASV | 0.972 | 1 | SB | VP2-3 | A0211 |
| 155 | SLFATISQAL | 0.940 | 1 | SB | VP2-3 | A0211 |
| 299 | GLYGTVTPAL | 0.939 | 1 | SB | VP2-3 | A0211 |
| 195 | FLEETTWTIV | 0.931 | 2 | SB | VP2-3 | A0211 |
| 260 | RMDLRNKESV | 0.912 | 2 | SB | VP2-3 | A0211 |
| 220 | NLSPIRPSMV | 0.891 | 3 | SB | VP2-3 | A0211 |
| 295 | PLLLGLYGTV | 0.885 | 3 | SB | VP2-3 | A0211 |
| 112 | GLYQQSGMAL | 0.864 | 4 | SB | VP2-3 | A0211 |
| 61 | GLTPQTYAVI | 0.850 | 5 | SB | VP2-3 | A0211 |
| 146 | YLDPRHWGPS | 0.740 | 16 | SB | VP2-3 | A0211 |
| 191 | SLARFLEETT | 0.737 | 17 | SB | VP2-3 | A0211 |
| 128 | EYYDILFPGV | 0.731 | 18 | SB | VP2-3 | A0211 |
| 159 | TISQALWHVI | 0.674 | 34 | SB | VP2-3 | A0211 |
| 102 | SDWDHKVSTV | 0.641 | 48 | SB | VP2-3 | A0211 |
| 292 | WMLPLLLGLY | 0.638 | 50 | WB | VP2-3 | A0211 |
| 163 | ALWHVIRDDI | 0.620 | 60 | WB | VP2-3 | A0211 |
| 3 | ALALLGDLVA | 0.616 | 63 | WB | VP2-3 | A0211 |
| 92 | SLAQVGYRFF | 0.615 | 64 | WB | VP2-3 | A0211 |
| 158 | ATISQALWHV | 0.598 | 77 | WB | VP2-3 | A0211 |
| 99 | RFFSDWDHKV | 0.596 | 79 | WB | VP2-3 | A0211 |
| 287 | RTAPQWMLPL | 0.585 | 89 | WB | VP2-3 | A0211 |
| 78 | AGFAALIQTV | 0.570 | 105 | WB | VP2-3 | A0211 |
| 43 | SLATVEGITT | 0.568 | 107 | WB | VP2-3 | A0211 |
| 223 | PIRPSMVRQV | 0.566 | 109 | WB | VP2-3 | A0211 |
| 296 | LLLGLYGTVT | 0.548 | 133 | WB | VP2-3 | A0211 |
| 38 | EVQIASLATV | 0.532 | 158 | WB | VP2-3 | A0211 |
| 114 | YQQSGMALEL | 0.530 | 162 | WB | VP2-3 | A0211 |
| 194 | RFLEETTWTI | 0.518 | 184 | WB | VP2-3 | A0211 |
| 239 | HVNFGHTYSI | 0.510 | 199 | WB | VP2-3 | A0211 |
| 24 | SVAEIAAGEA | 0.497 | 230 | WB | VP2-3 | A0211 |
| 171 | DIPAITSQEL | 0.484 | 265 | WB | VP2-3 | A0211 |
| 231 | QVAEREGTHV | 0.484 | 265 | WB | VP2-3 | A0211 |
| 288 | TAPQWMLPLL | 0.470 | 310 | WB | VP2-3 | A0211 |
| 16 | EAAAATGFSV | 0.464 | 330 | WB | VP2-3 | A0211 |
| 87 | VTGISSLAQV | 0.454 | 366 | WB | VP2-3 | A0211 |
| 6 | LLGDLVASVS | 0.453 | 372 | WB | VP2-3 | A0211 |
| 35 | AAIEVQIASL | 0.437 | 439 | WB | VP2-3 | A0211 |
| 132 | ILFPGVNTFV | 0.943 | 1 | SB | VP2-3 | A0212 |
| 5 | ALLGDLVASV | 0.935 | 2 | SB | VP2-3 | A0212 |
| 195 | FLEETTWTIV | 0.906 | 2 | SB | VP2-3 | A0212 |
| 299 | GLYGTVTPAL | 0.904 | 2 | SB | VP2-3 | A0212 |
| 155 | SLFATISQAL | 0.880 | 3 | SB | VP2-3 | A0212 |
| 260 | RMDLRNKESV | 0.826 | 6 | SB | VP2-3 | A0212 |
| 220 | NLSPIRPSMV | 0.779 | 10 | SB | VP2-3 | A0212 |
| 112 | GLYQQSGMAL | 0.778 | 11 | SB | VP2-3 | A0212 |
| 295 | PLLLGLYGTV | 0.757 | 13 | SB | VP2-3 | A0212 |
| 191 | SLARFLEETT | 0.661 | 39 | SB | VP2-3 | A0212 |
| 61 | GLTPQTYAVI | 0.654 | 42 | SB | VP2-3 | A0212 |
| 163 | ALWHVIRDDI | 0.638 | 50 | WB | VP2-3 | A0212 |
| 128 | EYYDILFPGV | 0.616 | 63 | WB | VP2-3 | A0212 |
| 146 | YLDPRHWGPS | 0.615 | 64 | WB | VP2-3 | A0212 |
| 114 | YQQSGMALEL | 0.540 | 145 | WB | VP2-3 | A0212 |
| 296 | LLLGLYGTVT | 0.537 | 149 | WB | VP2-3 | A0212 |
| 102 | SDWDHKVSTV | 0.537 | 150 | WB | VP2-3 | A0212 |
| 231 | QVAEREGTHV | 0.480 | 278 | WB | VP2-3 | A0212 |
| 292 | WMLPLLLGLY | 0.456 | 358 | WB | VP2-3 | A0212 |
| 158 | ATISQALWHV | 0.442 | 419 | WB | VP2-3 | A0212 |
| 99 | RFFSDWDHKV | 0.441 | 423 | WB | VP2-3 | A0212 |
| 213 | YIQDYYSNLS | 0.431 | 472 | WB | VP2-3 | A0212 |
| 132 | ILFPGVNTFV | 0.955 | 1 | SB | VP2-3 | A0216 |
| 5 | ALLGDLVASV | 0.929 | 2 | SB | VP2-3 | A0216 |
| 299 | GLYGTVTPAL | 0.896 | 3 | SB | VP2-3 | A0216 |
| 195 | FLEETTWTIV | 0.888 | 3 | SB | VP2-3 | A0216 |
| 220 | NLSPIRPSMV | 0.866 | 4 | SB | VP2-3 | A0216 |
| 155 | SLFATISQAL | 0.857 | 4 | SB | VP2-3 | A0216 |

TABLE J-continued

Prediction of BK virus VP2-3 protein specific MHC
class1, 8-, 9-, 10-, 11-mer peptide binders for
42 MHC class 1 alleles (see FIG. 11) using the
www.cbs.dtu.dk/services/NetMHC/ database.
The MHC class 1 molecules for which no binders were
found are not listed.

| pos | peptide | logscore | affinity(nM) | Bind Level | Protein Name | Allele |
|---|---|---|---|---|---|---|
| 295 | PLLLGLYGTV | 0.819 | 7 | SB | VP2-3 | A0216 |
| 260 | RMDLRNKESV | 0.787 | 9 | SB | VP2-3 | A0216 |
| 112 | GLYQQSGMAL | 0.782 | 10 | SB | VP2-3 | A0216 |
| 61 | GLTPQTYAVI | 0.651 | 43 | SB | VP2-3 | A0216 |
| 191 | SLARFLEETT | 0.648 | 45 | SB | VP2-3 | A0216 |
| 158 | ATISQALWHV | 0.620 | 60 | WB | VP2-3 | A0216 |
| 102 | SDWDHKVSTV | 0.575 | 99 | WB | VP2-3 | A0216 |
| 163 | ALWHVIRDDI | 0.562 | 114 | WB | VP2-3 | A0216 |
| 231 | QVAEREGTHV | 0.553 | 125 | WB | VP2-3 | A0216 |
| 128 | EYYDILFPGV | 0.552 | 126 | WB | VP2-3 | A0216 |
| 38 | EVQIASLATV | 0.550 | 130 | WB | VP2-3 | A0216 |
| 223 | PIRPSMVRQV | 0.520 | 179 | WB | VP2-3 | A0216 |
| 43 | SLATVEGITT | 0.498 | 229 | WB | VP2-3 | A0216 |
| 99 | RFFSDWDHKV | 0.498 | 229 | WB | VP2-3 | A0216 |
| 171 | DIPAITSQEL | 0.485 | 262 | WB | VP2-3 | A0216 |
| 87 | VTGISSLAQV | 0.455 | 363 | WB | VP2-3 | A0216 |
| 16 | EAAAATGFSV | 0.451 | 379 | WB | VP2-3 | A0216 |
| 114 | YQQSGMALEL | 0.446 | 401 | WB | VP2-3 | A0216 |
| 78 | AGFAALIQTV | 0.438 | 434 | WB | VP2-3 | A0216 |
| 3 | ALALLGDLVA | 0.434 | 456 | WB | VP2-3 | A0216 |
| 59 | AIGLTPQTYA | 0.433 | 460 | WB | VP2-3 | A0216 |
| 296 | LLLGLYGTVT | 0.427 | 492 | WB | VP2-3 | A0216 |
| 5 | ALLGDLVASV | 0.918 | 2 | SB | VP2-3 | A0219 |
| 195 | FLEETTWTIV | 0.849 | 5 | SB | VP2-3 | A0219 |
| 299 | GLYGTVTPAL | 0.826 | 6 | SB | VP2-3 | A0219 |
| 220 | NLSPIRPSMV | 0.768 | 12 | SB | VP2-3 | A0219 |
| 155 | SLFATISQAL | 0.750 | 14 | SB | VP2-3 | A0219 |
| 260 | RMDLRNKESV | 0.698 | 26 | SB | VP2-3 | A0219 |
| 295 | PLLLGLYGTV | 0.664 | 37 | SB | VP2-3 | A0219 |
| 61 | GLTPQTYAVI | 0.545 | 137 | WB | VP2-3 | A0219 |
| 114 | YQQSGMALEL | 0.523 | 175 | WB | VP2-3 | A0219 |
| 128 | EYYDILFPGV | 0.521 | 177 | WB | VP2-3 | A0219 |
| 159 | TISQALWHVI | 0.498 | 228 | WB | VP2-3 | A0219 |
| 16 | EAAAATGFSV | 0.480 | 277 | WB | VP2-3 | A0219 |
| 112 | GLYQQSGMAL | 0.441 | 424 | WB | VP2-3 | A0219 |
| 158 | ATISQALWHV | 0.439 | 430 | WB | VP2-3 | A0219 |
| 268 | SVHSGEFIEK | 0.544 | 139 | WB | VP2-3 | A0301 |
| 329 | KAKGTRASAK | 0.506 | 208 | WB | VP2-3 | A0301 |
| 320 | RRVSRGSSQK | 0.471 | 306 | WB | VP2-3 | A0301 |
| 202 | TIVNAPINFY | 0.464 | 331 | WB | VP2-3 | A0301 |
| 292 | WMLPLLLGLY | 0.456 | 358 | WB | VP2-3 | A0301 |
| 268 | SVHSGEFIEK | 0.783 | 10 | SB | VP2-3 | A1101 |
| 257 | VTQRMDLRNK | 0.698 | 26 | SB | VP2-3 | A1101 |
| 160 | ISQALWHVIR | 0.561 | 115 | WB | VP2-3 | A1101 |
| 329 | KAKGTRASAK | 0.536 | 152 | WB | VP2-3 | A1101 |
| 202 | TIVNAPINFY | 0.497 | 230 | WB | VP2-3 | A1101 |
| 90 | ISSLAQVGYR | 0.464 | 329 | WB | VP2-3 | A1101 |
| 212 | NYIQDYYSNL | 0.652 | 43 | SB | VP2-3 | A2301 |
| 186 | RFFRDSLARF | 0.651 | 43 | SB | VP2-3 | A2301 |
| 194 | RFLEETTWTI | 0.548 | 132 | WB | VP2-3 | A2301 |
| 201 | WTIVNAPINF | 0.547 | 135 | WB | VP2-3 | A2301 |
| 310 | AYEDGPNQKK | 0.490 | 250 | WB | VP2-3 | A2301 |
| 245 | TYSIDNADSI | 0.489 | 252 | WB | VP2-3 | A2301 |
| 91 | SSLAQVGYRF | 0.461 | 340 | WB | VP2-3 | A2301 |
| 179 | ELQRRTERFF | 0.429 | 482 | WB | VP2-3 | A2301 |
| 212 | NYIQDYYSNL | 0.650 | 44 | SB | VP2-3 | A2402 |
| 194 | RFLEETTWTI | 0.609 | 69 | WB | VP2-3 | A2402 |
| 151 | HWGPSLFATI | 0.540 | 145 | WB | VP2-3 | A2402 |
| 245 | TYSIDNADSI | 0.529 | 162 | WB | VP2-3 | A2402 |
| 186 | RFFRDSLARF | 0.484 | 266 | WB | VP2-3 | A2402 |
| 156 | LFATISQALW | 0.476 | 290 | WB | VP2-3 | A2402 |
| 194 | RFLEETTWTI | 0.667 | 36 | SB | VP2-3 | A2403 |
| 186 | RFFRDSLARF | 0.659 | 39 | SB | VP2-3 | A2403 |
| 212 | NYIQDYYSNL | 0.619 | 62 | WB | VP2-3 | A2403 |

TABLE J-continued

Prediction of BK virus VP2-3 protein specific MHC
class1, 8-, 9-, 10-, 11-mer peptide binders for
42 MHC class 1 alleles (see FIG. 11) using the
www.cbs.dtu.dk/services/NetMHC/ database.
The MHC class 1 molecules for which no binders were
found are not listed.

| pos | peptide | logscore | affinity(nM) | Bind Level | Protein Name | Allele |
|---|---|---|---|---|---|---|
| 245 | TYSIDNADSI | 0.461 | 341 | WB | VP2-3 | A2403 |
| 291 | QWMLPLLLGL | 0.429 | 481 | WB | VP2-3 | A2403 |
| 202 | TIVNAPINFY | 0.620 | 60 | WB | VP2-3 | A2601 |
| 252 | DSIEEVTQRM | 0.617 | 63 | WB | VP2-3 | A2601 |
| 202 | TIVNAPINFY | 0.801 | 8 | SB | VP2-3 | A2602 |
| 302 | GTVTPALEAY | 0.771 | 11 | SB | VP2-3 | A2602 |
| 287 | RTAPQWMLPL | 0.760 | 13 | SB | VP2-3 | A2602 |
| 201 | WTIVNAPINF | 0.744 | 15 | SB | VP2-3 | A2602 |
| 179 | ELQRRTERFF | 0.735 | 17 | SB | VP2-3 | A2602 |
| 171 | DIPAITSQEL | 0.532 | 158 | WB | VP2-3 | A2602 |
| 166 | HVIRDDIPAI | 0.531 | 159 | WB | VP2-3 | A2602 |
| 131 | DILFPGVNTF | 0.488 | 253 | WB | VP2-3 | A2602 |
| 38 | EVQIASLATV | 0.471 | 304 | WB | VP2-3 | A2602 |
| 209 | NFYNYIQDYY | 0.572 | 102 | WB | VP2-3 | A2902 |
| 204 | VNAPINFYNY | 0.549 | 131 | WB | VP2-3 | A2902 |
| 292 | WMLPLLLGLY | 0.547 | 134 | WB | VP2-3 | A2902 |
| 329 | KAKGTRASAK | 0.783 | 10 | SB | VP2-3 | A3001 |
| 322 | VSRGSSQKAK | 0.757 | 13 | SB | VP2-3 | A3001 |
| 268 | SVHSGEFIEK | 0.678 | 32 | SB | VP2-3 | A3001 |
| 180 | LQRRTERFFR | 0.485 | 263 | WB | VP2-3 | A3001 |
| 237 | GTHVNFGHTY | 0.479 | 281 | WB | VP2-3 | A3001 |
| 89 | GISSLAQVGY | 0.518 | 184 | WB | VP2-3 | A3002 |
| 292 | WMLPLLLGLY | 0.511 | 198 | WB | VP2-3 | A3002 |
| 209 | NFYNYIQDYY | 0.475 | 292 | WB | VP2-3 | A3002 |
| 202 | TIVNAPINFY | 0.437 | 443 | WB | VP2-3 | A3002 |
| 180 | LQRRTERFFR | 0.756 | 14 | SB | VP2-3 | A3101 |
| 334 | RASAKTTNKR | 0.645 | 46 | SB | VP2-3 | A3101 |
| 337 | AKTTNKRRSR | 0.606 | 71 | WB | VP2-3 | A3101 |
| 160 | ISQALWHVIR | 0.591 | 83 | WB | VP2-3 | A3101 |
| 174 | AITSQELQRR | 0.577 | 97 | WB | VP2-3 | A3101 |
| 177 | SQELQRRTER | 0.543 | 140 | WB | VP2-3 | A3101 |
| 329 | KAKGTRASAK | 0.520 | 180 | WB | VP2-3 | A3101 |
| 90 | ISSLAQVGYR | 0.491 | 246 | WB | VP2-3 | A3101 |
| 340 | TNKRRSRSSR | 0.489 | 252 | WB | VP2-3 | A3101 |
| 226 | PSMVRQVAER | 0.471 | 305 | WB | VP2-3 | A3101 |
| 335 | ASAKTTNKRR | 0.455 | 363 | WB | VP2-3 | A3101 |
| 315 | PNQKKRRVSR | 0.448 | 393 | WB | VP2-3 | A3101 |
| 216 | DYYSNLSPIR | 0.588 | 86 | WB | VP2-3 | A3301 |
| 180 | LQRRTERFFR | 0.560 | 116 | WB | VP2-3 | A3301 |
| 160 | ISQALWHVIR | 0.507 | 206 | WB | VP2-3 | A3301 |
| 278 | TIAPGGANQR | 0.743 | 16 | SB | VP2-3 | A6801 |
| 309 | EAYEDGPNQK | 0.741 | 16 | SB | VP2-3 | A6801 |
| 90 | ISSLAQVGYR | 0.713 | 22 | SB | VP2-3 | A6801 |
| 216 | DYYSNLSPIR | 0.707 | 23 | SB | VP2-3 | A6801 |
| 268 | SVHSGEFIEK | 0.645 | 46 | SB | VP2-3 | A6801 |
| 185 | ERFFRDSLAR | 0.541 | 142 | WB | VP2-3 | A6801 |
| 334 | RASAKTTNKR | 0.535 | 152 | WB | VP2-3 | A6801 |
| 202 | TIVNAPINFY | 0.532 | 158 | WB | VP2-3 | A6801 |
| 160 | ISQALWHVIR | 0.498 | 228 | WB | VP2-3 | A6801 |
| 255 | EEVTQRMDLR | 0.495 | 237 | WB | VP2-3 | A6801 |
| 209 | NFYNYIQDYY | 0.464 | 329 | WB | VP2-3 | A6801 |
| 221 | LSPIRPSMVR | 0.439 | 434 | WB | VP2-3 | A6801 |
| 16 | EAAAATGFSV | 0.886 | 3 | SB | VP2-3 | A6802 |
| 199 | TTWTIVNAPI | 0.877 | 3 | SB | VP2-3 | A6802 |
| 32 | EAAAAIEVQI | 0.797 | 8 | SB | VP2-3 | A6802 |
| 138 | NTFVNNIQYL | 0.763 | 12 | SB | VP2-3 | A6802 |
| 239 | HVNFGHTYSI | 0.707 | 23 | SB | VP2-3 | A6802 |
| 287 | RTAPQWMLPL | 0.692 | 28 | SB | VP2-3 | A6802 |
| 24 | SVAEIAAGEA | 0.669 | 36 | SB | VP2-3 | A6802 |
| 51 | TTTSEAIAAI | 0.664 | 38 | SB | VP2-3 | A6802 |
| 205 | NAPINFYNYI | 0.663 | 38 | SB | VP2-3 | A6802 |
| 27 | EIAAGEAAAA | 0.642 | 47 | SB | VP2-3 | A6802 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 48 | EGITTTSEAI | 0.641 | 48 | SB | VP2-3 | A6802 |
| 85 | QTVTGISSLA | 0.637 | 50 | WB | VP2-3 | A6802 |
| 38 | EVQIASLATV | 0.608 | 69 | WB | VP2-3 | A6802 |
| 171 | DIPAITSQEL | 0.587 | 86 | WB | VP2-3 | A6802 |
| 10 | LVASVSEAAA | 0.570 | 105 | WB | VP2-3 | A6802 |
| 128 | EYYDILFPGV | 0.563 | 113 | WB | VP2-3 | A6802 |
| 220 | NLSPIRPSMV | 0.549 | 130 | WB | VP2-3 | A6802 |
| 132 | ILFPGVNTFV | 0.545 | 138 | WB | VP2-3 | A6802 |
| 166 | HVIRDDIPAI | 0.535 | 152 | WB | VP2-3 | A6802 |
| 155 | SLFATISQAL | 0.516 | 188 | WB | VP2-3 | A6802 |
| 159 | TISQALWHVI | 0.500 | 223 | WB | VP2-3 | A6802 |
| 28 | IAAGEAAAAI | 0.487 | 257 | WB | VP2-3 | A6802 |
| 231 | QVAEREGTHV | 0.474 | 296 | WB | VP2-3 | A6802 |
| 158 | ATISQALWHV | 0.457 | 357 | WB | VP2-3 | A6802 |
| 41 | IASLATVEGI | 0.435 | 450 | WB | VP2-3 | A6802 |
| 16 | EAAAATGFSV | 0.809 | 7 | SB | VP2-3 | A6901 |
| 199 | TTWTIVNAPI | 0.775 | 11 | SB | VP2-3 | A6901 |
| 128 | EYYDILFPGV | 0.674 | 34 | SB | VP2-3 | A6901 |
| 38 | EVQIASLATV | 0.655 | 41 | SB | VP2-3 | A6901 |
| 138 | NTFVNNIQYL | 0.647 | 45 | SB | VP2-3 | A6901 |
| 158 | ATISQALWHV | 0.607 | 69 | WB | VP2-3 | A6901 |
| 32 | EAAAAIEVQI | 0.603 | 73 | WB | VP2-3 | A6901 |
| 27 | EIAAGEAAAA | 0.569 | 105 | WB | VP2-3 | A6901 |
| 239 | HVNFGHTYSI | 0.516 | 187 | WB | VP2-3 | A6901 |
| 287 | RTAPQWMLPL | 0.511 | 198 | WB | VP2-3 | A6901 |
| 166 | HVIRDDIPAI | 0.505 | 210 | WB | VP2-3 | A6901 |
| 132 | ILFPGVNTFV | 0.497 | 229 | WB | VP2-3 | A6901 |
| 231 | QVAEREGTHV | 0.482 | 271 | WB | VP2-3 | A6901 |
| 5 | ALLGDLVASV | 0.460 | 346 | WB | VP2-3 | A6901 |
| 51 | TTTSEAIAAI | 0.451 | 381 | WB | VP2-3 | A6901 |
| 87 | VTGISSLAQV | 0.440 | 426 | WB | VP2-3 | A6901 |
| 288 | TAPQWMLPLL | 0.437 | 441 | WB | VP2-3 | A6901 |
| 24 | SVAEIAAGEA | 0.434 | 456 | WB | VP2-3 | A6901 |
| 289 | APQWMLPLLL | 0.641 | 48 | SB | VP2-3 | B0702 |
| 225 | RPSMVRQVAE | 0.621 | 60 | WB | VP2-3 | B0702 |
| 148 | DPRHWGPSLF | 0.517 | 185 | WB | VP2-3 | B0702 |
| 73 | APGAIAGFAA | 0.513 | 194 | WB | VP2-3 | B0702 |
| 292 | WMLPLLLGLY | 0.543 | 140 | WB | VP2-3 | B1501 |
| 115 | QQSGMALELF | 0.542 | 141 | WB | VP2-3 | B1501 |
| 114 | YQQSGMALEL | 0.537 | 150 | WB | VP2-3 | B1501 |
| 84 | IQTVTGISSL | 0.522 | 176 | WB | VP2-3 | B1501 |
| 155 | SLFATISQAL | 0.494 | 238 | WB | VP2-3 | B1501 |
| 230 | RQVAEREGTH | 0.480 | 276 | WB | VP2-3 | B1501 |
| 92 | SLAQVGYRFF | 0.475 | 291 | WB | VP2-3 | B1501 |
| 58 | AAIGLTPQTY | 0.469 | 311 | WB | VP2-3 | B1501 |
| 237 | GTHVNFGHTY | 0.447 | 398 | WB | VP2-3 | B1501 |
| 299 | GLYGTVTPAL | 0.434 | 457 | WB | VP2-3 | B1501 |
| 201 | WTIVNAPINF | 0.426 | 497 | WB | VP2-3 | B1501 |
| 233 | AEREGTHVNF | 0.711 | 22 | SB | VP2-3 | B1801 |
| 121 | LELFNPDEYY | 0.515 | 189 | WB | VP2-3 | B1801 |
| 178 | QELQRRTERF | 0.507 | 207 | WB | VP2-3 | B1801 |
| 37 | IEVQIASLAT | 0.487 | 257 | WB | VP2-3 | B1801 |
| 148 | DPRHWGPSLF | 0.482 | 273 | WB | VP2-3 | B1801 |
| 292 | WMLPLLLGLY | 0.445 | 407 | WB | VP2-3 | B1801 |
| 320 | RRVSRGSSQK | 0.631 | 54 | WB | VP2-3 | B2705 |
| 98 | YRFFSDWDHK | 0.450 | 383 | WB | VP2-3 | B2705 |
| 125 | NPDEYYDILF | 0.757 | 13 | SB | VP2-3 | B3501 |
| 58 | AAIGLTPQTY | 0.566 | 109 | WB | VP2-3 | B3501 |
| 148 | DPRHWGPSLF | 0.544 | 138 | WB | VP2-3 | B3501 |
| 28 | IAAGEAAAAI | 0.514 | 192 | WB | VP2-3 | B3501 |
| 202 | TIVNAPINFY | 0.476 | 289 | WB | VP2-3 | B3501 |
| 67 | YAVIAGAPGA | 0.456 | 358 | WB | VP2-3 | B3501 |
| 292 | WMLPLLLGLY | 0.447 | 397 | WB | VP2-3 | B3501 |
| 209 | NFYNYIQDYY | 0.429 | 480 | WB | VP2-3 | B3501 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 114 | YQQSGMALEL | 0.466 | 323 | WB | VP2-3 | B3901 |
| 233 | AEREGTHVNF | 0.508 | 204 | WB | VP2-3 | B4001 |
| 254 | IEEVTQRMDL | 0.497 | 230 | WB | VP2-3 | B4001 |
| 266 | KESVHSGEFI | 0.457 | 355 | WB | VP2-3 | B4002 |
| 233 | AEREGTHVNF | 0.450 | 382 | WB | VP2-3 | B4002 |
| 26 | AEIAAGEAAA | 0.461 | 340 | WB | VP2-3 | B4403 |
| 26 | AEIAAGEAAA | 0.637 | 50 | WB | VP2-3 | B4501 |
| 197 | EETTWTIVNA | 0.481 | 273 | WB | VP2-3 | B4501 |
| 233 | AEREGTHVNF | 0.474 | 297 | WB | VP2-3 | B4501 |
| 294 | LPLLLGLYGT | 0.583 | 91 | WB | VP2-3 | B5101 |
| 289 | APQWMLPLLL | 0.580 | 94 | WB | VP2-3 | B5301 |
| 125 | NPDEYYDILF | 0.476 | 289 | WB | VP2-3 | B5301 |
| 294 | LPLLLGLYGT | 0.816 | 7 | SB | VP2-3 | B5401 |
| 73 | APGAIAGFAA | 0.666 | 36 | SB | VP2-3 | B5401 |
| 134 | FPGVNTFVNN | 0.529 | 163 | WB | VP2-3 | B5401 |
| 192 | LARFLEETTW | 0.441 | 422 | WB | VP2-3 | B5701 |
| 283 | GANQRTAPQW | 0.661 | 39 | SB | VP2-3 | B5801 |
| 192 | LARFLEETTW | 0.570 | 105 | WB | VP2-3 | B5801 |
| 201 | WTIVNAPINF | 0.543 | 139 | WB | VP2-3 | B5801 |
| 156 | LFATISQALW | 0.490 | 247 | WB | VP2-3 | B5801 |
| 287 | RTAPQWMLPL | 0.462 | 337 | WB | VP2-3 | B5801 |
| 91 | SSLAQVGYRF | 0.439 | 432 | WB | VP2-3 | B5801 |
| 11-mers | | | | | | |
| 201 | WTIVNAPINFY | 0.505 | 212 | WB | VP2-3 | A0101 |
| 146 | YLDPRHWGPSL | 0.844 | 5 | SB | VP2-3 | A0201 |
| 247 | SIDNADSIEEV | 0.608 | 69 | WB | VP2-3 | A0201 |
| 157 | FATISQALWHV | 0.499 | 226 | WB | VP2-3 | A0201 |
| 297 | LLGLYGTVTPA | 0.443 | 413 | WB | VP2-3 | A0201 |
| 61 | GLTPQTYAVIA | 0.440 | 428 | WB | VP2-3 | A0201 |
| 80 | FAALIQTVTGI | 0.740 | 16 | SB | VP2-3 | A0202 |
| 146 | YLDPRHWGPSL | 0.686 | 29 | SB | VP2-3 | A0202 |
| 297 | LLGLYGTVTPA | 0.612 | 66 | WB | VP2-3 | A0202 |
| 293 | MLPLLLGLYGT | 0.607 | 69 | WB | VP2-3 | A0202 |
| 61 | GLTPQTYAVIA | 0.598 | 77 | WB | VP2-3 | A0202 |
| 24 | SVAEIAAGEAA | 0.577 | 96 | WB | VP2-3 | A0202 |
| 157 | FATISQALWHV | 0.572 | 102 | WB | VP2-3 | A0202 |
| 52 | TTSEAIAAIGL | 0.559 | 117 | WB | VP2-3 | A0202 |
| 40 | QIASLATVEGI | 0.554 | 124 | WB | VP2-3 | A0202 |
| 287 | RTAPQWMLPLL | 0.542 | 142 | WB | VP2-3 | A0202 |
| 247 | SIDNADSIEEV | 0.539 | 146 | WB | VP2-3 | A0202 |
| 92 | SLAQVGYRFFS | 0.525 | 170 | WB | VP2-3 | A0202 |
| 10 | LVASVSEAAAA | 0.525 | 170 | WB | VP2-3 | A0202 |
| 59 | AIGLTPQTYAV | 0.518 | 183 | WB | VP2-3 | A0202 |
| 86 | TVTGISSLAQV | 0.493 | 241 | WB | VP2-3 | A0202 |
| 43 | SLATVEGITTT | 0.487 | 258 | WB | VP2-3 | A0202 |
| 3 | ALALLGDLVAS | 0.480 | 278 | WB | VP2-3 | A0202 |
| 34 | AAAIEVQIASL | 0.471 | 305 | WB | VP2-3 | A0202 |
| 83 | LIQTVTGISSL | 0.467 | 318 | WB | VP2-3 | A0202 |
| 1 | GAALALLGDLV | 0.467 | 320 | WB | VP2-3 | A0202 |
| 244 | HTYSIDNADSI | 0.466 | 324 | WB | VP2-3 | A0202 |
| 155 | SLFATISQALW | 0.458 | 350 | WB | VP2-3 | A0202 |
| 274 | FIEKTIAPGGA | 0.427 | 490 | WB | VP2-3 | A0202 |
| 140 | FVNNIQYLDPR | 0.427 | 492 | WB | VP2-3 | A0202 |
| 146 | YLDPRHWGPSL | 0.801 | 8 | SB | VP2-3 | A0203 |
| 297 | LLGLYGTVTPA | 0.759 | 13 | SB | VP2-3 | A0203 |
| 83 | LIQTVTGISSL | 0.719 | 20 | SB | VP2-3 | A0203 |
| 293 | MLPLLLGLYGT | 0.711 | 22 | SB | VP2-3 | A0203 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 80 | FAALIQTVTGI | 0.669 | 36 | SB | VP2-3 | A0203 |
| 43 | SLATVEGITTT | 0.657 | 40 | SB | VP2-3 | A0203 |
| 59 | AIGLTPQTYAV | 0.639 | 49 | SB | VP2-3 | A0203 |
| 61 | GLTPQTYAVIA | 0.610 | 67 | WB | VP2-3 | A0203 |
| 18 | AAATGFSVAEI | 0.562 | 114 | WB | VP2-3 | A0203 |
| 40 | QIASLATVEGI | 0.559 | 118 | WB | VP2-3 | A0203 |
| 86 | TVTGISSLAQV | 0.542 | 141 | WB | VP2-3 | A0203 |
| 287 | RTAPQWMLPLL | 0.526 | 168 | WB | VP2-3 | A0203 |
| 274 | FIEKTIAPGGA | 0.518 | 183 | WB | VP2-3 | A0203 |
| 10 | LVASVSEAAAA | 0.513 | 193 | WB | VP2-3 | A0203 |
| 4 | LALLGDLVASV | 0.490 | 248 | WB | VP2-3 | A0203 |
| 24 | SVAEIAAGEAA | 0.488 | 253 | WB | VP2-3 | A0203 |
| 34 | AAAIEVQIASL | 0.478 | 283 | WB | VP2-3 | A0203 |
| 327 | SQKAKGTRASA | 0.474 | 294 | WB | VP2-3 | A0203 |
| 247 | SIDNADSIEEV | 0.455 | 365 | WB | VP2-3 | A0203 |
| 157 | FATISQALWHV | 0.447 | 396 | WB | VP2-3 | A0203 |
| 101 | FSDWDHKVSTV | 0.447 | 398 | WB | VP2-3 | A0203 |
| 67 | YAVIAGAPGAI | 0.430 | 477 | WB | VP2-3 | A0203 |
| 146 | YLDPRHWGPSL | 0.615 | 64 | WB | VP2-3 | A0204 |
| 29 | AAGEAAAAIEV | 0.520 | 180 | WB | VP2-3 | A0204 |
| 59 | AIGLTPQTYAV | 0.517 | 185 | WB | VP2-3 | A0204 |
| 297 | LLGLYGTVTPA | 0.495 | 236 | WB | VP2-3 | A0204 |
| 247 | SIDNADSIEEV | 0.488 | 255 | WB | VP2-3 | A0204 |
| 43 | SLATVEGITTT | 0.466 | 322 | WB | VP2-3 | A0204 |
| 146 | YLDPRHWGPSL | 0.882 | 3 | SB | VP2-3 | A0206 |
| 214 | IQDYYSNLSPI | 0.767 | 12 | SB | VP2-3 | A0206 |
| 230 | RQVAEREGTHV | 0.764 | 12 | SB | VP2-3 | A0206 |
| 157 | FATISQALWHV | 0.747 | 15 | SB | VP2-3 | A0206 |
| 114 | YQQSGMALELF | 0.741 | 16 | SB | VP2-3 | A0206 |
| 247 | SIDNADSIEEV | 0.659 | 40 | SB | VP2-3 | A0206 |
| 29 | AAGEAAAAIEV | 0.632 | 53 | WB | VP2-3 | A0206 |
| 287 | RTAPQWMLPLL | 0.614 | 64 | WB | VP2-3 | A0206 |
| 80 | FAALIQTVTGI | 0.614 | 65 | WB | VP2-3 | A0206 |
| 35 | AAIEVQIASLA | 0.587 | 86 | WB | VP2-3 | A0206 |
| 37 | IEVQIASLATV | 0.586 | 88 | WB | VP2-3 | A0206 |
| 24 | SVAEIAAGEAA | 0.580 | 93 | WB | VP2-3 | A0206 |
| 4 | LALLGDLVASV | 0.580 | 94 | WB | VP2-3 | A0206 |
| 101 | FSDWDHKVSTV | 0.577 | 97 | WB | VP2-3 | A0206 |
| 15 | SEAAAATGFSV | 0.572 | 102 | WB | VP2-3 | A0206 |
| 86 | TVTGISSLAQV | 0.557 | 120 | WB | VP2-3 | A0206 |
| 59 | AIGLTPQTYAV | 0.537 | 150 | WB | VP2-3 | A0206 |
| 293 | MLPLLLGLYGT | 0.536 | 151 | WB | VP2-3 | A0206 |
| 58 | AAIGLTPQTYA | 0.531 | 159 | WB | VP2-3 | A0206 |
| 10 | LVASVSEAAAA | 0.524 | 173 | WB | VP2-3 | A0206 |
| 18 | AAATGFSVAEI | 0.509 | 203 | WB | VP2-3 | A0206 |
| 68 | AVIAGAPGAIA | 0.503 | 215 | WB | VP2-3 | A0206 |
| 84 | IQTVTGISSLA | 0.500 | 223 | WB | VP2-3 | A0206 |
| 52 | TTSEAIAAIGL | 0.457 | 357 | WB | VP2-3 | A0206 |
| 1 | GAALALLGDLV | 0.454 | 366 | WB | VP2-3 | A0206 |
| 297 | LLGLYGTVTPA | 0.442 | 420 | WB | VP2-3 | A0206 |
| 13 | SVSEAAAATGF | 0.441 | 423 | WB | VP2-3 | A0206 |
| 45 | ATVEGITTTSE | 0.429 | 481 | WB | VP2-3 | A0206 |
| 146 | YLDPRHWGPSL | 0.969 | 1 | SB | VP2-3 | A0211 |
| 247 | SIDNADSIEEV | 0.903 | 2 | SB | VP2-3 | A0211 |
| 86 | TVTGISSLAQV | 0.868 | 4 | SB | VP2-3 | A0211 |
| 61 | GLTPQTYAVIA | 0.808 | 7 | SB | VP2-3 | A0211 |
| 92 | SLAQVGYRFFS | 0.759 | 13 | SB | VP2-3 | A0211 |
| 59 | AIGLTPQTYAV | 0.737 | 17 | SB | VP2-3 | A0211 |
| 122 | ELFNPDEYYDI | 0.669 | 35 | SB | VP2-3 | A0211 |
| 43 | SLATVEGITTT | 0.657 | 40 | SB | VP2-3 | A0211 |
| 29 | AAGEAAAAIEV | 0.644 | 46 | SB | VP2-3 | A0211 |
| 4 | LALLGDLVASV | 0.626 | 56 | WB | VP2-3 | A0211 |
| 287 | RTAPQWMLPLL | 0.626 | 57 | WB | VP2-3 | A0211 |
| 131 | DILFPGVNTFV | 0.620 | 60 | WB | VP2-3 | A0211 |
| 101 | FSDWDHKVSTV | 0.615 | 64 | WB | VP2-3 | A0211 |
| 157 | FATISQALWHV | 0.608 | 69 | WB | VP2-3 | A0211 |
| 293 | MLPLLLGLYGT | 0.597 | 78 | WB | VP2-3 | A0211 |
| 132 | ILFPGVNTFVN | 0.565 | 110 | WB | VP2-3 | A0211 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 297 | LLGLYGTVTPA | 0.547 | 134 | WB | VP2-3 | A0211 |
| 76 | AIAGFAALIQT | 0.537 | 150 | WB | VP2-3 | A0211 |
| 292 | WMLPLLLGLYG | 0.526 | 167 | WB | VP2-3 | A0211 |
| 24 | SVAEIAAGEAA | 0.526 | 168 | WB | VP2-3 | A0211 |
| 253 | SIEEVTQRMDL | 0.525 | 170 | WB | VP2-3 | A0211 |
| 296 | LLLGLYGTVTP | 0.523 | 174 | WB | VP2-3 | A0211 |
| 98 | YRFFSDWDHKV | 0.515 | 190 | WB | VP2-3 | A0211 |
| 6 | LLGDLVASVSE | 0.504 | 213 | WB | VP2-3 | A0211 |
| 27 | EIAAGEAAAAI | 0.496 | 234 | WB | VP2-3 | A0211 |
| 194 | RFLEETTWTIV | 0.476 | 288 | WB | VP2-3 | A0211 |
| 155 | SLFATISQALW | 0.468 | 315 | WB | VP2-3 | A0211 |
| 5 | ALLGDLVASVS | 0.465 | 325 | WB | VP2-3 | A0211 |
| 83 | LIQTVTGISSL | 0.454 | 369 | WB | VP2-3 | A0211 |
| 77 | IAGFAALIQTV | 0.449 | 386 | WB | VP2-3 | A0211 |
| 278 | TIAPGGANQRT | 0.438 | 437 | WB | VP2-3 | A0211 |
| 191 | SLARFLEETTW | 0.437 | 444 | WB | VP2-3 | A0211 |
| 299 | GLYGTVTPALE | 0.429 | 482 | WB | VP2-3 | A0211 |
| 146 | YLDPRHWGPSL | 0.942 | 1 | SB | VP2-3 | A0212 |
| 247 | SIDNADSIEEV | 0.724 | 19 | SB | VP2-3 | A0212 |
| 59 | AIGLTPQTYAV | 0.677 | 32 | SB | VP2-3 | A0212 |
| 61 | GLTPQTYAVIA | 0.591 | 83 | WB | VP2-3 | A0212 |
| 43 | SLATVEGITTT | 0.566 | 109 | WB | VP2-3 | A0212 |
| 122 | ELFNPDEYYDI | 0.556 | 121 | WB | VP2-3 | A0212 |
| 4 | LALLGDLVASV | 0.541 | 143 | WB | VP2-3 | A0212 |
| 293 | MLPLLLGLYGT | 0.513 | 194 | WB | VP2-3 | A0212 |
| 6 | LLGDLVASVSE | 0.507 | 207 | WB | VP2-3 | A0212 |
| 83 | LIQTVTGISSL | 0.499 | 226 | WB | VP2-3 | A0212 |
| 253 | SIEEVTQRMDL | 0.493 | 242 | WB | VP2-3 | A0212 |
| 292 | WMLPLLLGLYG | 0.489 | 251 | WB | VP2-3 | A0212 |
| 92 | SLAQVGYRFFS | 0.479 | 281 | WB | VP2-3 | A0212 |
| 86 | TVTGISSLAQV | 0.475 | 292 | WB | VP2-3 | A0212 |
| 157 | FATISQALWHV | 0.435 | 454 | WB | VP2-3 | A0212 |
| 132 | ILFPGVNTFVN | 0.434 | 457 | WB | VP2-3 | A0212 |
| 213 | YIQDYYSNLSP | 0.433 | 464 | WB | VP2-3 | A0212 |
| 98 | YRFFSDWDHKV | 0.432 | 468 | WB | VP2-3 | A0212 |
| 296 | LLLGLYGTVTP | 0.431 | 473 | WB | VP2-3 | A0212 |
| 146 | YLDPRHWGPSL | 0.908 | 2 | SB | VP2-3 | A0216 |
| 247 | SIDNADSIEEV | 0.852 | 4 | SB | VP2-3 | A0216 |
| 86 | TVTGISSLAQV | 0.811 | 7 | SB | VP2-3 | A0216 |
| 59 | AIGLTPQTYAV | 0.755 | 14 | SB | VP2-3 | A0216 |
| 29 | AAGEAAAAIEV | 0.714 | 22 | SB | VP2-3 | A0216 |
| 92 | SLAQVGYRFFS | 0.674 | 34 | SB | VP2-3 | A0216 |
| 131 | DILFPGVNTFV | 0.671 | 35 | SB | VP2-3 | A0216 |
| 43 | SLATVEGITTT | 0.635 | 52 | WB | VP2-3 | A0216 |
| 61 | GLTPQTYAVIA | 0.633 | 53 | WB | VP2-3 | A0216 |
| 297 | LLGLYGTVTPA | 0.621 | 60 | WB | VP2-3 | A0216 |
| 83 | LIQTVTGISSL | 0.526 | 169 | WB | VP2-3 | A0216 |
| 157 | FATISQALWHV | 0.524 | 172 | WB | VP2-3 | A0216 |
| 122 | ELFNPDEYYDI | 0.508 | 205 | WB | VP2-3 | A0216 |
| 4 | LALLGDLVASV | 0.499 | 225 | WB | VP2-3 | A0216 |
| 77 | IAGFAALIQTV | 0.459 | 350 | WB | VP2-3 | A0216 |
| 76 | AIAGFAALIQT | 0.458 | 351 | WB | VP2-3 | A0216 |
| 146 | YLDPRHWGPSL | 0.941 | 1 | SB | VP2-3 | A0219 |
| 247 | SIDNADSIEEV | 0.699 | 26 | SB | VP2-3 | A0219 |
| 86 | TVTGISSLAQV | 0.670 | 35 | SB | VP2-3 | A0219 |
| 59 | AIGLTPQTYAV | 0.566 | 109 | WB | VP2-3 | A0219 |
| 4 | LALLGDLVASV | 0.537 | 149 | WB | VP2-3 | A0219 |
| 157 | FATISQALWHV | 0.530 | 161 | WB | VP2-3 | A0219 |
| 83 | LIQTVTGISSL | 0.499 | 225 | WB | VP2-3 | A0219 |
| 332 | GTRASAKTTNK | 0.622 | 59 | WB | VP2-3 | A0301 |
| 321 | RVSRGSSQKAK | 0.580 | 93 | WB | VP2-3 | A0301 |
| 203 | IVNAPINFYNY | 0.501 | 220 | WB | VP2-3 | A0301 |
| 339 | TTNKRRSRSSR | 0.487 | 258 | WB | VP2-3 | A0301 |
| 203 | IVNAPINFYNY | 0.678 | 32 | SB | VP2-3 | A1101 |
| 339 | TTNKRRSRSSR | 0.651 | 43 | SB | VP2-3 | A1101 |
| 277 | KTIAPGGANQR | 0.634 | 52 | WB | VP2-3 | A1101 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 321 | RVSRGSSQKAK | 0.626 | 57 | WB | VP2-3 | A1101 |
| 332 | GTRASAKTTNK | 0.606 | 70 | WB | VP2-3 | A1101 |
| 89 | GISSLAQVGYR | 0.521 | 177 | WB | VP2-3 | A1101 |
| 136 | GVNTFVNNIQY | 0.517 | 185 | WB | VP2-3 | A1101 |
| 159 | TISQALWHVIR | 0.481 | 274 | WB | VP2-3 | A1101 |
| 176 | TSQELQRRTER | 0.476 | 289 | WB | VP2-3 | A1101 |
| 140 | FVNNIQYLDPR | 0.469 | 313 | WB | VP2-3 | A1101 |
| 267 | ESVHSGEFIEK | 0.437 | 442 | WB | VP2-3 | A1101 |
| 200 | TWTIVNAPINF | 0.630 | 54 | WB | VP2-3 | A2301 |
| 97 | GYRFFSDWDHK | 0.623 | 59 | WB | VP2-3 | A2301 |
| 113 | LYQQSGMALEL | 0.597 | 77 | WB | VP2-3 | A2301 |
| 186 | RFFRDSLARFL | 0.449 | 389 | WB | VP2-3 | A2301 |
| 200 | TWTIVNAPINF | 0.612 | 66 | WB | VP2-3 | A2402 |
| 113 | LYQQSGMALEL | 0.533 | 156 | WB | VP2-3 | A2402 |
| 113 | LYQQSGMALEL | 0.750 | 14 | SB | VP2-3 | A2403 |
| 186 | RFFRDSLARFL | 0.485 | 263 | WB | VP2-3 | A2403 |
| 91 | SSLAQVGYRFF | 0.459 | 347 | WB | VP2-3 | A2403 |
| 201 | WTIVNAPINFY | 0.672 | 34 | SB | VP2-3 | A2601 |
| 109 | STVGLYQQSGM | 0.619 | 61 | WB | VP2-3 | A2601 |
| 201 | WTIVNAPINFY | 0.930 | 2 | SB | VP2-3 | A2602 |
| 109 | STVGLYQQSGM | 0.769 | 12 | SB | VP2-3 | A2602 |
| 27 | EIAAGEAAAAI | 0.765 | 12 | SB | VP2-3 | A2602 |
| 287 | RTAPQWMLPLL | 0.678 | 32 | SB | VP2-3 | A2602 |
| 203 | IVNAPINFYNY | 0.672 | 34 | SB | VP2-3 | A2602 |
| 13 | SVSEAAAATGF | 0.566 | 109 | WB | VP2-3 | A2602 |
| 88 | TGISSLAQVGY | 0.498 | 228 | WB | VP2-3 | A2602 |
| 291 | QWMLPLLLGLY | 0.553 | 126 | WB | VP2-3 | A2902 |
| 203 | IVNAPINFYNY | 0.517 | 185 | WB | VP2-3 | A2902 |
| 236 | EGTHVNFGHTY | 0.485 | 262 | WB | VP2-3 | A2902 |
| 208 | INFYNYIQDYY | 0.471 | 304 | WB | VP2-3 | A2902 |
| 136 | GVNTFVNNIQY | 0.468 | 317 | WB | VP2-3 | A2902 |
| 319 | KRRVSRGSSQK | 0.802 | 8 | SB | VP2-3 | A3001 |
| 332 | GTRASAKTTNK | 0.790 | 9 | SB | VP2-3 | A3001 |
| 97 | GYRFFSDWDHK | 0.743 | 16 | SB | VP2-3 | A3001 |
| 321 | RVSRGSSQKAK | 0.684 | 30 | SB | VP2-3 | A3001 |
| 203 | IVNAPINFYNY | 0.460 | 345 | WB | VP2-3 | A3002 |
| 339 | TTNKRRSRSSR | 0.837 | 5 | SB | VP2-3 | A3101 |
| 277 | KTIAPGGANQR | 0.682 | 31 | SB | VP2-3 | A3101 |
| 334 | RASAKTTNKRR | 0.664 | 37 | SB | VP2-3 | A3101 |
| 336 | SAKTTNKRRSR | 0.656 | 41 | SB | VP2-3 | A3101 |
| 140 | FVNNIQYLDPR | 0.655 | 41 | SB | VP2-3 | A3101 |
| 176 | TSQELQRRTER | 0.645 | 46 | SB | VP2-3 | A3101 |
| 179 | ELQRRTERFFR | 0.636 | 51 | WB | VP2-3 | A3101 |
| 225 | RPSMVRQVAER | 0.580 | 94 | WB | VP2-3 | A3101 |
| 324 | RGSSQKAKGTR | 0.569 | 105 | WB | VP2-3 | A3101 |
| 89 | GISSLAQVGYR | 0.567 | 108 | WB | VP2-3 | A3101 |
| 159 | TISQALWHVIR | 0.483 | 268 | WB | VP2-3 | A3101 |
| 332 | GTRASAKTTNK | 0.446 | 401 | WB | VP2-3 | A3101 |
| 220 | NLSPIRPSMVR | 0.432 | 465 | WB | VP2-3 | A3101 |
| 179 | ELQRRTERFFR | 0.812 | 7 | SB | VP2-3 | A3301 |
| 339 | TTNKRRSRSSR | 0.738 | 17 | SB | VP2-3 | A3301 |
| 140 | FVNNIQYLDPR | 0.519 | 181 | WB | VP2-3 | A3301 |
| 176 | TSQELQRRTER | 0.516 | 188 | WB | VP2-3 | A3301 |
| 220 | NLSPIRPSMVR | 0.506 | 210 | WB | VP2-3 | A3301 |
| 159 | TISQALWHVIR | 0.465 | 326 | WB | VP2-3 | A3301 |
| 339 | TTNKRRSRSSR | 0.848 | 5 | SB | VP2-3 | A6801 |
| 140 | FVNNIQYLDPR | 0.795 | 9 | SB | VP2-3 | A6801 |
| 159 | TISQALWHVIR | 0.758 | 13 | SB | VP2-3 | A6801 |
| 256 | EVTQRMDLRNK | 0.719 | 20 | SB | VP2-3 | A6801 |
| 179 | ELQRRTERFFR | 0.714 | 22 | SB | VP2-3 | A6801 |
| 309 | EAYEDGPNQKK | 0.713 | 22 | SB | VP2-3 | A6801 |

TABLE J-continued

Prediction of BK virus VP2-3 protein specific MHC
class1, 8-, 9-, 10-, 11-mer peptide binders for
42 MHC class 1 alleles (see FIG. 11) using the
www.cbs.dtu.dk/services/NetMHC/ database.
The MHC class 1 molecules for which no binders were
found are not listed.

| pos | peptide | logscore | affinity(nM) | Bind Level | Protein Name | Allele |
|---|---|---|---|---|---|---|
| 267 | ESVHSGEFIEK | 0.706 | 24 | SB | VP2-3 | A6801 |
| 220 | NLSPIRPSMVR | 0.687 | 29 | SB | VP2-3 | A6801 |
| 250 | NADSIEEVTQR | 0.655 | 41 | SB | VP2-3 | A6801 |
| 176 | TSQELQRRTER | 0.647 | 45 | SB | VP2-3 | A6801 |
| 201 | WTIVNAPINFY | 0.600 | 75 | WB | VP2-3 | A6801 |
| 89 | GISSLAQVGYR | 0.591 | 83 | WB | VP2-3 | A6801 |
| 277 | KTIAPGGANQR | 0.588 | 86 | WB | VP2-3 | A6801 |
| 172 | IPAITSQELQR | 0.515 | 190 | WB | VP2-3 | A6801 |
| 225 | RPSMVRQVAER | 0.438 | 438 | WB | VP2-3 | A6801 |
| 215 | QDYYSNLSPIR | 0.437 | 444 | WB | VP2-3 | A6801 |
| 198 | ETTWTIVNAPI | 0.863 | 4 | SB | VP2-3 | A6802 |
| 86 | TVTGISSLAQV | 0.804 | 8 | SB | VP2-3 | A6802 |
| 16 | EAAAATGFSVA | 0.777 | 11 | SB | VP2-3 | A6802 |
| 80 | FAALIQTVTGI | 0.761 | 13 | SB | VP2-3 | A6802 |
| 27 | EIAAGEAAAAI | 0.759 | 13 | SB | VP2-3 | A6802 |
| 244 | HTYSIDNADSI | 0.756 | 13 | SB | VP2-3 | A6802 |
| 52 | TTSEAIAAIGL | 0.729 | 18 | SB | VP2-3 | A6802 |
| 24 | SVAEIAAGEAA | 0.724 | 19 | SB | VP2-3 | A6802 |
| 40 | QIASLATVEGI | 0.649 | 44 | SB | VP2-3 | A6802 |
| 32 | EAAAIEVQIA | 0.633 | 52 | WB | VP2-3 | A6802 |
| 10 | LVASVSEAAAA | 0.605 | 71 | WB | VP2-3 | A6802 |
| 131 | DILFPGVNTFV | 0.561 | 115 | WB | VP2-3 | A6802 |
| 287 | RTAPQWMLPLL | 0.551 | 129 | WB | VP2-3 | A6802 |
| 259 | QRMDLRNKESV | 0.550 | 129 | WB | VP2-3 | A6802 |
| 122 | ELFNPDEYYDI | 0.549 | 131 | WB | VP2-3 | A6802 |
| 46 | TVEGITTTSEA | 0.537 | 150 | WB | VP2-3 | A6802 |
| 157 | FATISQALWHV | 0.500 | 223 | WB | VP2-3 | A6802 |
| 109 | STVGLYQQSGM | 0.495 | 235 | WB | VP2-3 | A6802 |
| 204 | VNAPINFYNYI | 0.467 | 319 | WB | VP2-3 | A6802 |
| 18 | AAATGFSVAEI | 0.465 | 326 | WB | VP2-3 | A6802 |
| 23 | FSVAEIAAGEA | 0.463 | 333 | WB | VP2-3 | A6802 |
| 15 | SEAAAATGFSV | 0.457 | 356 | WB | VP2-3 | A6802 |
| 98 | YRFFSDWDHKV | 0.453 | 371 | WB | VP2-3 | A6802 |
| 50 | ITTTSEAIAAI | 0.442 | 419 | WB | VP2-3 | A6802 |
| 67 | YAVIAGAPGAI | 0.439 | 430 | WB | VP2-3 | A6802 |
| 0 | MGAALALLGDL | 0.426 | 497 | WB | VP2-3 | A6802 |
| 198 | ETTWTIVNAPI | 0.765 | 12 | SB | VP2-3 | A6901 |
| 27 | EIAAGEAAAAI | 0.722 | 20 | SB | VP2-3 | A6901 |
| 131 | DILFPGVNTFV | 0.706 | 23 | SB | VP2-3 | A6901 |
| 157 | FATISQALWHV | 0.625 | 58 | WB | VP2-3 | A6901 |
| 52 | TTSEAIAAIGL | 0.581 | 93 | WB | VP2-3 | A6901 |
| 244 | HTYSIDNADSI | 0.559 | 117 | WB | VP2-3 | A6901 |
| 86 | TVTGISSLAQV | 0.494 | 237 | WB | VP2-3 | A6901 |
| 24 | SVAEIAAGEAA | 0.491 | 245 | WB | VP2-3 | A6901 |
| 67 | YAVIAGAPGAI | 0.465 | 326 | WB | VP2-3 | A6901 |
| 146 | YLDPRHWGPSL | 0.462 | 338 | WB | VP2-3 | A6901 |
| 29 | AAGEAAAAIEV | 0.456 | 360 | WB | VP2-3 | A6901 |
| 101 | FSDWDHKVSTV | 0.443 | 416 | WB | VP2-3 | A6901 |
| 294 | LPLLLGLYGTV | 0.439 | 433 | WB | VP2-3 | A6901 |
| 40 | QIASLATVEGI | 0.436 | 448 | WB | VP2-3 | A6901 |
| 287 | RTAPQWMLPLL | 0.433 | 459 | WB | VP2-3 | A6901 |
| 73 | APGAIAGFAAL | 0.671 | 35 | SB | VP2-3 | B0702 |
| 222 | SPIRPSMVRQV | 0.530 | 162 | WB | VP2-3 | B0702 |
| 67 | YAVIAGAPGAI | 0.489 | 251 | WB | VP2-3 | B0702 |
| 114 | YQQSGMALELF | 0.567 | 108 | WB | VP2-3 | B1501 |
| 201 | WTIVNAPINFY | 0.536 | 151 | WB | VP2-3 | B1501 |
| 203 | IVNAPINFYNY | 0.501 | 221 | WB | VP2-3 | B1501 |
| 13 | SVSEAAAATGF | 0.500 | 223 | WB | VP2-3 | B1501 |

TABLE J-continued

Prediction of BK virus VP2-3 protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity(nM) | Bind Level | Protein Name | Allele |
|---|---|---|---|---|---|---|
| 264 | RNKESVHSGEF | 0.488 | 254 | WB | VP2-3 | B1501 |
| 57 | IAAIGLTPQTY | 0.455 | 361 | WB | VP2-3 | B1501 |
| 37 | IEVQIASLATV | 0.605 | 71 | WB | VP2-3 | B1801 |
| 127 | DEYYDILFPGV | 0.591 | 83 | WB | VP2-3 | B1801 |
| 178 | QELQRRTERFF | 0.466 | 323 | WB | VP2-3 | B1801 |
| 130 | YDILFPGVNTF | 0.426 | 495 | WB | VP2-3 | B1801 |
| 182 | RRTERFFRDSL | 0.564 | 111 | WB | VP2-3 | B2705 |
| 319 | KRRVSRGSSQK | 0.498 | 227 | WB | VP2-3 | B2705 |
| 320 | RRVSRGSSQKA | 0.461 | 342 | WB | VP2-3 | B2705 |
| 286 | QRTAPQWMLPL | 0.430 | 477 | WB | VP2-3 | B2705 |
| 119 | MALELFNPDEY | 0.799 | 8 | SB | VP2-3 | B3501 |
| 57 | IAAIGLTPQTY | 0.701 | 25 | SB | VP2-3 | B3501 |
| 67 | YAVIAGAPGAI | 0.605 | 71 | WB | VP2-3 | B3501 |
| 13 | SVSEAAAATGF | 0.558 | 119 | WB | VP2-3 | B3501 |
| 201 | WTIVNAPINFY | 0.508 | 204 | WB | VP2-3 | B3501 |
| 73 | APGAIAGFAAL | 0.500 | 224 | WB | VP2-3 | B3501 |
| 301 | YGTVTPALEAY | 0.466 | 322 | WB | VP2-3 | B3501 |
| 11 | VASVSEAAAAT | 0.445 | 404 | WB | VP2-3 | B3501 |
| 146 | YLDPRHWGPSL | 0.500 | 223 | WB | VP2-3 | B3901 |
| 211 | YNYIQDYYSNL | 0.445 | 405 | WB | VP2-3 | B3901 |
| 31 | GEAAAAIEVQI | 0.587 | 87 | WB | VP2-3 | B4001 |
| 15 | SEAAAATGFSV | 0.513 | 194 | WB | VP2-3 | B4001 |
| 37 | IEVQIASLATV | 0.477 | 287 | WB | VP2-3 | B4001 |
| 127 | DEYYDILFPGV | 0.451 | 380 | WB | VP2-3 | B4001 |
| 178 | QELQRRTERFF | 0.497 | 231 | WB | VP2-3 | B4002 |
| 26 | AEIAAGEAAAA | 0.428 | 489 | WB | VP2-3 | B4002 |
| 26 | AEIAAGEAAAA | 0.484 | 264 | WB | VP2-3 | B4403 |
| 26 | AEIAAGEAAAA | 0.620 | 61 | WB | VP2-3 | B4501 |
| 294 | LPLLLGLYGTV | 0.749 | 15 | SB | VP2-3 | B5101 |
| 134 | FPGVNTFVNNI | 0.632 | 53 | WB | VP2-3 | B5101 |
| 134 | FPGVNTFVNNI | 0.791 | 9 | SB | VP2-3 | B5301 |
| 294 | LPLLLGLYGTV | 0.479 | 281 | WB | VP2-3 | B5301 |
| 119 | MALELFNPDEY | 0.477 | 287 | WB | VP2-3 | B5301 |
| 294 | LPLLLGLYGTV | 0.839 | 5 | SB | VP2-3 | B5401 |
| 134 | FPGVNTFVNNI | 0.750 | 14 | SB | VP2-3 | B5401 |
| 63 | TPQTYAVIAGA | 0.491 | 245 | WB | VP2-3 | B5401 |
| 80 | FAALIQTVTGI | 0.454 | 369 | WB | VP2-3 | B5401 |
| 222 | SPIRPSMVRQV | 0.451 | 378 | WB | VP2-3 | B5401 |
| 90 | ISSLAQVGYRF | 0.685 | 30 | SB | VP2-3 | B5801 |
| 191 | SLARFLEETTW | 0.631 | 54 | WB | VP2-3 | B5801 |
| 155 | SLFATISQALW | 0.572 | 102 | WB | VP2-3 | B5801 |
| 57 | IAAIGLTPQTY | 0.539 | 145 | WB | VP2-3 | B5801 |
| 282 | GGANQRTAPQW | 0.529 | 162 | WB | VP2-3 | B5801 |
| 287 | RTAPQWMLPLL | 0.488 | 253 | WB | VP2-3 | B5801 |

SEQ ID NOS: 52253-53779

Preferred BK virus fragments of VP1 capable of interacting with one or more MHC class 1 molecules are listed in Table K.

TABLE K

Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 8-mers | | | | | | |
| 196 | YLDKNNAY | 0.756 | 14 | SB | VP1 | A0101 |
| 108 | LMWEAVTV | 0.819 | 7 | SB | VP1 | A0201 |
| 243 | VLLDEQGV | 0.703 | 24 | SB | VP1 | A0201 |
| 83 | KMLPCYST | 0.657 | 41 | SB | VP1 | A0201 |
| 40 | GVDAITEV | 0.595 | 79 | WB | VP1 | A0201 |
| 281 | GLARYFKI | 0.591 | 83 | WB | VP1 | A0201 |
| 106 | NLLMWEAV | 0.580 | 94 | WB | VP1 | A0201 |
| 84 | MLPCYSTA | 0.562 | 114 | WB | VP1 | A0201 |
| 107 | LLMWEAVT | 0.498 | 229 | WB | VP1 | A0201 |
| 281 | GLARYFKI | 0.717 | 21 | SB | VP1 | A0202 |
| 108 | LMWEAVTV | 0.668 | 36 | SB | VP1 | A0202 |
| 84 | MLPCYSTA | 0.666 | 37 | SB | VP1 | A0202 |
| 243 | VLLDEQGV | 0.663 | 38 | SB | VP1 | A0202 |
| 262 | SAADICGL | 0.662 | 38 | SB | VP1 | A0202 |
| 40 | GVDAITEV | 0.633 | 52 | WB | VP1 | A0202 |
| 34 | VLEVKTGV | 0.510 | 200 | WB | VP1 | A0202 |
| 152 | FAVGGDPL | 0.508 | 205 | WB | VP1 | A0202 |
| 121 | GITSMLNL | 0.475 | 291 | WB | VP1 | A0202 |
| 125 | MLNLHAGS | 0.470 | 310 | WB | VP1 | A0202 |
| 25 | KLLIKGGV | 0.457 | 354 | WB | VP1 | A0202 |
| 107 | LLMWEAVT | 0.451 | 379 | WB | VP1 | A0202 |
| 238 | NTATTVLL | 0.447 | 394 | WB | VP1 | A0202 |
| 84 | MLPCYSTA | 0.841 | 5 | SB | VP1 | A0203 |
| 108 | LMWEAVTV | 0.784 | 10 | SB | VP1 | A0203 |
| 27 | LIKGGVEV | 0.779 | 10 | SB | VP1 | A0203 |
| 281 | GLARYFKI | 0.762 | 13 | SB | VP1 | A0203 |
| 243 | VLLDEQGV | 0.746 | 15 | SB | VP1 | A0203 |
| 236 | VTNTATTV | 0.674 | 33 | SB | VP1 | A0203 |
| 25 | KLLIKGGV | 0.657 | 41 | SB | VP1 | A0203 |
| 106 | NLLMWEAV | 0.643 | 47 | SB | VP1 | A0203 |
| 34 | VLEVKTGV | 0.635 | 51 | WB | VP1 | A0203 |
| 233 | VLHVTNTA | 0.633 | 52 | WB | VP1 | A0203 |
| 107 | LLMWEAVT | 0.563 | 113 | WB | VP1 | A0203 |
| 262 | SAADICGL | 0.538 | 148 | WB | VP1 | A0203 |
| 188 | VMNTDHKA | 0.531 | 159 | WB | VP1 | A0203 |
| 83 | KMLPCYST | 0.509 | 203 | WB | VP1 | A0203 |
| 125 | MLNLHAGS | 0.509 | 203 | WB | VP1 | A0203 |
| 326 | SQVEEVRV | 0.501 | 221 | WB | VP1 | A0203 |
| 229 | NVPPVLHV | 0.492 | 244 | WB | VP1 | A0203 |
| 121 | GITSMLNL | 0.490 | 248 | WB | VP1 | A0203 |
| 40 | GVDAITEV | 0.488 | 255 | WB | VP1 | A0203 |
| 294 | SVKNPYPI | 0.470 | 308 | WB | VP1 | A0203 |
| 112 | AVTVKTEV | 0.456 | 358 | WB | VP1 | A0203 |
| 119 | VIGITSML | 0.439 | 433 | WB | VP1 | A0203 |
| 108 | LMWEAVTV | 0.780 | 10 | SB | VP1 | A0204 |
| 243 | VLLDEQGV | 0.740 | 16 | SB | VP1 | A0204 |
| 25 | KLLIKGGV | 0.582 | 91 | WB | VP1 | A0204 |
| 281 | GLARYFKI | 0.510 | 201 | WB | VP1 | A0204 |
| 34 | VLEVKTGV | 0.498 | 228 | WB | VP1 | A0204 |
| 236 | VTNTATTV | 0.489 | 253 | WB | VP1 | A0204 |
| 326 | SQVEEVRV | 0.453 | 371 | WB | VP1 | A0204 |
| 106 | NLLMWEAV | 0.441 | 423 | WB | VP1 | A0204 |
| 27 | LIKGGVEV | 0.432 | 465 | WB | VP1 | A0204 |
| 40 | GVDAITEV | 0.431 | 472 | WB | VP1 | A0204 |
| 108 | LMWEAVTV | 0.852 | 4 | SB | VP1 | A0206 |
| 326 | SQVEEVRV | 0.789 | 9 | SB | VP1 | A0206 |
| 106 | NLLMWEAV | 0.731 | 18 | SB | VP1 | A0206 |
| 152 | FAVGGDPL | 0.729 | 18 | SB | VP1 | A0206 |
| 243 | VLLDEQGV | 0.720 | 20 | SB | VP1 | A0206 |
| 40 | GVDAITEV | 0.691 | 28 | SB | VP1 | A0206 |
| 21 | VQVPKLLI | 0.685 | 30 | SB | VP1 | A0206 |
| 84 | MLPCYSTA | 0.624 | 58 | WB | VP1 | A0206 |
| 83 | KMLPCYST | 0.623 | 59 | WB | VP1 | A0206 |
| 354 | GQLQTKMV | 0.584 | 89 | WB | VP1 | A0206 |
| 229 | NVPPVLHV | 0.574 | 99 | WB | VP1 | A0206 |
| 25 | KLLIKGGV | 0.543 | 139 | WB | VP1 | A0206 |
| 262 | SAADICGL | 0.513 | 193 | WB | VP1 | A0206 |
| 236 | VTNTATTV | 0.506 | 208 | WB | VP1 | A0206 |
| 281 | GLARYFKI | 0.505 | 211 | WB | VP1 | A0206 |
| 144 | VQGSNFHF | 0.481 | 275 | WB | VP1 | A0206 |
| 112 | AVTVKTEV | 0.454 | 368 | WB | VP1 | A0206 |
| 276 | TQQWRGLA | 0.439 | 434 | WB | VP1 | A0206 |
| 184 | AQSQVMNT | 0.432 | 465 | WB | VP1 | A0206 |
| 147 | SNFHFFAV | 0.432 | 467 | WB | VP1 | A0206 |
| 108 | LMWEAVTV | 0.966 | 1 | SB | VP1 | A0211 |
| 243 | VLLDEQGV | 0.965 | 1 | SB | VP1 | A0211 |
| 106 | NLLMWEAV | 0.910 | 2 | SB | VP1 | A0211 |
| 40 | GVDAITEV | 0.856 | 4 | SB | VP1 | A0211 |
| 27 | LIKGGVEV | 0.838 | 5 | SB | VP1 | A0211 |
| 229 | NVPPVLHV | 0.830 | 6 | SB | VP1 | A0211 |
| 25 | KLLIKGGV | 0.823 | 6 | SB | VP1 | A0211 |
| 349 | YIDRQGQL | 0.819 | 7 | SB | VP1 | A0211 |
| 281 | GLARYFKI | 0.788 | 9 | SB | VP1 | A0211 |
| 84 | MLPCYSTA | 0.786 | 10 | SB | VP1 | A0211 |
| 196 | YLDKNNAY | 0.751 | 14 | SB | VP1 | A0211 |
| 83 | KMLPCYST | 0.746 | 15 | SB | VP1 | A0211 |
| 34 | VLEVKTGV | 0.731 | 18 | SB | VP1 | A0211 |
| 101 | DLTCGNLL | 0.639 | 49 | SB | VP1 | A0211 |
| 262 | SAADICGL | 0.614 | 65 | WB | VP1 | A0211 |
| 97 | NLNEDLTC | 0.603 | 73 | WB | VP1 | A0211 |
| 188 | VMNTDHKA | 0.602 | 74 | WB | VP1 | A0211 |
| 233 | VLHVTNTA | 0.594 | 80 | WB | VP1 | A0211 |
| 112 | AVTVKTEV | 0.578 | 96 | WB | VP1 | A0211 |
| 320 | PMYGMESQ | 0.573 | 102 | WB | VP1 | A0211 |
| 326 | SQVEEVRV | 0.548 | 133 | WB | VP1 | A0211 |
| 332 | RVFDGTEQ | 0.542 | 141 | WB | VP1 | A0211 |
| 333 | VFDGTEQL | 0.505 | 211 | WB | VP1 | A0211 |
| 254 | CKADSLYV | 0.500 | 224 | WB | VP1 | A0211 |
| 236 | VTNTATTV | 0.498 | 229 | WB | VP1 | A0211 |
| 124 | SMLNLHAG | 0.491 | 246 | WB | VP1 | A0211 |
| 121 | GITSMLNL | 0.481 | 276 | WB | VP1 | A0211 |
| 147 | SNFHFFAV | 0.471 | 305 | WB | VP1 | A0211 |
| 107 | LLMWEAVT | 0.456 | 358 | WB | VP1 | A0211 |
| 252 | PLCKADSL | 0.453 | 370 | WB | VP1 | A0211 |
| 223 | TYTGGENV | 0.451 | 378 | WB | VP1 | A0211 |
| 339 | QLPGDPDM | 0.440 | 428 | WB | VP1 | A0211 |
| 119 | VIGITSML | 0.437 | 439 | WB | VP1 | A0211 |
| 243 | VLLDEQGV | 0.938 | 1 | SB | VP1 | A0212 |
| 108 | LMWEAVTV | 0.932 | 2 | SB | VP1 | A0212 |
| 106 | NLLMWEAV | 0.866 | 4 | SB | VP1 | A0212 |
| 27 | LIKGGVEV | 0.758 | 13 | SB | VP1 | A0212 |
| 281 | GLARYFKI | 0.738 | 17 | SB | VP1 | A0212 |
| 34 | VLEVKTGV | 0.730 | 18 | SB | VP1 | A0212 |
| 196 | YLDKNNAY | 0.708 | 23 | SB | VP1 | A0212 |
| 25 | KLLIKGGV | 0.691 | 28 | SB | VP1 | A0212 |
| 349 | YIDRQGQL | 0.659 | 40 | SB | VP1 | A0212 |
| 84 | MLPCYSTA | 0.645 | 46 | SB | VP1 | A0212 |
| 40 | GVDAITEV | 0.626 | 57 | WB | VP1 | A0212 |
| 229 | NVPPVLHV | 0.625 | 57 | WB | VP1 | A0212 |
| 320 | PMYGMESQ | 0.570 | 104 | WB | VP1 | A0212 |
| 188 | VMNTDHKA | 0.557 | 120 | WB | VP1 | A0212 |
| 233 | VLHVTNTA | 0.537 | 149 | WB | VP1 | A0212 |

TABLE K-continued

Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 83 | KMLPCYST | 0.496 | 234 | WB | VP1 | A0212 |
| 339 | QLPGDPDM | 0.474 | 295 | WB | VP1 | A0212 |
| 107 | LLMWEAVT | 0.462 | 337 | WB | VP1 | A0212 |
| 124 | SMLNLHAG | 0.437 | 443 | WB | VP1 | A0212 |
| 50 | FLNPEMGD | 0.437 | 444 | WB | VP1 | A0212 |
| 236 | VTNTATTV | 0.435 | 450 | WB | VP1 | A0212 |
| 97 | NLNEDLTC | 0.431 | 469 | WB | VP1 | A0212 |
| 326 | SQVEEVRV | 0.429 | 483 | WB | VP1 | A0212 |
| 108 | LMWEAVTV | 0.930 | 2 | SB | VP1 | A0216 |
| 243 | VLLDEQGV | 0.867 | 4 | SB | VP1 | A0216 |
| 106 | NLLMWEAV | 0.829 | 6 | SB | VP1 | A0216 |
| 27 | LIKGGVEV | 0.816 | 7 | SB | VP1 | A0216 |
| 229 | NVPPVLHV | 0.794 | 9 | SB | VP1 | A0216 |
| 40 | GVDAITEV | 0.784 | 10 | SB | VP1 | A0216 |
| 281 | GLARYFKI | 0.745 | 15 | SB | VP1 | A0216 |
| 34 | VLEVKTGV | 0.709 | 23 | SB | VP1 | A0216 |
| 84 | MLPCYSTA | 0.699 | 26 | SB | VP1 | A0216 |
| 349 | YIDRQGQL | 0.698 | 26 | SB | VP1 | A0216 |
| 25 | KLLIKGGV | 0.668 | 36 | SB | VP1 | A0216 |
| 112 | AVTVKTEV | 0.647 | 45 | SB | VP1 | A0216 |
| 252 | PLCKADSL | 0.627 | 56 | WB | VP1 | A0216 |
| 101 | DLTCGNLL | 0.529 | 163 | WB | VP1 | A0216 |
| 233 | VLHVTNTA | 0.520 | 179 | WB | VP1 | A0216 |
| 119 | VIGITSML | 0.493 | 241 | WB | VP1 | A0216 |
| 83 | KMLPCYST | 0.490 | 250 | WB | VP1 | A0216 |
| 320 | PMYGMESQ | 0.474 | 296 | WB | VP1 | A0216 |
| 236 | VTNTATTV | 0.470 | 309 | WB | VP1 | A0216 |
| 196 | YLDKNNAY | 0.461 | 339 | WB | VP1 | A0216 |
| 321 | MYGMESQV | 0.456 | 360 | WB | VP1 | A0216 |
| 152 | FAVGGDPL | 0.438 | 439 | WB | VP1 | A0216 |
| 223 | TYTGGENV | 0.434 | 457 | WB | VP1 | A0216 |
| 108 | LMWEAVTV | 0.930 | 2 | SB | VP1 | A0219 |
| 243 | VLLDEQGV | 0.896 | 3 | SB | VP1 | A0219 |
| 106 | NLLMWEAV | 0.798 | 8 | SB | VP1 | A0219 |
| 40 | GVDAITEV | 0.662 | 38 | SB | VP1 | A0219 |
| 229 | NVPPVLHV | 0.606 | 70 | WB | VP1 | A0219 |
| 27 | LIKGGVEV | 0.540 | 144 | WB | VP1 | A0219 |
| 349 | YIDRQGQL | 0.526 | 168 | WB | VP1 | A0219 |
| 34 | VLEVKTGV | 0.485 | 262 | WB | VP1 | A0219 |
| 254 | CKADSLYV | 0.484 | 265 | WB | VP1 | A0219 |
| 196 | YLDKNNAY | 0.451 | 381 | WB | VP1 | A0219 |
| 236 | VTNTATTV | 0.446 | 399 | WB | VP1 | A0219 |
| 333 | VFDGTEQL | 0.439 | 432 | WB | VP1 | A0219 |
| 281 | GLARYFKI | 0.434 | 456 | WB | VP1 | A0219 |
| 101 | DLTCGNLL | 0.430 | 474 | WB | VP1 | A0219 |
| 289 | RLRKRSVK | 0.776 | 11 | SB | VP1 | A0301 |
| 308 | LINRRTQK | 0.697 | 26 | SB | VP1 | A0301 |
| 164 | VLMNYRTK | 0.693 | 27 | SB | VP1 | A0301 |
| 127 | NLHAGSQK | 0.656 | 41 | SB | VP1 | A0301 |
| 165 | LMNYRTKY | 0.467 | 318 | WB | VP1 | A0301 |
| 280 | RGLARYFK | 0.446 | 399 | WB | VP1 | A0301 |
| 352 | RQGQLQTK | 0.432 | 468 | WB | VP1 | A0301 |
| 187 | QVMNTDHK | 0.705 | 24 | SB | VP1 | A1101 |
| 164 | VLMNYRTK | 0.620 | 60 | WB | VP1 | A1101 |
| 308 | LINRRTQK | 0.613 | 65 | WB | VP1 | A1101 |
| 280 | RGLARYFK | 0.596 | 79 | WB | VP1 | A1101 |
| 22 | QVPKLLIK | 0.510 | 200 | WB | VP1 | A1101 |
| 31 | GVEVLEVK | 0.506 | 210 | WB | VP1 | A1101 |
| 11 | GAAPKKPK | 0.444 | 408 | WB | VP1 | A1101 |
| 352 | RQGQLQTK | 0.436 | 447 | WB | VP1 | A1101 |
| 298 | PYPISFLL | 0.570 | 104 | WB | VP1 | A2301 |
| 259 | LYVSAADI | 0.509 | 203 | WB | VP1 | A2301 |
| 144 | VQGSNFHF | 0.499 | 225 | WB | VP1 | A2301 |
| 109 | MWEAVTVK | 0.470 | 310 | WB | VP1 | A2301 |
| 284 | RYFKIRLR | 0.448 | 393 | WB | VP1 | A2301 |
| 298 | PYPISFLL | 0.771 | 11 | SB | VP1 | A2402 |
| 202 | AYPVECWI | 0.672 | 34 | SB | VP1 | A2402 |
| 259 | LYVSAADI | 0.538 | 148 | WB | VP1 | A2402 |
| 302 | SFLLSDLI | 0.533 | 156 | WB | VP1 | A2402 |
| 144 | VQGSNFHF | 0.441 | 422 | WB | VP1 | A2402 |
| 202 | AYPVECWI | 0.721 | 20 | SB | VP1 | A2403 |
| 298 | PYPISFLL | 0.614 | 65 | SB | VP1 | A2403 |
| 259 | LYVSAADI | 0.464 | 329 | WB | VP1 | A2403 |
| 118 | EVIGITSM | 0.834 | 6 | SB | VP1 | A2601 |
| 118 | EVIGITSM | 0.909 | 2 | SB | VP1 | A2602 |
| 315 | KVDGQPMY | 0.730 | 18 | SB | VP1 | A2602 |
| 196 | YLDKNNAY | 0.675 | 33 | SB | VP1 | A2602 |
| 182 | PTAQSQVM | 0.599 | 76 | WB | VP1 | A2602 |
| 217 | NTRYFGTY | 0.573 | 101 | WB | VP1 | A2602 |
| 349 | YIDRQGQL | 0.555 | 123 | WB | VP1 | A2602 |
| 327 | QVEEVRVF | 0.491 | 245 | WB | VP1 | A2602 |
| 190 | NTDHKAYL | 0.463 | 332 | WB | VP1 | A2602 |
| 238 | NTATTVLL | 0.462 | 338 | WB | VP1 | A2602 |
| 196 | YLDKNNAY | 0.550 | 130 | WB | VP1 | A2902 |
| 165 | LMNYRTKY | 0.498 | 228 | WB | VP1 | A2902 |
| 289 | RLRKRSVK | 0.873 | 3 | SB | VP1 | A3001 |
| 280 | RGLARYFK | 0.802 | 8 | SB | VP1 | A3001 |
| 187 | QVMNTDHK | 0.563 | 113 | WB | VP1 | A3001 |
| 308 | LINRRTQK | 0.535 | 153 | WB | VP1 | A3001 |
| 164 | VLMNYRTK | 0.534 | 153 | WB | VP1 | A3001 |
| 285 | YFKIRLRK | 0.497 | 231 | WB | VP1 | A3001 |
| 84 | RYFKIRLR | 0.452 | 377 | WB | VP1 | A3001 |
| 127 | NLHAGSQK | 0.426 | 497 | WB | VP1 | A3001 |
| 315 | KVDGQPMY | 0.436 | 447 | WB | VP1 | A3002 |
| 165 | LMNYRTKY | 0.431 | 473 | WB | VP1 | A3002 |
| 284 | RYFKIRLR | 0.898 | 3 | SB | VP1 | A3101 |
| 280 | RGLARYFK | 0.716 | 21 | SB | VP1 | A3101 |
| 289 | RLRKRSVK | 0.670 | 35 | SB | VP1 | A3101 |
| 282 | LARYFKIR | 0.663 | 38 | SB | VP1 | A3101 |
| 277 | QQWRGLAR | 0.643 | 47 | SB | VP1 | A3101 |
| 285 | YFKIRLRK | 0.581 | 93 | WB | VP1 | A3101 |
| 304 | LLSDLINR | 0.569 | 106 | WB | VP1 | A3101 |
| 308 | LINRRTQK | 0.542 | 141 | WB | VP1 | A3101 |
| 273 | SSGTQQWR | 0.503 | 215 | WB | VP1 | A3101 |
| 164 | VLMNYRTK | 0.434 | 458 | WB | VP1 | A3101 |
| 345 | DMIRYIDR | 0.767 | 12 | SB | VP1 | A3301 |
| 284 | RYFKIRLR | 0.631 | 54 | WB | VP1 | A3301 |
| 282 | LARYFKIR | 0.515 | 190 | WB | VP1 | A3301 |
| 285 | YFKIRLRK | 0.504 | 213 | WB | VP1 | A3301 |
| 277 | QQWRGLAR | 0.444 | 410 | WB | VP1 | A3301 |
| 187 | QVMNTDHK | 0.708 | 23 | SB | VP1 | A6801 |
| 345 | DMIRYIDR | 0.627 | 56 | WB | VP1 | A6801 |
| 325 | ESQVEEVR | 0.606 | 70 | WB | VP1 | A6801 |
| 85 | LPCYSTAR | 0.568 | 107 | WB | VP1 | A6801 |
| 127 | NLHAGSQK | 0.503 | 217 | WB | VP1 | A6801 |
| 304 | LLSDLINR | 0.497 | 230 | WB | VP1 | A6801 |
| 308 | LINRRTQK | 0.497 | 231 | WB | VP1 | A6801 |
| 284 | RYFKIRLR | 0.488 | 254 | WB | VP1 | A6801 |
| 162 | QGVLMNYR | 0.487 | 257 | WB | VP1 | A6801 |
| 305 | LSDLINRR | 0.439 | 431 | WB | VP1 | A6801 |
| 282 | LARYFKIR | 0.438 | 439 | WB | VP1 | A6801 |

TABLE K-continued

Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 238 | NTATTVLL | 0.723 | 19 | SB | VP1 | A6802 |
| 262 | SAADICGL | 0.718 | 21 | SB | VP1 | A6802 |
| 118 | EVIGITSM | 0.718 | 21 | SB | VP1 | A6802 |
| 147 | SNFHFFAV | 0.659 | 39 | SB | VP1 | A6802 |
| 229 | NVPPVLHV | 0.647 | 45 | SB | VP1 | A6802 |
| 297 | NPYPISFL | 0.515 | 191 | WB | VP1 | A6802 |
| 152 | FAVGGDPL | 0.506 | 210 | WB | VP1 | A6802 |
| 88 | YSTARIPL | 0.473 | 300 | WB | VP1 | A6802 |
| 294 | SVKNPYPI | 0.458 | 351 | WB | VP1 | A6802 |
| 254 | CKADSLYV | 0.441 | 421 | WB | VP1 | A6802 |
| 108 | LMWEAVTV | 0.730 | 18 | SB | VP1 | A6901 |
| 238 | NTATTVLL | 0.636 | 51 | WB | VP1 | A6901 |
| 157 | DPLEMQGV | 0.635 | 51 | WB | VP1 | A6901 |
| 297 | NPYPISFL | 0.557 | 120 | WB | VP1 | A6901 |
| 118 | EVIGITSM | 0.548 | 132 | WB | VP1 | A6901 |
| 229 | NVPPVLHV | 0.545 | 137 | WB | VP1 | A6901 |
| 106 | NLLMWEAV | 0.539 | 147 | WB | VP1 | A6901 |
| 262 | SAADICGL | 0.441 | 421 | WB | VP1 | A6901 |
| 19 | EPVQVPKL | 0.431 | 471 | WB | VP1 | A6901 |
| 142 | KPVQGSNF | 0.685 | 30 | SB | VP1 | B0702 |
| 297 | NPYPISFL | 0.489 | 251 | WB | VP1 | B0702 |
| 16 | KPKEPVQV | 0.433 | 462 | WB | VP1 | B0702 |
| 95 | LPNLNEDL | 0.428 | 488 | WB | VP1 | B0702 |
| 68 | HLSAENAF | 0.555 | 123 | WB | VP1 | B1501 |
| 165 | LMNYRTKY | 0.542 | 142 | WB | VP1 | B1501 |
| 161 | MQGVLMNY | 0.509 | 202 | WB | VP1 | B1501 |
| 144 | VQGSNFHF | 0.453 | 369 | WB | VP1 | B1501 |
| 196 | YLDKNNAY | 0.448 | 393 | WB | VP1 | B1501 |
| 246 | DEQGVGPL | 0.554 | 124 | WB | VP1 | B1801 |
| 324 | MESQVEEV | 0.449 | 389 | WB | VP1 | B1801 |
| 159 | LEMQGVLM | 0.439 | 432 | WB | VP1 | B1801 |
| 283 | ARYFKIRL | 0.453 | 371 | WB | VP1 | B2705 |
| 292 | KRSVKNPY | 0.436 | 446 | WB | VP1 | B2705 |
| 279 | WRGLARYF | 0.426 | 496 | WB | VP1 | B2705 |
| 152 | FAVGGDPL | 0.737 | 17 | SB | VP1 | B3501 |
| 142 | KPVQGSNF | 0.631 | 54 | WB | VP1 | B3501 |
| 19 | EPVQVPKL | 0.547 | 134 | WB | VP1 | B3501 |
| 196 | YLDKNNAY | 0.544 | 138 | WB | VP1 | B3501 |
| 118 | EVIGITSM | 0.533 | 157 | WB | VP1 | B3501 |
| 95 | LPNLNEDL | 0.482 | 270 | WB | VP1 | B3501 |
| 299 | YPISFLLS | 0.480 | 278 | WB | VP1 | B3501 |
| 68 | HLSAENAF | 0.472 | 304 | WB | VP1 | B3501 |
| 297 | NPYPISFL | 0.470 | 309 | WB | VP1 | B3501 |
| 227 | GENVPPVL | 0.576 | 98 | WB | VP1 | B4001 |
| 159 | LEMQGVLM | 0.513 | 194 | WB | VP1 | B4001 |
| 324 | MESQVEEV | 0.433 | 462 | WB | VP1 | B4001 |
| 246 | DEQGVGPL | 0.430 | 476 | WB | VP1 | B4001 |
| 227 | GENVPPVL | 0.457 | 357 | WB | VP1 | B4002 |
| 71 | AENAFESD | 0.469 | 312 | WB | VP1 | B4501 |
| 340 | LPGDPDMI | 0.621 | 60 | WB | VP1 | B5101 |
| 230 | VPPVLHVT | 0.446 | 401 | WB | VP1 | B5101 |
| 203 | YPVECWIP | 0.426 | 498 | WB | VP1 | B5101 |
| 297 | NPYPISFL | 0.568 | 107 | WB | VP1 | B5301 |
| 142 | KPVQGSNF | 0.533 | 156 | WB | VP1 | B5301 |
| 19 | EPVQVPKL | 0.525 | 171 | WB | VP1 | B5301 |
| 340 | LPGDPDMI | 0.522 | 176 | WB | VP1 | B5301 |
| 95 | LPNLNEDL | 0.434 | 456 | WB | VP1 | B5301 |
| 299 | YPISFLLS | 0.612 | 66 | WB | VP1 | B5401 |
| 203 | YPVECWIP | 0.524 | 172 | WB | VP1 | B5401 |
| 230 | VPPVLHVT | 0.521 | 178 | WB | VP1 | B5401 |
| 85 | LPCYSTAR | 0.450 | 382 | WB | VP1 | B5401 |
| 340 | LPGDPDMI | 0.436 | 448 | WB | VP1 | B5401 |
| 272 | NSSGTQQW | 0.527 | 166 | WB | VP1 | B5701 |
| 201 | NAYPVECW | 0.479 | 280 | WB | VP1 | B5701 |
| 201 | NAYPVECW | 0.691 | 28 | SB | VP1 | B5801 |
| 272 | NSSGTQQW | 0.675 | 33 | SB | VP1 | B5801 |

9-mers

| pos | peptide | logscore | affinity (nM) | Bind Level | Protein Name | Allele |
|---|---|---|---|---|---|---|
| 107 | LLMWEAVTV | 0.761 | 13 | SB | VP1 | A0201 |
| 83 | KMLPCYSTA | 0.724 | 19 | SB | VP1 | A0201 |
| 26 | LLIKGGVEV | 0.573 | 101 | WB | VP1 | A0201 |
| 323 | GMESQVEEV | 0.550 | 129 | WB | VP1 | A0201 |
| 332 | RVFDGTEQL | 0.550 | 130 | WB | VP1 | A0201 |
| 107 | LLMWEAVTV | 0.769 | 12 | SB | VP1 | A0202 |
| 332 | RVFDGTEQL | 0.681 | 31 | SB | VP1 | A0202 |
| 323 | GMESQVEEV | 0.678 | 32 | SB | VP1 | A0202 |
| 26 | LLIKGGVEV | 0.632 | 53 | WB | VP1 | A0202 |
| 83 | KMLPCYSTA | 0.540 | 145 | WB | VP1 | A0202 |
| 308 | LINRRTQKV | 0.539 | 146 | WB | VP1 | A0202 |
| 61 | NLRGYSQHL | 0.534 | 154 | WB | VP1 | A0202 |
| 127 | NLHAGSQKV | 0.529 | 163 | WB | VP1 | A0202 |
| 43 | AITEVECFL | 0.504 | 213 | WB | VP1 | A0202 |
| 118 | EVIGITSML | 0.480 | 277 | WB | VP1 | A0202 |
| 304 | LLSDLINRR | 0.474 | 295 | WB | VP1 | A0202 |
| 268 | GLFTNSSGT | 0.463 | 333 | WB | VP1 | A0202 |
| 339 | QLPGDPDMI | 0.455 | 363 | WB | VP1 | A0202 |
| 146 | GSNFHFFAV | 0.439 | 430 | WB | VP1 | A0202 |
| 236 | VTNTATTVL | 0.439 | 434 | WB | VP1 | A0202 |
| 107 | LLMWEAVTV | 0.839 | 5 | SB | VP1 | A0203 |
| 308 | LINRRTQKV | 0.820 | 6 | SB | VP1 | A0203 |
| 26 | LLIKGGVEV | 0.818 | 7 | SB | VP1 | A0203 |
| 127 | NLHAGSQKV | 0.786 | 10 | SB | VP1 | A0203 |
| 83 | KMLPCYSTA | 0.761 | 13 | SB | VP1 | A0203 |
| 27 | LIKGGVEVL | 0.623 | 59 | WB | VP1 | A0203 |
| 61 | NLRGYSQHL | 0.616 | 64 | WB | VP1 | A0203 |
| 332 | RVFDGTEQL | 0.609 | 68 | WB | VP1 | A0203 |
| 323 | GMESQVEEV | 0.604 | 72 | WB | VP1 | A0203 |
| 222 | GTYTGGENV | 0.586 | 88 | WB | VP1 | A0203 |
| 258 | SLYVSAADI | 0.570 | 104 | WB | VP1 | A0203 |
| 268 | GLFTNSSGT | 0.535 | 153 | WB | VP1 | A0203 |
| 235 | HVTNTATTV | 0.512 | 195 | WB | VP1 | A0203 |
| 320 | PMYGMESQV | 0.509 | 203 | WB | VP1 | A0203 |
| 125 | MLNLHAGSQ | 0.480 | 277 | WB | VP1 | A0203 |
| 114 | TVKTEVIGI | 0.476 | 288 | WB | VP1 | A0203 |
| 287 | KIRLRKRSV | 0.452 | 374 | WB | VP1 | A0203 |
| 236 | VTNTATTVL | 0.450 | 384 | WB | VP1 | A0203 |
| 107 | LLMWEAVTV | 0.751 | 14 | SB | VP1 | A0204 |
| 26 | LLIKGGVEV | 0.688 | 29 | SB | VP1 | A0204 |
| 323 | GMESQVEEV | 0.648 | 45 | SB | VP1 | A0204 |
| 127 | NLHAGSQKV | 0.613 | 65 | WB | VP1 | A0204 |
| 308 | LINRRTQKV | 0.547 | 133 | WB | VP1 | A0204 |
| 83 | KMLPCYSTA | 0.504 | 214 | WB | VP1 | A0204 |
| 33 | EVLVKTGV | 0.476 | 289 | WB | VP1 | A0204 |
| 43 | AITEVECFL | 0.428 | 488 | WB | VP1 | A0204 |
| 107 | LLMWEAVTV | 0.865 | 4 | SB | VP1 | A0206 |
| 26 | LLIKGGVEV | 0.808 | 7 | SB | VP1 | A0206 |
| 332 | RVFDGTEQL | 0.797 | 8 | SB | VP1 | A0206 |
| 83 | KMLPCYSTA | 0.723 | 20 | SB | VP1 | A0206 |

TABLE K-continued

Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 235 | HVTNTATTV | 0.591 | 83 | WB | VP1 | A0206 |
| 144 | VQGSNFHFF | 0.586 | 88 | WB | VP1 | A0206 |
| 146 | GSNFHFFAV | 0.555 | 123 | WB | VP1 | A0206 |
| 43 | AITEVECFL | 0.542 | 142 | WB | VP1 | A0206 |
| 326 | SQVEEVRVF | 0.472 | 303 | WB | VP1 | A0206 |
| 39 | TGVDAITEV | 0.460 | 344 | WB | VP1 | A0206 |
| 127 | NLHAGSQKV | 0.451 | 378 | WB | VP1 | A0206 |
| 107 | LLMWEAVTV | 0.952 | 1 | SB | VP1 | A0211 |
| 26 | LLIKGGVEV | 0.946 | 1 | SB | VP1 | A0211 |
| 127 | NLHAGSQKV | 0.943 | 1 | SB | VP1 | A0211 |
| 320 | PMYGMESQV | 0.941 | 1 | SB | VP1 | A0211 |
| 332 | RVFDGTEQL | 0.923 | 2 | SB | VP1 | A0211 |
| 83 | KMLPCYSTA | 0.869 | 4 | SB | VP1 | A0211 |
| 43 | AITEVECFL | 0.830 | 6 | SB | VP1 | A0211 |
| 33 | EVLEVKTGV | 0.818 | 7 | SB | VP1 | A0211 |
| 61 | NLRGYSQHL | 0.804 | 8 | SB | VP1 | A0211 |
| 323 | GMESQVEEV | 0.800 | 8 | SB | VP1 | A0211 |
| 308 | LINRRTQKV | 0.688 | 29 | SB | VP1 | A0211 |
| 235 | HVTNTATTV | 0.687 | 29 | SB | VP1 | A0211 |
| 242 | TVLLDEQGV | 0.669 | 35 | SB | VP1 | A0211 |
| 196 | YLDKNNAYP | 0.642 | 48 | SB | VP1 | A0211 |
| 339 | QLPGDPDMI | 0.623 | 59 | WB | VP1 | A0211 |
| 101 | DLTCGNLLM | 0.603 | 73 | WB | VP1 | A0211 |
| 54 | EMGDPDDNL | 0.589 | 85 | WB | VP1 | A0211 |
| 27 | LIKGGVEVL | 0.568 | 107 | WB | VP1 | A0211 |
| 258 | SLYVSAADI | 0.564 | 111 | WB | VP1 | A0211 |
| 176 | TITPKNPTA | 0.543 | 140 | WB | VP1 | A0211 |
| 349 | YIDRQGQLQ | 0.525 | 169 | WB | VP1 | A0211 |
| 222 | GTYTGGENV | 0.521 | 178 | WB | VP1 | A0211 |
| 124 | SMLNLHAGS | 0.494 | 238 | WB | VP1 | A0211 |
| 108 | LMWEAVTVK | 0.489 | 251 | WB | VP1 | A0211 |
| 39 | TGVDAITEV | 0.488 | 253 | WB | VP1 | A0211 |
| 94 | PLPNLNEDL | 0.487 | 256 | WB | VP1 | A0211 |
| 255 | KADSLYVSA | 0.475 | 292 | WB | VP1 | A0211 |
| 118 | EVIGITSML | 0.472 | 304 | WB | VP1 | A0211 |
| 201 | NAYPVECWI | 0.470 | 310 | WB | VP1 | A0211 |
| 106 | NLLMWEAVT | 0.467 | 320 | WB | VP1 | A0211 |
| 268 | GLFTNSSGT | 0.463 | 332 | WB | VP1 | A0211 |
| 244 | LLDEQGVGP | 0.443 | 415 | WB | VP1 | A0211 |
| 26 | LLIKGGVEV | 0.905 | 2 | SB | VP1 | A0212 |
| 107 | LLMWEAVTV | 0.903 | 2 | SB | VP1 | A0212 |
| 127 | NLHAGSQKV | 0.895 | 3 | SB | VP1 | A0212 |
| 320 | PMYGMESQV | 0.883 | 3 | SB | VP1 | A0212 |
| 61 | NLRGYSQHL | 0.837 | 5 | SB | VP1 | A0212 |
| 33 | EVLEVKTGV | 0.810 | 7 | SB | VP1 | A0212 |
| 332 | RVFDGTEQL | 0.768 | 12 | SB | VP1 | A0212 |
| 308 | LINRRTQKV | 0.710 | 23 | SB | VP1 | A0212 |
| 43 | AITEVECFL | 0.696 | 26 | SB | VP1 | A0212 |
| 323 | GMESQVEEV | 0.680 | 31 | SB | VP1 | A0212 |
| 242 | TVLLDEQGV | 0.643 | 47 | SB | VP1 | A0212 |
| 196 | YLDKNNAYP | 0.604 | 72 | WB | VP1 | A0212 |
| 54 | EMGDPDDNL | 0.597 | 78 | WB | VP1 | A0212 |
| 83 | KMLPCYSTA | 0.575 | 99 | WB | VP1 | A0212 |
| 339 | QLPGDPDMI | 0.548 | 132 | WB | VP1 | A0212 |
| 108 | LMWEAVTVK | 0.537 | 149 | WB | VP1 | A0212 |
| 268 | GLFTNSSGT | 0.534 | 155 | WB | VP1 | A0212 |
| 222 | GTYTGGENV | 0.527 | 166 | WB | VP1 | A0212 |
| 27 | LIKGGVEVL | 0.505 | 212 | WB | VP1 | A0212 |
| 124 | SMLNLHAGS | 0.492 | 243 | WB | VP1 | A0212 |
| 244 | LLDEQGVGP | 0.484 | 266 | WB | VP1 | A0212 |
| 164 | VLMNYRTKY | 0.481 | 274 | WB | VP1 | A0212 |
| 94 | PLPNLNEDL | 0.480 | 276 | WB | VP1 | A0212 |
| 235 | HVTNTATTV | 0.457 | 356 | WB | VP1 | A0212 |
| 304 | LLSDLINRR | 0.443 | 414 | WB | VP1 | A0212 |
| 258 | SLYVSAADI | 0.436 | 449 | WB | VP1 | A0212 |
| 349 | YIDRQGQLQ | 0.435 | 452 | WB | VP1 | A0212 |
| 201 | NAYPVECWI | 0.435 | 453 | WB | VP1 | A0212 |
| 26 | LLIKGGVEV | 0.935 | 2 | SB | VP1 | A0216 |
| 320 | PMYGMESQV | 0.926 | 2 | SB | VP1 | A0216 |
| 127 | NLHAGSQKV | 0.887 | 3 | SB | VP1 | A0216 |
| 107 | LLMWEAVTV | 0.872 | 3 | SB | VP1 | A0216 |
| 332 | RVFDGTEQL | 0.838 | 5 | SB | VP1 | A0216 |
| 61 | NLRGYSQHL | 0.835 | 5 | SB | VP1 | A0216 |
| 43 | AITEVECFL | 0.834 | 6 | SB | VP1 | A0216 |
| 323 | GMESQVEEV | 0.826 | 6 | SB | VP1 | A0216 |
| 235 | HVTNTATTV | 0.762 | 13 | SB | VP1 | A0216 |
| 33 | EVLEVKTGV | 0.742 | 16 | SB | VP1 | A0216 |
| 308 | LINRRTQKV | 0.701 | 25 | SB | VP1 | A0216 |
| 83 | KMLPCYSTA | 0.653 | 42 | SB | VP1 | A0216 |
| 54 | EMGDPDDNL | 0.649 | 44 | SB | VP1 | A0216 |
| 201 | NAYPVECWI | 0.593 | 81 | WB | VP1 | A0216 |
| 111 | EAVTVKTEV | 0.540 | 145 | WB | VP1 | A0216 |
| 39 | TGVDAITEV | 0.524 | 171 | WB | VP1 | A0216 |
| 118 | EVIGITSML | 0.513 | 194 | WB | VP1 | A0216 |
| 196 | YLDKNNAYP | 0.512 | 196 | WB | VP1 | A0216 |
| 339 | QLPGDPDMI | 0.491 | 245 | WB | VP1 | A0216 |
| 222 | GTYTGGENV | 0.485 | 262 | WB | VP1 | A0216 |
| 27 | LIKGGVEVL | 0.467 | 318 | WB | VP1 | A0216 |
| 176 | TITPKNPTA | 0.462 | 336 | WB | VP1 | A0216 |
| 94 | PLPNLNEDL | 0.426 | 496 | WB | VP1 | A0216 |
| 127 | NLHAGSQKV | 0.862 | 4 | SB | VP1 | A0219 |
| 107 | LLMWEAVTV | 0.811 | 7 | SB | VP1 | A0219 |
| 320 | PMYGMESQV | 0.786 | 10 | SB | VP1 | A0219 |
| 26 | LLIKGGVEV | 0.776 | 11 | SB | VP1 | A0219 |
| 332 | RVFDGTEQL | 0.762 | 13 | SB | VP1 | A0219 |
| 323 | GMESQVEEV | 0.643 | 47 | SB | VP1 | A0219 |
| 61 | NLRGYSQHL | 0.621 | 60 | WB | VP1 | A0219 |
| 54 | EMGDPDDNL | 0.581 | 93 | WB | VP1 | A0219 |
| 235 | HVTNTATTV | 0.537 | 150 | WB | VP1 | A0219 |
| 33 | EVLEVKTGV | 0.529 | 162 | WB | VP1 | A0219 |
| 308 | LINRRTQKV | 0.528 | 165 | WB | VP1 | A0219 |
| 39 | TGVDAITEV | 0.492 | 242 | WB | VP1 | A0219 |
| 108 | LMWEAVTVK | 0.442 | 417 | WB | VP1 | A0219 |
| 27 | LIKGGVEVL | 0.438 | 437 | WB | VP1 | A0219 |
| 284 | RYFKIRLRK | 0.643 | 47 | SB | VP1 | A0301 |
| 108 | LMWEAVTVK | 0.570 | 104 | WB | VP1 | A0301 |
| 134 | KVHENGGGK | 0.525 | 170 | WB | VP1 | A0301 |
| 164 | VLMNYRTKY | 0.453 | 370 | WB | VP1 | A0301 |
| 163 | GVLMNYRTK | 0.440 | 426 | WB | VP1 | A0301 |
| 163 | GVLMNYRTK | 0.621 | 60 | WB | VP1 | A1101 |
| 186 | SQVMNTDHK | 0.599 | 76 | WB | VP1 | A1101 |
| 284 | RYFKIRLRK | 0.586 | 88 | WB | VP1 | A1101 |
| 276 | TQQWRGLAR | 0.561 | 115 | WB | VP1 | A1101 |
| 134 | KVHENGGGK | 0.556 | 121 | WB | VP1 | A1101 |
| 284 | RYFKIRLRK | 0.724 | 19 | SB | VP1 | A2301 |
| 87 | CYSTARIPL | 0.572 | 102 | WB | VP1 | A2301 |
| 143 | PVQGSNFHF | 0.555 | 123 | WB | VP1 | A2301 |
| 348 | RYIDRQGQL | 0.538 | 147 | WB | VP1 | A2301 |
| 144 | VQGSNFHFF | 0.480 | 277 | WB | VP1 | A2301 |
| 144 | VQGSNFHFF | 0.521 | 178 | WB | VP1 | A2402 |
| 348 | RYIDRQGQL | 0.506 | 210 | WB | VP1 | A2402 |
| 348 | RYIDRQGQL | 0.602 | 73 | WB | VP1 | A2403 |
| 195 | AYLDKNNAY | 0.502 | 218 | WB | VP1 | A2403 |
| 278 | QWRGLARYF | 0.434 | 457 | WB | VP1 | A2403 |

TABLE K-continued

Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 118 | EVIGITSML | 0.663 | 38 | SB | VP1 | A2601 |
| 160 | EMQGVLMNY | 0.553 | 126 | WB | VP1 | A2601 |
| 118 | EVIGITSML | 0.898 | 3 | SB | VP1 | A2602 |
| 160 | EMQGVLMNY | 0.659 | 39 | SB | VP1 | A2602 |
| 36 | EVKTGVDAI | 0.584 | 90 | WB | VP1 | A2602 |
| 164 | VLMNYRTKY | 0.620 | 61 | WB | VP1 | A2902 |
| 188 | VMNTDHKAY | 0.535 | 153 | WB | VP1 | A2902 |
| 195 | AYLDKNNAY | 0.524 | 172 | WB | VP1 | A2902 |
| 284 | RYFKIRLRK | 0.812 | 7 | SB | VP1 | A3001 |
| 134 | KVHENGGGK | 0.791 | 9 | SB | VP1 | A3001 |
| 163 | GVLMNYRTK | 0.563 | 113 | WB | VP1 | A3001 |
| 291 | RKRSVKNPY | 0.543 | 141 | WB | VP1 | A3001 |
| 169 | RTKYPQGTI | 0.492 | 243 | WB | VP1 | A3001 |
| 191 | TDHKAYLDK | 0.436 | 444 | WB | VP1 | A3001 |
| 287 | KIRLRKRSV | 0.436 | 446 | WB | VP1 | A3001 |
| 289 | RLRKRSVKN | 0.436 | 447 | WB | VP1 | A3001 |
| 186 | SQVMNTDHK | 0.434 | 455 | WB | VP1 | A3001 |
| 161 | MQGVLMNYR | 0.811 | 7 | SB | VP1 | A3101 |
| 285 | YFKIRLRKR | 0.800 | 8 | SB | VP1 | A3101 |
| 284 | RYFKIRLRK | 0.762 | 13 | SB | VP1 | A3101 |
| 276 | TQQWRGLAR | 0.627 | 56 | WB | VP1 | A3101 |
| 84 | MLPCYSTAR | 0.578 | 95 | WB | VP1 | A3101 |
| 304 | LLSDLINRR | 0.573 | 101 | WB | VP1 | A3101 |
| 281 | GLARYFKIR | 0.520 | 180 | WB | VP1 | A3101 |
| 108 | LMWEAVTVK | 0.502 | 219 | WB | VP1 | A3101 |
| 303 | FLLSDLINR | 0.441 | 422 | WB | VP1 | A3101 |
| 285 | YFKIRLRKR | 0.782 | 10 | SB | VP1 | A3301 |
| 307 | DLINRRTQK | 0.659 | 39 | SB | VP1 | A3301 |
| 272 | NSSGTQQWR | 0.732 | 18 | SB | VP1 | A6801 |
| 84 | MLPCYSTAR | 0.720 | 20 | SB | VP1 | A6801 |
| 307 | DLINRRTQK | 0.593 | 81 | WB | VP1 | A6801 |
| 324 | MESQVEEVR | 0.548 | 132 | WB | VP1 | A6801 |
| 304 | LLSDLINRR | 0.543 | 140 | WB | VP1 | A6801 |
| 118 | EVIGITSML | 0.509 | 202 | WB | VP1 | A6801 |
| 161 | MQGVLMNYR | 0.437 | 442 | WB | VP1 | A6801 |
| 284 | RYFKIRLRK | 0.437 | 444 | WB | VP1 | A6801 |
| 118 | EVIGITSML | 0.903 | 2 | SB | VP1 | A6802 |
| 111 | EAVTVKTEV | 0.739 | 16 | SB | VP1 | A6802 |
| 33 | EVLEVKTGV | 0.728 | 18 | SB | VP1 | A6802 |
| 39 | TGVDAITEV | 0.683 | 30 | SB | VP1 | A6802 |
| 297 | NPYPISFLL | 0.632 | 53 | WB | VP1 | A6802 |
| 332 | RVFDGTEQL | 0.578 | 95 | WB | VP1 | A6802 |
| 145 | QGSNFHFFA | 0.563 | 113 | WB | VP1 | A6802 |
| 201 | NAYPVECWI | 0.556 | 121 | WB | VP1 | A6802 |
| 187 | QVMNTDHKA | 0.527 | 167 | WB | VP1 | A6802 |
| 146 | GSNFHFFAV | 0.497 | 231 | WB | VP1 | A6802 |
| 293 | RSVKNPYPI | 0.457 | 357 | WB | VP1 | A6802 |
| 261 | VSAADICGL | 0.455 | 364 | WB | VP1 | A6802 |
| 235 | HVTNTATTV | 0.444 | 410 | WB | VP1 | A6802 |
| 229 | NVPPVLHVT | 0.441 | 422 | WB | VP1 | A6802 |
| 297 | NPYPISFLL | 0.673 | 34 | SB | VP1 | A6901 |
| 118 | EVIGITSML | 0.636 | 51 | WB | VP1 | A6901 |
| 235 | HVTNTATTV | 0.546 | 136 | WB | VP1 | A6901 |
| 107 | LLMWEAVTV | 0.499 | 225 | WB | VP1 | A6901 |
| 201 | NAYPVECWI | 0.485 | 262 | WB | VP1 | A6901 |
| 111 | EAVTVKTEV | 0.483 | 268 | WB | VP1 | A6901 |
| 225 | TGGENVPPV | 0.469 | 311 | WB | VP1 | A6901 |
| 222 | GTYTGGENV | 0.437 | 440 | WB | VP1 | A6901 |
| 127 | NLHAGSQKV | 0.433 | 463 | WB | VP1 | A6901 |
| 332 | RVFDGTEQL | 0.430 | 474 | WB | VP1 | A6901 |
| 85 | LPCYSTARI | 0.692 | 28 | SB | VP1 | B0702 |
| 13 | APKKPKEPV | 0.688 | 29 | SB | VP1 | B0702 |
| 1 | APTKRKGEC | 0.619 | 61 | WB | VP1 | B0702 |
| 282 | LARYFKIRL | 0.535 | 153 | WB | VP1 | B0702 |
| 287 | KIRLRKRSV | 0.520 | 179 | WB | VP1 | B0702 |
| 181 | NPTAQSQVM | 0.498 | 227 | WB | VP1 | B0702 |
| 79 | SPDRKMLPC | 0.482 | 272 | WB | VP1 | B0702 |
| 19 | EPVQVPKLL | 0.474 | 295 | WB | VP1 | B0702 |
| 251 | GPLCKADSL | 0.455 | 364 | WB | VP1 | B0702 |
| 287 | KIRLRKRSV | 0.431 | 472 | WB | VP1 | B0801 |
| 326 | SQVEEVRVF | 0.598 | 77 | WB | VP1 | B1501 |
| 188 | VMNTDHKAY | 0.589 | 85 | WB | VP1 | B1501 |
| 313 | TQKVDGQPM | 0.566 | 108 | WB | VP1 | B1501 |
| 277 | QQWRGLARY | 0.543 | 140 | WB | VP1 | B1501 |
| 160 | EMQGVLMNY | 0.456 | 360 | WB | VP1 | B1501 |
| 295 | VKNPYPISF | 0.595 | 79 | WB | VP1 | B1801 |
| 117 | TEVIGITSM | 0.472 | 303 | WB | VP1 | B1801 |
| 288 | IRLRKRSVK | 0.523 | 174 | WB | VP1 | B2705 |
| 279 | WRGLARYFK | 0.486 | 259 | WB | VP1 | B2705 |
| 181 | NPTAQSQVM | 0.758 | 13 | SB | VP1 | B3501 |
| 57 | DPDDNLRGY | 0.613 | 65 | WB | VP1 | B3501 |
| 157 | DPLEMQGVL | 0.577 | 97 | WB | VP1 | B3501 |
| 142 | KPVQGSNFH | 0.574 | 99 | WB | VP1 | B3501 |
| 297 | NPYPISFLL | 0.568 | 107 | WB | VP1 | B3501 |
| 151 | FFAVGGDPL | 0.565 | 110 | WB | VP1 | B3501 |
| 67 | QHLSAENAF | 0.495 | 235 | WB | VP1 | B3501 |
| 203 | YPVECWIPD | 0.491 | 247 | WB | VP1 | B3501 |
| 19 | EPVQVPKLL | 0.475 | 292 | WB | VP1 | B3501 |
| 42 | DAITEVECF | 0.468 | 317 | WB | VP1 | B3501 |
| 95 | LPNLNEDLT | 0.441 | 424 | WB | VP1 | B3501 |
| 136 | HENGGGKPV | 0.448 | 391 | WB | VP1 | B4001 |
| 47 | VECFLNPEM | 0.431 | 469 | WB | VP1 | B4001 |
| 71 | AENAFESDS | 0.600 | 75 | WB | VP1 | B4501 |
| 85 | LPCYSTARI | 0.659 | 39 | SB | VP1 | B5101 |
| 19 | EPVQVPKLL | 0.475 | 292 | WB | VP1 | B5101 |
| 297 | NPYPISFLL | 0.459 | 350 | WB | VP1 | B5101 |
| 85 | LPCYSTARI | 0.655 | 41 | SB | VP1 | B5301 |
| 297 | NPYPISFLL | 0.623 | 59 | WB | VP1 | B5301 |
| 19 | EPVQVPKLL | 0.535 | 152 | WB | VP1 | B5301 |
| 95 | LPNLNEDLT | 0.636 | 51 | WB | VP1 | B5401 |
| 85 | LPCYSTARI | 0.591 | 83 | WB | VP1 | B5401 |
| 203 | YPVECWIPD | 0.481 | 273 | WB | VP1 | B5401 |
| 299 | YPISFLLSD | 0.435 | 452 | WB | VP1 | B5401 |
| 102 | LTCGNLLMW | 0.453 | 371 | WB | VP1 | B5701 |
| 102 | LTCGNLLMW | 0.624 | 58 | WB | VP1 | B5801 |

10-mers

| pos | peptide | logscore | affinity (nM) | Bind Level | Protein Name | Allele |
|---|---|---|---|---|---|---|
| 196 | YLDKNNAYPV | 0.866 | 4 | SB | VP1 | A0201 |
| 108 | LMWEAVTVKT | 0.691 | 28 | SB | VP1 | A0201 |
| 84 | MLPCYSTARI | 0.675 | 33 | SB | VP1 | A0201 |
| 106 | NLLMWEAVTV | 0.634 | 52 | WB | VP1 | A0201 |
| 224 | YTGGENVPPV | 0.608 | 69 | WB | VP1 | A0201 |
| 260 | YVSAADICGL | 0.589 | 85 | WB | VP1 | A0201 |
| 244 | LLDEQGVGPL | 0.537 | 150 | WB | VP1 | A0201 |
| 25 | KLLIKGGVEV | 0.517 | 185 | WB | VP1 | A0201 |
| 188 | VMNTDHKAYL | 0.504 | 214 | WB | VP1 | A0201 |
| 281 | GLARYFKIRL | 0.482 | 271 | WB | VP1 | A0201 |

TABLE K-continued

Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 322 | YGMESQVEEV | 0.465 | 325 | WB | VP1 | A0201 |
| 26 | LLIKGGVEVL | 0.465 | 328 | WB | VP1 | A0201 |
| 196 | YLDKNNAYPV | 0.722 | 20 | SB | VP1 | A0202 |
| 260 | YVSAADICGL | 0.676 | 33 | SB | VP1 | A0202 |
| 244 | LLDEQGVGPL | 0.652 | 43 | SB | VP1 | A0202 |
| 26 | LLIKGGVEVL | 0.621 | 60 | WB | VP1 | A0202 |
| 188 | VMNTDHKAYL | 0.613 | 66 | WB | VP1 | A0202 |
| 84 | MLPCYSTARI | 0.604 | 72 | WB | VP1 | A0202 |
| 106 | NLLMWEAVTV | 0.571 | 104 | WB | VP1 | A0202 |
| 224 | YTGGENVPPV | 0.554 | 124 | WB | VP1 | A0202 |
| 281 | GLARYFKIRL | 0.520 | 179 | WB | VP1 | A0202 |
| 303 | FLLSDLINRR | 0.495 | 236 | WB | VP1 | A0202 |
| 304 | LLSDLINRRT | 0.487 | 257 | WB | VP1 | A0202 |
| 322 | YGMESQVEEV | 0.470 | 308 | WB | VP1 | A0202 |
| 25 | KLLIKGGVEV | 0.462 | 338 | WB | VP1 | A0202 |
| 38 | KTGVDAITEV | 0.453 | 372 | WB | VP1 | A0202 |
| 255 | KADSLYVSAA | 0.442 | 419 | WB | VP1 | A0202 |
| 84 | MLPCYSTARI | 0.854 | 4 | SB | VP1 | A0203 |
| 196 | YLDKNNAYPV | 0.801 | 8 | SB | VP1 | A0203 |
| 244 | LLDEQGVGPL | 0.704 | 24 | SB | VP1 | A0203 |
| 188 | VMNTDHKAYL | 0.702 | 25 | SB | VP1 | A0203 |
| 26 | LLIKGGVEVL | 0.663 | 38 | SB | VP1 | A0203 |
| 106 | NLLMWEAVTV | 0.660 | 39 | SB | VP1 | A0203 |
| 224 | YTGGENVPPV | 0.611 | 67 | WB | VP1 | A0203 |
| 260 | YVSAADICGL | 0.606 | 70 | WB | VP1 | A0203 |
| 25 | KLLIKGGVEV | 0.596 | 79 | WB | VP1 | A0203 |
| 281 | GLARYFKIRL | 0.590 | 84 | WB | VP1 | A0203 |
| 304 | LLSDLINRRT | 0.530 | 162 | WB | VP1 | A0203 |
| 108 | LMWEAVTVKT | 0.467 | 319 | WB | VP1 | A0203 |
| 233 | VLHVTNTATT | 0.462 | 338 | WB | VP1 | A0203 |
| 352 | RQGQLQTKMV | 0.448 | 391 | WB | VP1 | A0203 |
| 236 | VTNTATTVLL | 0.446 | 399 | WB | VP1 | A0203 |
| 38 | KTGVDAITEV | 0.441 | 424 | WB | VP1 | A0203 |
| 307 | DLINRRTQKV | 0.438 | 437 | WB | VP1 | A0203 |
| 196 | YLDKNNAYPV | 0.658 | 40 | SB | VP1 | A0204 |
| 25 | KLLIKGGVEV | 0.650 | 44 | SB | VP1 | A0204 |
| 244 | LLDEQGVGPL | 0.598 | 77 | WB | VP1 | A0204 |
| 224 | YTGGENVPPV | 0.596 | 78 | WB | VP1 | A0204 |
| 108 | LMWEAVTVKT | 0.548 | 133 | WB | VP1 | A0204 |
| 106 | NLLMWEAVTV | 0.541 | 142 | WB | VP1 | A0204 |
| 38 | KTGVDAITEV | 0.517 | 185 | WB | VP1 | A0204 |
| 322 | YGMESQVEEV | 0.499 | 226 | WB | VP1 | A0204 |
| 188 | VMNTDHKAYL | 0.473 | 299 | WB | VP1 | A0204 |
| 26 | LLIKGGVEVL | 0.468 | 315 | WB | VP1 | A0204 |
| 89 | STARIPLPNL | 0.433 | 459 | WB | VP1 | A0204 |
| 196 | YLDKNNAYPV | 0.873 | 3 | SB | VP1 | A0206 |
| 144 | VQGSNFHFFA | 0.733 | 17 | SB | VP1 | A0206 |
| 106 | NLLMWEAVTV | 0.694 | 27 | SB | VP1 | A0206 |
| 260 | YVSAADICGL | 0.677 | 32 | SB | VP1 | A0206 |
| 84 | MLPCYSTARI | 0.671 | 35 | SB | VP1 | A0206 |
| 244 | LLDEQGVGPL | 0.637 | 50 | WB | VP1 | A0206 |
| 224 | YTGGENVPPV | 0.606 | 71 | WB | VP1 | A0206 |
| 38 | KTGVDAITEV | 0.590 | 84 | WB | VP1 | A0206 |
| 25 | KLLIKGGVEV | 0.588 | 86 | WB | VP1 | A0206 |
| 186 | SQVMNTDHKA | 0.588 | 86 | WB | VP1 | A0206 |
| 352 | RQGQLQTKMV | 0.559 | 118 | WB | VP1 | A0206 |
| 152 | FAVGGDPLEM | 0.550 | 129 | WB | VP1 | A0206 |
| 26 | LLIKGGVEVL | 0.549 | 131 | WB | VP1 | A0206 |
| 322 | YGMESQVEEV | 0.514 | 191 | WB | VP1 | A0206 |
| 277 | QQWRGLARYF | 0.509 | 202 | WB | VP1 | A0206 |
| 108 | LMWEAVTVKT | 0.503 | 216 | WB | VP1 | A0206 |
| 161 | MQGVLMNYRT | 0.428 | 486 | WB | VP1 | A0206 |
| 196 | YLDKNNAYPV | 0.976 | 1 | SB | VP1 | A0211 |
| 106 | NLLMWEAVTV | 0.926 | 2 | SB | VP1 | A0211 |
| 244 | LLDEQGVGPL | 0.906 | 2 | SB | VP1 | A0211 |
| 25 | KLLIKGGVEV | 0.849 | 5 | SB | VP1 | A0211 |
| 26 | LLIKGGVEVL | 0.843 | 5 | SB | VP1 | A0211 |
| 224 | YTGGENVPPV | 0.820 | 7 | SB | VP1 | A0211 |
| 281 | GLARYFKIRL | 0.817 | 7 | SB | VP1 | A0211 |
| 252 | PLCKADSLYV | 0.801 | 8 | SB | VP1 | A0211 |
| 188 | VMNTDHKAYL | 0.798 | 8 | SB | VP1 | A0211 |
| 84 | MLPCYSTARI | 0.773 | 11 | SB | VP1 | A0211 |
| 307 | DLINRRTQKV | 0.751 | 14 | SB | VP1 | A0211 |
| 108 | LMWEAVTVKT | 0.740 | 16 | SB | VP1 | A0211 |
| 260 | YVSAADICGL | 0.693 | 27 | SB | VP1 | A0211 |
| 349 | YIDRQGQLQT | 0.652 | 43 | SB | VP1 | A0211 |
| 304 | LLSDLINRRT | 0.628 | 55 | WB | VP1 | A0211 |
| 322 | YGMESQVEEV | 0.608 | 69 | WB | VP1 | A0211 |
| 155 | GGDPLEMQGV | 0.597 | 78 | WB | VP1 | A0211 |
| 315 | KVDGQPMYGM | 0.593 | 82 | WB | VP1 | A0211 |
| 124 | SMLNLHAGSQ | 0.578 | 96 | WB | VP1 | A0211 |
| 38 | KTGVDAITEV | 0.533 | 156 | WB | VP1 | A0211 |
| 268 | GLFTNSSGTQ | 0.499 | 226 | WB | VP1 | A0211 |
| 243 | VLLDEQGVGP | 0.427 | 494 | WB | VP1 | A0211 |
| 196 | YLDKNNAYPV | 0.940 | 1 | SB | VP1 | A0212 |
| 106 | NLLMWEAVTV | 0.863 | 4 | SB | VP1 | A0212 |
| 26 | LLIKGGVEVL | 0.799 | 8 | SB | VP1 | A0212 |
| 244 | LLDEQGVGPL | 0.763 | 12 | SB | VP1 | A0212 |
| 281 | GLARYFKIRL | 0.762 | 13 | SB | VP1 | A0212 |
| 224 | YTGGENVPPV | 0.734 | 17 | SB | VP1 | A0212 |
| 188 | VMNTDHKAYL | 0.728 | 19 | SB | VP1 | A0212 |
| 108 | LMWEAVTVKT | 0.718 | 21 | SB | VP1 | A0212 |
| 25 | KLLIKGGVEV | 0.705 | 24 | SB | VP1 | A0212 |
| 84 | MLPCYSTARI | 0.659 | 40 | SB | VP1 | A0212 |
| 260 | YVSAADICGL | 0.646 | 46 | SB | VP1 | A0212 |
| 307 | DLINRRTQKV | 0.625 | 57 | WB | VP1 | A0212 |
| 252 | PLCKADSLYV | 0.620 | 60 | WB | VP1 | A0212 |
| 304 | LLSDLINRRT | 0.541 | 143 | WB | VP1 | A0212 |
| 349 | YIDRQGQLQT | 0.533 | 157 | WB | VP1 | A0212 |
| 155 | GGDPLEMQGV | 0.513 | 195 | WB | VP1 | A0212 |
| 243 | VLLDEQGVGP | 0.504 | 213 | WB | VP1 | A0212 |
| 303 | FLLSDLINRR | 0.481 | 274 | WB | VP1 | A0212 |
| 322 | YGMESQVEEV | 0.474 | 297 | WB | VP1 | A0212 |
| 124 | SMLNLHAGSQ | 0.430 | 477 | WB | VP1 | A0212 |
| 196 | YLDKNNAYPV | 0.945 | 1 | SB | VP1 | A0216 |
| 106 | NLLMWEAVTV | 0.882 | 3 | SB | VP1 | A0216 |
| 252 | PLCKADSLYV | 0.866 | 4 | SB | VP1 | A0216 |
| 281 | GLARYFKIRL | 0.844 | 5 | SB | VP1 | A0216 |
| 307 | DLINRRTQKV | 0.820 | 7 | SB | VP1 | A0216 |
| 26 | LLIKGGVEVL | 0.800 | 8 | SB | VP1 | A0216 |
| 25 | KLLIKGGVEV | 0.779 | 10 | SB | VP1 | A0216 |
| 244 | LLDEQGVGPL | 0.740 | 16 | SB | VP1 | A0216 |
| 224 | YTGGENVPPV | 0.726 | 19 | SB | VP1 | A0216 |
| 84 | MLPCYSTARI | 0.723 | 19 | SB | VP1 | A0216 |
| 188 | VMNTDHKAYL | 0.662 | 38 | SB | VP1 | A0216 |
| 108 | LMWEAVTVKT | 0.606 | 70 | WB | VP1 | A0216 |
| 260 | YVSAADICGL | 0.545 | 136 | WB | VP1 | A0216 |
| 38 | KTGVDAITEV | 0.510 | 199 | WB | VP1 | A0216 |
| 304 | LLSDLINRRT | 0.477 | 285 | WB | VP1 | A0216 |
| 349 | YIDRQGQLQT | 0.470 | 309 | WB | VP1 | A0216 |
| 28 | IKGGVEVLEV | 0.430 | 478 | WB | VP1 | A0216 |
| 196 | YLDKNNAYPV | 0.940 | 1 | SB | VP1 | A0219 |
| 106 | NLLMWEAVTV | 0.763 | 12 | SB | VP1 | A0219 |
| 224 | YTGGENVPPV | 0.678 | 32 | SB | VP1 | A0219 |
| 26 | LLIKGGVEVL | 0.671 | 35 | SB | VP1 | A0219 |
| 260 | YVSAADICGL | 0.656 | 41 | SB | VP1 | A0219 |
| 244 | LLDEQGVGPL | 0.644 | 46 | SB | VP1 | A0219 |

TABLE K-continued

Prediction of BK virus VP1 protein specific MHC class1, 8-, 9-, 10-, 11-mer peptide binders for 42 MHC class TABLE K-continued Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 117 | TEVIGITSML | 0.570 | 104 | WB | VP1 | B4001 |
| 324 | MESQVEEVRV | 0.475 | 293 | WB | VP1 | B4001 |
| 53 | PEMGDPDDNL | 0.473 | 298 | WB | VP1 | B4001 |
| 99 | NEDLTCGNLL | 0.471 | 304 | WB | VP1 | B4001 |
| 110 | WEAVTVKTEV | 0.428 | 488 | WB | VP1 | B4001 |
| 215 | NENTRYFGTY | 0.430 | 476 | WB | VP1 | B4402 |
| 71 | AENAFESDSP | 0.495 | 235 | WB | VP1 | B4501 |
| 19 | EPVQVPKLLI | 0.654 | 42 | SB | VP1 | B5101 |
| 299 | YPISFLLSDL | 0.557 | 120 | WB | VP1 | B5101 |
| 19 | EPVQVPKLLI | 0.658 | 40 | SB | VP1 | B5301 |
| 299 | YPISFLLSDL | 0.604 | 72 | WB | VP1 | B5301 |
| 142 | KPVQGSNFHF | 0.531 | 159 | WB | VP1 | B5301 |
| 340 | LPGDPDMIRY | 0.523 | 174 | WB | VP1 | B5301 |
| 79 | SPDRKMLPCY | 0.468 | 315 | WB | VP1 | B5301 |
| 211 | DPSRNENTRY | 0.468 | 316 | WB | VP1 | B5301 |
| 23 | VPKLLIKGGV | 0.607 | 70 | WB | VP1 | B5401 |
| 231 | PPVLHVTNTA | 0.590 | 84 | WB | VP1 | B5401 |
| 85 | LPCYSTARIP | 0.533 | 157 | WB | VP1 | B5401 |
| 19 | EPVQVPKLLI | 0.463 | 332 | WB | VP1 | B5401 |
| 203 | YPVECWIPDP | 0.456 | 358 | WB | VP1 | B5401 |
| 270 | FTNSSGTQQW | 0.478 | 285 | WB | VP1 | B5701 |
| 270 | FTNSSGTQQW | 0.738 | 16 | SB | VP1 | B5801 |
| 199 | KNNAYPVECW | 0.634 | 52 | WB | VP1 | B5801 |
| 261 | VSAADICGLF | 0.458 | 351 | WB | VP1 | B5801 |

11-mers

| pos | peptide | logscore | affinity (nM) | Bind Level | Protein Name | Allele |
|---|---|---|---|---|---|---|
| 83 | KMLPCYSTARI | 0.778 | 11 | SB | VP1 | A0201 |
| 107 | LLMWEAVTVKT | 0.594 | 80 | WB | VP1 | A0201 |
| 243 | VLLDEQGVGPL | 0.577 | 97 | WB | VP1 | A0201 |
| 303 | FLLSDLINRRT | 0.551 | 129 | WB | VP1 | A0201 |
| 233 | VLHVTNTATTV | 0.497 | 230 | WB | VP1 | A0201 |
| 144 | VQGSNFHFFAV | 0.461 | 342 | WB | VP1 | A0201 |
| 125 | MLNLHAGSQKV | 0.459 | 348 | WB | VP1 | A0201 |
| 187 | QVMNTDHKAYL | 0.444 | 407 | WB | VP1 | A0201 |
| 323 | GMESQVEEVRV | 0.434 | 458 | WB | VP1 | A0201 |
| 125 | MLNLHAGSQKV | 0.757 | 13 | SB | VP1 | A0202 |
| 97 | NLNEDLTCGNL | 0.678 | 32 | SB | VP1 | A0202 |
| 243 | VLLDEQGVGPL | 0.618 | 62 | WB | VP1 | A0202 |
| 83 | KMLPCYSTARI | 0.597 | 78 | WB | VP1 | A0202 |
| 107 | LLMWEAVTVKT | 0.592 | 82 | WB | VP1 | A0202 |
| 323 | GMESQVEEVRV | 0.558 | 119 | WB | VP1 | A0202 |
| 144 | VQGSNFHFFAV | 0.548 | 133 | WB | VP1 | A0202 |
| 233 | VLHVTNTATTV | 0.506 | 209 | WB | VP1 | A0202 |
| 187 | QVMNTDHKAYL | 0.482 | 270 | WB | VP1 | A0202 |
| 303 | FLLSDLINRRT | 0.438 | 436 | WB | VP1 | A0202 |
| 125 | MLNLHAGSQKV | 0.897 | 3 | SB | VP1 | A0203 |
| 27 | LIKGGVEVLEV | 0.784 | 10 | SB | VP1 | A0203 |
| 83 | KMLPCYSTARI | 0.744 | 15 | SB | VP1 | A0203 |
| 233 | VLHVTNTATTV | 0.743 | 16 | SB | VP1 | A0203 |
| 97 | NLNEDLTCGNL | 0.709 | 23 | SB | VP1 | A0203 |
| 243 | VLLDEQGVGPL | 0.708 | 23 | SB | VP1 | A0203 |
| 61 | NLRGYSQHLSA | 0.693 | 27 | SB | VP1 | A0203 |
| 107 | LLMWEAVTVKT | 0.605 | 71 | WB | VP1 | A0203 |
| 134 | KVHENGGGKPV | 0.574 | 99 | WB | VP1 | A0203 |
| 144 | VQGSNFHFFAV | 0.520 | 180 | WB | VP1 | A0203 |
| 294 | SVKNPYPISFL | 0.475 | 292 | WB | VP1 | A0203 |
| 346 | MIRYIDRQGQL | 0.471 | 306 | WB | VP1 | A0203 |
| 323 | GMESQVEEVRV | 0.459 | 348 | WB | VP1 | A0203 |
| 303 | FLLSDLINRRT | 0.454 | 367 | WB | VP1 | A0203 |
| 125 | MLNLHAGSQKV | 0.687 | 29 | SB | VP1 | A0204 |
| 233 | VLHVTNTATTV | 0.655 | 41 | SB | VP1 | A0204 |
| 243 | VLLDEQGVGPL | 0.629 | 55 | WB | VP1 | A0204 |
| 134 | KVHENGGGKPV | 0.544 | 138 | WB | VP1 | A0204 |
| 323 | GMESQVEEVRV | 0.544 | 138 | WB | VP1 | A0204 |
| 83 | KMLPCYSTARI | 0.497 | 230 | WB | VP1 | A0204 |
| 144 | VQGSNFHFFAV | 0.476 | 290 | WB | VP1 | A0204 |
| 107 | LLMWEAVTVKT | 0.464 | 328 | WB | VP1 | A0204 |
| 195 | AYLDKNNAYPV | 0.460 | 345 | WB | VP1 | A0204 |
| 25 | KLLIKGGVEVL | 0.443 | 415 | WB | VP1 | A0204 |
| 224 | YTGGENVPPVL | 0.428 | 487 | WB | VP1 | A0204 |
| 144 | VQGSNFHFFAV | 0.865 | 4 | SB | VP1 | A0206 |
| 83 | KMLPCYSTARI | 0.720 | 20 | SB | VP1 | A0206 |
| 125 | MLNLHAGSQKV | 0.576 | 97 | WB | VP1 | A0206 |
| 243 | VLLDEQGVGPL | 0.571 | 103 | WB | VP1 | A0206 |
| 318 | GQPMYGMESQV | 0.519 | 181 | WB | VP1 | A0206 |
| 107 | LLMWEAVTVKT | 0.498 | 229 | WB | VP1 | A0206 |
| 187 | QVMNTDHKAYL | 0.485 | 261 | WB | VP1 | A0206 |
| 233 | VLHVTNTATTV | 0.435 | 450 | WB | VP1 | A0206 |
| 303 | FLLSDLINRRT | 0.433 | 462 | WB | VP1 | A0206 |
| 243 | VLLDEQGVGPL | 0.906 | 2 | SB | VP1 | A0211 |
| 233 | VLHVTNTATTV | 0.899 | 2 | SB | VP1 | A0211 |
| 125 | MLNLHAGSQKV | 0.897 | 3 | SB | VP1 | A0211 |
| 83 | KMLPCYSTARI | 0.831 | 6 | SB | VP1 | A0211 |
| 27 | LIKGGVEVLEV | 0.813 | 7 | SB | VP1 | A0211 |
| 323 | GMESQVEEVRV | 0.770 | 12 | SB | VP1 | A0211 |
| 244 | LLDEQGVGPLC | 0.735 | 17 | SB | VP1 | A0211 |
| 61 | NLRGYSQHLSA | 0.703 | 24 | SB | VP1 | A0211 |
| 304 | LLSDLINRRTQ | 0.696 | 26 | SB | VP1 | A0211 |
| 25 | KLLIKGGVEVL | 0.681 | 31 | SB | VP1 | A0211 |
| 134 | KVHENGGGKPV | 0.674 | 34 | SB | VP1 | A0211 |
| 97 | NLNEDLTCGNL | 0.669 | 35 | SB | VP1 | A0211 |
| 195 | AYLDKNNAYPV | 0.636 | 51 | WB | VP1 | A0211 |
| 303 | FLLSDLINRRT | 0.612 | 66 | WB | VP1 | A0211 |
| 164 | VLMNYRTKYPQ | 0.607 | 70 | WB | VP1 | A0211 |
| 223 | TYTGGENVPPV | 0.585 | 89 | WB | VP1 | A0211 |
| 196 | YLDKNNAYPVE | 0.560 | 116 | WB | VP1 | A0211 |
| 107 | LLMWEAVTVKT | 0.551 | 128 | WB | VP1 | A0211 |
| 235 | HVTNTATTVLL | 0.525 | 171 | WB | VP1 | A0211 |
| 22 | QVPKLLIKGGV | 0.523 | 174 | WB | VP1 | A0211 |
| 268 | GLFTNSSGTQQ | 0.506 | 209 | WB | VP1 | A0211 |
| 339 | QLPGDPDMIRY | 0.501 | 222 | WB | VP1 | A0211 |
| 144 | VQGSNFHFFAV | 0.500 | 224 | WB | VP1 | A0211 |
| 187 | QVMNTDHKAYL | 0.499 | 225 | WB | VP1 | A0211 |
| 11 | GAAPKKPKEPV | 0.474 | 297 | WB | VP1 | A0211 |
| 224 | YTGGENVPPVL | 0.472 | 302 | WB | VP1 | A0211 |
| 160 | EMQGVLMNYRT | 0.468 | 317 | WB | VP1 | A0211 |
| 349 | YIDRQGQLQTK | 0.450 | 385 | WB | VP1 | A0211 |
| 240 | ATTVLLDEQGV | 0.437 | 443 | WB | VP1 | A0211 |
| 233 | VLHVTNTATTV | 0.838 | 5 | SB | VP1 | A0212 |
| 243 | VLLDEQGVGPL | 0.823 | 6 | SB | VP1 | A0212 |
| 125 | MLNLHAGSQKV | 0.813 | 7 | SB | VP1 | A0212 |
| 323 | GMESQVEEVRV | 0.713 | 22 | SB | VP1 | A0212 |
| 27 | LIKGGVEVLEV | 0.697 | 26 | SB | VP1 | A0212 |
| 61 | NLRGYSQHLSA | 0.690 | 28 | SB | VP1 | A0212 |
| 144 | VQGSNFHFFAV | 0.652 | 42 | SB | VP1 | A0212 |
| 244 | LLDEQGVGPLC | 0.645 | 46 | SB | VP1 | A0212 |
| 304 | LLSDLINRRTQ | 0.599 | 76 | WB | VP1 | A0212 |
| 83 | KMLPCYSTARI | 0.596 | 79 | WB | VP1 | A0212 |
| 164 | VLMNYRTKYPQ | 0.576 | 98 | WB | VP1 | A0212 |
| 196 | YLDKNNAYPVE | 0.569 | 106 | WB | VP1 | A0212 |
| 303 | FLLSDLINRRT | 0.561 | 115 | WB | VP1 | A0212 |

TABLE K-continued

Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 224 | YTGGENVPPVL | 0.543 | 140 | WB | VP1 | A0212 |
| 25 | KLLIKGGVEVL | 0.530 | 161 | WB | VP1 | A0212 |
| 107 | LLMWEAVTVKT | 0.511 | 199 | WB | VP1 | A0212 |
| 97 | NLNEDLTCGNL | 0.491 | 247 | WB | VP1 | A0212 |
| 195 | AYLDKNNAYPV | 0.490 | 249 | WB | VP1 | A0212 |
| 349 | YIDRQGQLQTK | 0.465 | 325 | WB | VP1 | A0212 |
| 154 | VGGDPLEMQGV | 0.464 | 329 | WB | VP1 | A0212 |
| 160 | EMQGVLMNYRT | 0.460 | 345 | WB | VP1 | A0212 |
| 108 | LMWEAVTVKTE | 0.438 | 434 | WB | VP1 | A0212 |
| 233 | VLHVTNTATTV | 0.865 | 4 | SB | VP1 | A0216 |
| 125 | MLNLHAGSQKV | 0.827 | 6 | SB | VP1 | A0216 |
| 323 | GMESQVEEVRV | 0.804 | 8 | SB | VP1 | A0216 |
| 27 | LIKGGVEVLEV | 0.752 | 14 | SB | VP1 | A0216 |
| 243 | VLLDEQGVGPL | 0.724 | 19 | SB | VP1 | A0216 |
| 83 | KMLPCYSTARI | 0.660 | 39 | SB | VP1 | A0216 |
| 61 | NLRGYSQHLSA | 0.647 | 45 | SB | VP1 | A0216 |
| 187 | QVMNTDHKAYL | 0.643 | 47 | SB | VP1 | A0216 |
| 164 | VLMNYRTKYPQ | 0.619 | 61 | WB | VP1 | A0216 |
| 195 | AYLDKNNAYPV | 0.616 | 64 | WB | VP1 | A0216 |
| 11 | GAAPKKPKEPV | 0.542 | 142 | WB | VP1 | A0216 |
| 294 | SVKNPYPISFL | 0.530 | 162 | WB | VP1 | A0216 |
| 318 | GQPMYGMESQV | 0.525 | 170 | WB | VP1 | A0216 |
| 25 | KLLIKGGVEVL | 0.517 | 186 | WB | VP1 | A0216 |
| 223 | TYTGGENVPPV | 0.512 | 196 | WB | VP1 | A0216 |
| 268 | GLFTNSSGTQQ | 0.495 | 236 | WB | VP1 | A0216 |
| 97 | NLNEDLTCGNL | 0.481 | 274 | WB | VP1 | A0216 |
| 22 | QVPKLLIKGGV | 0.478 | 284 | WB | VP1 | A0216 |
| 304 | LLSDLINRRTQ | 0.474 | 295 | WB | VP1 | A0216 |
| 160 | EMQGVLMNYRT | 0.464 | 329 | WB | VP1 | A0216 |
| 31 | GVEVLEVKTGV | 0.459 | 348 | WB | VP1 | A0216 |
| 144 | VQGSNFHFFAV | 0.456 | 361 | WB | VP1 | A0216 |
| 235 | HVTNTATTVLL | 0.454 | 368 | WB | VP1 | A0216 |
| 303 | FLLSDLINRRT | 0.453 | 372 | WB | VP1 | A0216 |
| 249 | GVGPLCKADSL | 0.450 | 383 | WB | VP1 | A0216 |
| 220 | YFGTYTGGENV | 0.447 | 394 | WB | VP1 | A0216 |
| 37 | VKTGVDAITEV | 0.439 | 433 | WB | VP1 | A0216 |
| 134 | KVHENGGGKPV | 0.434 | 454 | WB | VP1 | A0216 |
| 233 | VLHVTNTATTV | 0.703 | 24 | SB | VP1 | A0219 |
| 125 | MLNLHAGSQKV | 0.697 | 26 | SB | VP1 | A0219 |
| 243 | VLLDEQGVGPL | 0.673 | 34 | SB | VP1 | A0219 |
| 27 | LIKGGVEVLEV | 0.581 | 93 | WB | VP1 | A0219 |
| 144 | VQGSNFHFFAV | 0.546 | 135 | WB | VP1 | A0219 |
| 323 | GMESQVEEVRV | 0.511 | 198 | WB | VP1 | A0219 |
| 83 | KMLPCYSTARI | 0.501 | 221 | WB | VP1 | A0219 |
| 223 | TYTGGENVPPV | 0.457 | 357 | WB | VP1 | A0219 |
| 154 | VGGDPLEMQGV | 0.443 | 413 | WB | VP1 | A0219 |
| 224 | YTGGENVPPVL | 0.428 | 485 | WB | VP1 | A0219 |
| 124 | SMLNLHAGSQK | 0.698 | 26 | SB | VP1 | A0301 |
| 289 | RLRKRSVKNPY | 0.560 | 117 | WB | VP1 | A0301 |
| 281 | GLARYFKIRLR | 0.520 | 180 | WB | VP1 | A0301 |
| 106 | NLLMWEAVTVK | 0.478 | 285 | WB | VP1 | A0301 |
| 270 | FTNSSGTQQWR | 0.447 | 395 | WB | VP1 | A0301 |
| 124 | SMLNLHAGSQK | 0.754 | 14 | SB | VP1 | A1101 |
| 184 | AQSQVMNTDHK | 0.640 | 49 | SB | VP1 | A1101 |
| 301 | ISFLLSDLINR | 0.631 | 54 | WB | VP1 | A1101 |
| 277 | QQWRGLARYFK | 0.573 | 101 | WB | VP1 | A1101 |
| 73 | NAFESDSPDRK | 0.538 | 148 | WB | VP1 | A1101 |
| 275 | GTQQWRGLARY | 0.477 | 288 | WB | VP1 | A1101 |
| 106 | NLLMWEAVTVK | 0.462 | 336 | WB | VP1 | A1101 |
| 161 | MQGVLMNYRTK | 0.448 | 390 | WB | VP1 | A1101 |
| 312 | RTQKVDGQPMY | 0.441 | 421 | WB | VP1 | A1101 |
| 282 | LARYFKIRLRK | 0.432 | 467 | WB | VP1 | A1101 |
| 305 | LSDLINRRTQK | 0.431 | 473 | WB | VP1 | A1101 |
| 259 | LYVSAADICGL | 0.573 | 102 | WB | VP1 | A2301 |
| 298 | PYPISFLLSDL | 0.474 | 295 | WB | VP1 | A2301 |
| 298 | PYPISFLLSDL | 0.564 | 111 | WB | VP1 | A2402 |
| 167 | NYRTKYPQGTI | 0.552 | 128 | WB | VP1 | A2402 |
| 278 | QWRGLARYFKI | 0.438 | 439 | WB | VP1 | A2402 |
| 65 | YSQHLSAENAF | 0.655 | 41 | SB | VP1 | A2403 |
| 298 | PYPISFLLSDL | 0.628 | 56 | WB | VP1 | A2403 |
| 259 | LYVSAADICGL | 0.536 | 151 | WB | VP1 | A2403 |
| 269 | LFTNSSGTQQW | 0.434 | 458 | WB | VP1 | A2403 |
| 118 | EVIGITSMLNL | 0.705 | 24 | SB | VP1 | A2601 |
| 78 | DSPDRKMLPCY | 0.602 | 74 | WB | VP1 | A2601 |
| 118 | EVIGITSMLNL | 0.894 | 3 | SB | VP1 | A2602 |
| 294 | SVKNPYPISFL | 0.778 | 11 | SB | VP1 | A2602 |
| 78 | DSPDRKMLPCY | 0.715 | 21 | SB | VP1 | A2602 |
| 260 | YVSAADICGLF | 0.691 | 28 | SB | VP1 | A2602 |
| 339 | QLPGDPDMIRY | 0.669 | 35 | SB | VP1 | A2602 |
| 187 | QVMNTDHKAYL | 0.618 | 62 | WB | VP1 | A2602 |
| 275 | GTQQWRGLARY | 0.593 | 81 | WB | VP1 | A2602 |
| 312 | RTQKVDGQPMY | 0.482 | 273 | WB | VP1 | A2602 |
| 289 | RLRKRSVKNPY | 0.805 | 8 | SB | VP1 | A3001 |
| 282 | LARYFKIRLRK | 0.787 | 10 | SB | VP1 | A3001 |
| 6 | KGECPGAAPKK | 0.656 | 41 | SB | VP1 | A3001 |
| 134 | KVHENGGGKPV | 0.525 | 169 | WB | VP1 | A3001 |
| 132 | SQKVHENGGGK | 0.508 | 205 | WB | VP1 | A3001 |
| 312 | RTQKVDGQPMY | 0.498 | 227 | WB | VP1 | A3001 |
| 277 | QQWRGLARYFK | 0.477 | 286 | WB | VP1 | A3001 |
| 161 | MQGVLMNYRTK | 0.455 | 362 | WB | VP1 | A3001 |
| 291 | RKRSVKNPYPI | 0.432 | 468 | WB | VP1 | A3001 |
| 312 | RTQKVDGQPMY | 0.474 | 295 | WB | VP1 | A3002 |
| 277 | QQWRGLARYFK | 0.695 | 27 | SB | VP1 | A3101 |
| 301 | ISFLLSDLINR | 0.646 | 46 | SB | VP1 | A3101 |
| 302 | SFLLSDLINRR | 0.634 | 52 | WB | VP1 | A3101 |
| 270 | FTNSSGTQQWR | 0.615 | 64 | WB | VP1 | A3101 |
| 124 | SMLNLHAGSQK | 0.602 | 74 | WB | VP1 | A3101 |
| 281 | GLARYFKIRLR | 0.598 | 77 | WB | VP1 | A3101 |
| 282 | LARYFKIRLRK | 0.457 | 355 | WB | VP1 | A3101 |
| 161 | MQGVLMNYRTK | 0.453 | 371 | WB | VP1 | A3101 |
| 82 | RKMLPCYSTAR | 0.428 | 486 | WB | VP1 | A3101 |
| 301 | ISFLLSDLINR | 0.516 | 187 | WB | VP1 | A3301 |
| 302 | SFLLSDLINRR | 0.486 | 259 | WB | VP1 | A3301 |
| 270 | FTNSSGTQQWR | 0.792 | 9 | SB | VP1 | A6801 |
| 301 | ISFLLSDLINR | 0.717 | 21 | SB | VP1 | A6801 |
| 73 | NAFESDSPDRK | 0.709 | 23 | SB | VP1 | A6801 |
| 72 | ENAFESDSPDR | 0.595 | 80 | WB | VP1 | A6801 |
| 322 | YGMESQVEEVR | 0.478 | 284 | WB | VP1 | A6801 |
| 282 | LARYFKIRLRK | 0.478 | 284 | WB | VP1 | A6801 |
| 118 | EVIGITSMLNL | 0.811 | 7 | SB | VP1 | A6802 |
| 187 | QVMNTDHKAYL | 0.666 | 36 | SB | VP1 | A6802 |
| 22 | QVPKLLIKGGV | 0.649 | 44 | SB | VP1 | A6802 |
| 235 | HVTNTATTVLL | 0.487 | 257 | WB | VP1 | A6802 |
| 330 | EVRVFDGTEQL | 0.471 | 306 | WB | VP1 | A6802 |
| 103 | TCGNLLMWEAV | 0.457 | 354 | WB | VP1 | A6802 |
| 118 | EVIGITSMLNL | 0.681 | 31 | SB | VP1 | A6901 |
| 33 | EVLEVKTGVDA | 0.574 | 99 | WB | VP1 | A6901 |
| 187 | QVMNTDHKAYL | 0.533 | 155 | WB | VP1 | A6901 |

TABLE K-continued

Prediction of BK virus VP1 protein specific MHC class1, 8-, 9-, 10-, 11-mer peptide binders for 42 MHC class 1 alleles (see FIG. 11) using the //www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 99 | YPISFLLSDLI | 0.456 | 361 | WB | VP1 | A6901 |
| 224 | YTGGENVPPVL | 0.454 | 366 | WB | VP1 | A6901 |
| 235 | HVTNTATTVLL | 0.449 | 389 | WB | VP1 | A6901 |
| 85 | LPCYSTARIPL | 0.805 | 8 | SB | VP1 | B0702 |
| 142 | KPVQGSNFHFF | 0.686 | 29 | SB | VP1 | B0702 |
| 13 | APKKPKEPVQV | 0.564 | 112 | WB | VP1 | B0702 |
| 1 | APTKRKGECPG | 0.493 | 242 | WB | VP1 | B0702 |
| 16 | KPKEPVQVPKL | 0.491 | 245 | WB | VP1 | B0702 |
| 178 | TPKNPTAQSQV | 0.486 | 259 | WB | VP1 | B0702 |
| 299 | YPISFLLSDLI | 0.435 | 452 | WB | VP1 | B0702 |
| 285 | YFKIRLRKRSV | 0.492 | 244 | WB | VP1 | B0801 |
| 276 | TQQWRGLARYF | 0.585 | 89 | WB | VP1 | B1501 |
| 289 | RLRKRSVKNPY | 0.578 | 96 | WB | VP1 | B1501 |
| 186 | SQVMNTDHKAY | 0.565 | 110 | WB | VP1 | B1501 |
| 65 | YSQHLSAENAF | 0.559 | 118 | WB | VP1 | B1501 |
| 60 | YVSAADICGLF | 0.550 | 130 | WB | VP1 | B1501 |
| 312 | RTQKVDGQPMY | 0.427 | 492 | WB | VP1 | B1501 |
| 324 | MESQVEEVRVF | 0.678 | 32 | SB | VP1 | B1801 |
| 45 | TEVECFLNPEM | 0.554 | 124 | WB | VP1 | B1801 |
| 75 | FESDSPDRKML | 0.525 | 171 | WB | VP1 | B1801 |
| 110 | WEAVTVKTEVI | 0.483 | 267 | WB | VP1 | B1801 |
| 311 | RRTQKVDGQPM | 0.521 | 177 | WB | VP1 | B2705 |
| 277 | QQWRGLARYFK | 0.429 | 480 | WB | VP1 | B2705 |
| 142 | KPVQGSNFHFF | 0.739 | 16 | SB | VP1 | B3501 |
| 203 | YPVECWIPDPS | 0.712 | 22 | SB | VP1 | B3501 |
| 85 | LPCYSTARIPL | 0.676 | 33 | SB | VP1 | B3501 |
| 211 | DPSRNENTRYF | 0.625 | 57 | WB | VP1 | B3501 |
| 65 | YSQHLSAENAF | 0.609 | 68 | WB | VP1 | B3501 |
| 151 | FFAVGGDPLEM | 0.579 | 95 | WB | VP1 | B3501 |
| 260 | YVSAADICGLF | 0.578 | 96 | WB | VP1 | B3501 |
| 299 | YPISFLLSDLI | 0.498 | 227 | WB | VP1 | B3501 |
| 52 | NPEMGDPDDNL | 0.470 | 310 | WB | VP1 | B3501 |
| 193 | HKAYLDKNNAY | 0.461 | 342 | WB | VP1 | B3501 |
| 149 | FHFFAVGGDPL | 0.586 | 88 | WB | VP1 | B3901 |
| 234 | LHVTNTATTVL | 0.579 | 94 | WB | VP1 | B3901 |
| 224 | YTGGENVPPVL | 0.498 | 227 | WB | VP1 | B3901 |
| 75 | FESDSPDRKML | 0.556 | 121 | WB | VP1 | B4001 |
| 45 | TEVECFLNPEM | 0.446 | 402 | WB | VP1 | B4001 |
| 45 | TEVECFLNPEM | 0.451 | 379 | WB | VP1 | B4002 |
| 45 | TEVECFLNPEM | 0.477 | 287 | WB | VP1 | B4403 |
| 71 | AENAFESDSPD | 0.487 | 257 | WB | VP1 | B4501 |
| 299 | YPISFLLSDLI | 0.706 | 24 | SB | VP1 | B5101 |
| 340 | LPGDPDMIRYI | 0.600 | 75 | WB | VP1 | B5101 |
| 30 | VPPVLHVTNTA | 0.508 | 206 | WB | VP1 | B5101 |
| 85 | LPCYSTARIPL | 0.492 | 243 | WB | VP1 | B5101 |
| 299 | YPISFLLSDLI | 0.735 | 17 | SB | VP1 | B5301 |
| 340 | LPGDPDMIRYI | 0.564 | 112 | WB | VP1 | B5301 |
| 142 | KPVQGSNFHFF | 0.534 | 154 | WB | VP1 | B5301 |
| 85 | LPCYSTARIPL | 0.434 | 455 | WB | VP1 | B5301 |
| 299 | YPISFLLSDLI | 0.778 | 11 | SB | VP1 | B5401 |
| 230 | VPPVLHVTNTA | 0.720 | 20 | SB | VP1 | B5401 |
| 203 | YPVECWIPDPS | 0.657 | 40 | SB | VP1 | B5401 |
| 93 | IPLPNLNEDLT | 0.542 | 142 | WB | VP1 | B5401 |
| 85 | LPCYSTARIPL | 0.510 | 200 | WB | VP1 | B5401 |
| 340 | LPGDPDMIRYI | 0.458 | 350 | WB | VP1 | B5401 |
| 293 | RSVKNPYPISF | 0.691 | 28 | SB | VP1 | B5801 |

SEQ ID NOS.: 53780-54917

Preferred BK virus fragments of small T antigen capable of interacting with one or more MHC class 1 molecules are listed in Table L.

TABLE L

Prediction of BK virus small t protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 8-mers | | | | | | |
| 124 | FLRKEPLV | 0.663 | 38 | SB | Small t | A0201 |
| 11 | ELMDLLGL | 0.599 | 76 | WB | Small t | A0201 |
| 153 | TLQWWVQI | 0.543 | 141 | WB | Small t | A0201 |
| 74 | GTWNSSEV | 0.542 | 141 | WB | Small t | A0201 |
| 154 | LQWWVQII | 0.520 | 179 | WB | Small t | A0201 |
| 110 | CMLCQLRL | 0.509 | 202 | WB | Small t | A0201 |
| 21 | AAWGNLPL | 0.473 | 297 | WB | Small t | A0201 |
| 60 | KMEQDVKV | 0.452 | 375 | WB | Small t | A0201 |
| 11 | ELMDLLGL | 0.762 | 13 | SB | Small t | A0202 |
| 124 | FLRKEPLV | 0.715 | 21 | SB | Small t | A0202 |
| 9 | SMELMDLL | 0.628 | 56 | WB | Small t | A0202 |
| 50 | KMKRMNTL | 0.586 | 88 | WB | Small t | A0202 |
| 60 | KMEQDVKV | 0.505 | 211 | WB | Small t | A0202 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 27 | PLMRKAYL | 0.488 | 254 | WB | Small t | A0202 |
| 110 | CMLCQLRL | 0.475 | 292 | WB | Small t | A0202 |
| 124 | FLRKEPLV | 0.863 | 4 | SB | Small t | A0203 |
| 50 | KMKRMNTL | 0.758 | 13 | SB | Small t | A0203 |
| 11 | ELMDLLGL | 0.712 | 22 | SB | Small t | A0203 |
| 153 | TLQWWVQI | 0.690 | 28 | SB | Small t | A0203 |
| 110 | CMLCQLRL | 0.515 | 189 | WB | Small t | A0203 |
| 105 | SVHCPCML | 0.430 | 474 | WB | Small t | A0203 |
| 60 | KMEQDVKV | 0.429 | 484 | WB | Small t | A0203 |
| 60 | KMEQDVKV | 0.615 | 64 | WB | Small t | A0204 |
| 124 | FLRKEPLV | 0.573 | 100 | WB | Small t | A0204 |
| 153 | TLQWWVQI | 0.524 | 172 | WB | Small t | A0204 |
| 11 | ELMDLLGL | 0.521 | 178 | WB | Small t | A0204 |
| 50 | KMKRMNTL | 0.443 | 412 | WB | Small t | A0204 |
| 154 | LQWWVQII | 0.679 | 32 | SB | Small t | A0206 |
| 74 | GTWNSSEV | 0.645 | 46 | SB | Small t | A0206 |
| 11 | ELMDLLGL | 0.594 | 80 | WB | Small t | A0206 |
| 124 | FLRKEPLV | 0.581 | 92 | WB | Small t | A0206 |
| 21 | AAWGNLPL | 0.571 | 104 | WB | Small t | A0206 |
| 110 | CMLCQLRL | 0.496 | 233 | WB | Small t | A0206 |
| 142 | TQWFGLDL | 0.494 | 239 | WB | Small t | A0206 |
| 153 | TLQWWVQI | 0.468 | 315 | WB | Small t | A0206 |
| 60 | KMEQDVKV | 0.427 | 490 | WB | Small t | A0206 |
| 11 | ELMDLLGL | 0.904 | 2 | SB | Small t | A0211 |
| 124 | FLRKEPLV | 0.865 | 4 | SB | Small t | A0211 |
| 153 | TLQWWVQI | 0.861 | 4 | SB | Small t | A0211 |
| 60 | KMEQDVKV | 0.845 | 5 | SB | Small t | A0211 |
| 14 | DLLGLERA | 0.725 | 19 | SB | Small t | A0211 |
| 74 | GTWNSSEV | 0.720 | 20 | SB | Small t | A0211 |
| 110 | CMLCQLRL | 0.666 | 37 | SB | Small t | A0211 |
| 27 | PLMRKAYL | 0.666 | 37 | SB | Small t | A0211 |
| 21 | AAWGNLPL | 0.638 | 50 | WB | Small t | A0211 |
| 9 | SMELMDLL | 0.635 | 51 | WB | Small t | A0211 |
| 56 | TLYKKMEQ | 0.625 | 57 | WB | Small t | A0211 |
| 50 | KMKRMNTL | 0.582 | 92 | WB | Small t | A0211 |
| 146 | GLDLTEET | 0.563 | 113 | WB | Small t | A0211 |
| 3 | VLNREESM | 0.494 | 239 | WB | Small t | A0211 |
| 105 | SVHCPCML | 0.430 | 474 | WB | Small t | A0211 |
| 148 | DLTEETLQ | 0.428 | 487 | WB | Small t | A0211 |
| 124 | FLRKEPLV | 0.884 | 3 | SB | Small t | A0212 |
| 11 | ELMDLLGL | 0.842 | 5 | SB | Small t | A0212 |
| 153 | TLQWWVQI | 0.692 | 28 | SB | Small t | A0212 |
| 60 | KMEQDVKV | 0.666 | 37 | SB | Small t | A0212 |
| 3 | VLNREESM | 0.639 | 49 | SB | Small t | A0212 |
| 27 | PLMRKAYL | 0.597 | 78 | WB | Small t | A0212 |
| 110 | CMLCQLRL | 0.580 | 94 | WB | Small t | A0212 |
| 50 | KMKRMNTL | 0.579 | 94 | WB | Small t | A0212 |
| 14 | DLLGLERA | 0.523 | 174 | WB | Small t | A0212 |
| 74 | GTWNSSEV | 0.521 | 178 | WB | Small t | A0212 |
| 56 | TLYKKMEQ | 0.520 | 180 | WB | Small t | A0212 |
| 21 | AAWGNLPL | 0.511 | 197 | WB | Small t | A0212 |
| 9 | SMELMDLL | 0.426 | 495 | WB | Small t | A0212 |
| 124 | FLRKEPLV | 0.876 | 3 | SB | Small t | A0216 |
| 27 | PLMRKAYL | 0.829 | 6 | SB | Small t | A0216 |
| 11 | ELMDLLGL | 0.740 | 16 | SB | Small t | A0216 |
| 74 | GTWNSSEV | 0.734 | 17 | SB | Small t | A0216 |
| 60 | KMEQDVKV | 0.732 | 18 | SB | Small t | A0216 |
| 153 | TLQWWVQI | 0.684 | 30 | SB | Small t | A0216 |
| 56 | TLYKKMEQ | 0.662 | 38 | SB | Small t | A0216 |
| 50 | KMKRMNTL | 0.651 | 43 | SB | Small t | A0216 |
| 21 | AAWGNLPL | 0.600 | 75 | WB | Small t | A0216 |
| 110 | CMLCQLRL | 0.577 | 97 | WB | Small t | A0216 |
| 14 | DLLGLERA | 0.566 | 109 | WB | Small t | A0216 |
| 9 | SMELMDLL | 0.532 | 158 | WB | Small t | A0216 |
| 146 | GLDLTEET | 0.453 | 370 | WB | Small t | A0216 |
| 3 | VLNREESM | 0.429 | 482 | WB | Small t | A0216 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 11 | ELMDLLGL | 0.807 | 8 | SB | Small t | A0219 |
| 124 | FLRKEPLV | 0.736 | 17 | SB | Small t | A0219 |
| 21 | AAWGNLPL | 0.637 | 51 | WB | Small t | A0219 |
| 153 | TLQWWVQI | 0.608 | 69 | WB | Small t | A0219 |
| 27 | PLMRKAYL | 0.589 | 85 | WB | Small t | A0219 |
| 110 | CMLCQLRL | 0.548 | 133 | WB | Small t | A0219 |
| 74 | GTWNSSEV | 0.540 | 145 | WB | Small t | A0219 |
| 116 | RLRHLNRK | 0.728 | 19 | SB | Small t | A0301 |
| 53 | RMNTLYKK | 0.719 | 20 | SB | Small t | A0301 |
| 119 | HLNRKFLR | 0.676 | 33 | SB | Small t | A0301 |
| 28 | LMRKAYLK | 0.671 | 35 | SB | Small t | A0301 |
| 31 | KAYLKKCK | 0.506 | 210 | WB | Small t | A0301 |
| 53 | RMNTLYKK | 0.727 | 19 | SB | Small t | A1101 |
| 31 | KAYLKKCK | 0.639 | 49 | SB | Small t | A1101 |
| 52 | KRMNTLYK | 0.454 | 367 | WB | Small t | A1101 |
| 119 | HLNRKFLR | 0.443 | 415 | WB | Small t | A1101 |
| 160 | IIGETPFR | 0.438 | 436 | WB | Small t | A1101 |
| 28 | LMRKAYLK | 0.435 | 452 | WB | Small t | A1101 |
| 131 | VWIDCYCI | 0.479 | 280 | WB | Small t | A2301 |
| 92 | LYCKEWPI | 0.458 | 351 | WB | Small t | A2301 |
| 131 | VWIDCYCI | 0.675 | 33 | SB | Small t | A2402 |
| 92 | LYCKEWPI | 0.622 | 60 | WB | Small t | A2402 |
| 11 | ELMDLLGL | 0.486 | 259 | WB | Small t | A2601 |
| 159 | QIIGETPF | 0.823 | 6 | SB | Small t | A2602 |
| 80 | EVCADFPL | 0.594 | 80 | WB | Small t | A2602 |
| 66 | KVAHQPDF | 0.563 | 112 | WB | Small t | A2602 |
| 11 | ELMDLLGL | 0.500 | 224 | WB | Small t | A2602 |
| 86 | PLCPDTLY | 0.515 | 189 | WB | Small t | A2902 |
| 116 | RLRHLNRK | 0.810 | 7 | SB | Small t | A3001 |
| 28 | LMRKAYLK | 0.805 | 8 | SB | Small t | A3001 |
| 53 | RMNTLYKK | 0.672 | 34 | SB | Small t | A3001 |
| 31 | KAYLKKCK | 0.628 | 55 | WB | Small t | A3001 |
| 52 | KRMNTLYK | 0.620 | 60 | WB | Small t | A3001 |
| 29 | MRKAYLKK | 0.612 | 66 | WB | Small t | A3001 |
| 120 | LNRKFLRK | 0.571 | 104 | WB | Small t | A3001 |
| 119 | HLNRKFLR | 0.850 | 5 | SB | Small t | A3101 |
| 53 | RMNTLYKK | 0.816 | 7 | SB | Small t | A3101 |
| 111 | MLCQLRLR | 0.684 | 30 | SB | Small t | A3101 |
| 28 | LMRKAYLK | 0.646 | 46 | SB | Small t | A3101 |
| 116 | RLRHLNRK | 0.541 | 142 | WB | Small t | A3101 |
| 160 | IIGETPFR | 0.540 | 145 | WB | Small t | A3101 |
| 31 | KAYLKKCK | 0.504 | 214 | WB | Small t | A3101 |
| 119 | HLNRKFLR | 0.745 | 15 | SB | Small t | A3301 |
| 111 | MLCQLRLR | 0.521 | 177 | WB | Small t | A3301 |
| 160 | IIGETPFR | 0.469 | 313 | WB | Small t | A3301 |
| 163 | ETPFRDLK | 0.799 | 8 | SB | Small t | A6801 |
| 111 | MLCQLRLR | 0.725 | 19 | SB | Small t | A6801 |
| 119 | HLNRKFLR | 0.654 | 42 | SB | Small t | A6801 |
| 160 | IIGETPFR | 0.568 | 107 | WB | Small t | A6801 |
| 80 | EVCADFPL | 0.773 | 11 | SB | Small t | A6802 |
| 11 | ELMDLLGL | 0.583 | 90 | WB | Small t | A6802 |
| 8 | ESMELMDL | 0.563 | 113 | WB | Small t | A6802 |
| 105 | SVHCPCML | 0.510 | 200 | WB | Small t | A6802 |
| 19 | ERAAWGNL | 0.434 | 456 | WB | Small t | A6802 |
| 11 | ELMDLLGL | 0.667 | 36 | SB | Small t | A6901 |
| 80 | EVCADFPL | 0.549 | 131 | WB | Small t | A6901 |
| 74 | GTWNSSEV | 0.545 | 137 | WB | Small t | A6901 |
| 85 | FPLCPDTL | 0.537 | 150 | WB | Small t | A6901 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 21 | AAWGNLPL | 0.513 | 193 | WB | Small t | A6901 |
| 8 | ESMELMDL | 0.453 | 372 | WB | Small t | A6901 |
| 103 | KPSVHCPC | 0.540 | 145 | WB | Small t | B0702 |
| 21 | AAWGNLPL | 0.482 | 270 | WB | Small t | B0702 |
| 26 | LPLMRKAY | 0.431 | 472 | WB | Small t | B0702 |
| 50 | KMKRMNTL | 0.479 | 282 | WB | Small t | B0801 |
| 33 | YLKKCKEF | 0.446 | 401 | WB | Small t | B0801 |
| 159 | QIIGETPF | 0.529 | 163 | WB | Small t | B1501 |
| 33 | YLKKCKEF | 0.496 | 232 | WB | Small t | B1501 |
| 50 | KMKRMNTL | 0.474 | 294 | WB | Small t | B1501 |
| 52 | KRMNTLYK | 0.623 | 58 | WB | Small t | B2705 |
| 29 | MRKAYLKK | 0.430 | 477 | WB | Small t | B2705 |
| 26 | LPLMRKAY | 0.749 | 15 | SB | Small t | B3501 |
| 85 | FPLCPDTL | 0.706 | 24 | SB | Small t | B3501 |
| 21 | AAWGNLPL | 0.509 | 203 | WB | Small t | B3501 |
| 159 | QIIGETPF | 0.457 | 355 | WB | Small t | B3501 |
| 5 | NREESMEL | 0.555 | 123 | WB | Small t | B3901 |
| 162 | GETPFRDL | 0.607 | 69 | WB | Small t | B4001 |
| 6 | REESMELM | 0.511 | 197 | WB | Small t | B4001 |
| 6 | REESMELM | 0.433 | 463 | WB | Small t | B4002 |
| 151 | EETLQWWV | 0.428 | 488 | WB | Small t | B4002 |
| 150 | TEETLQWW | 0.443 | 414 | WB | Small t | B4402 |
| 151 | EETLQWWV | 0.426 | 497 | WB | Small t | B4403 |
| 151 | EETLQWWV | 0.447 | 397 | WB | Small t | B4501 |
| 85 | FPLCPDTL | 0.509 | 202 | WB | Small t | B5101 |
| 108 | CPCMLCQL | 0.480 | 276 | WB | Small t | B5101 |
| 26 | LPLMRKAY | 0.636 | 51 | WB | Small t | B5301 |
| 85 | FPLCPDTL | 0.559 | 117 | WB | Small t | B5301 |
| 26 | LPLMRKAY | 0.482 | 271 | WB | Small t | B5401 |
| 149 | LTEETLQW | 0.602 | 74 | WB | Small t | B5701 |
| 149 | LTEETLQW | 0.555 | 123 | WB | Small t | B5801 |
| 66 | KVAHQPDF | 0.491 | 246 | WB | Small t | B5801 |
| 16 | LGLERAAW | 0.439 | 430 | WB | Small t | B5801 |

9-mers

| pos | peptide | logscore | affinity (nM) | Bind Level | Protein Name | Allele |
|---|---|---|---|---|---|---|
| 91 | TLYCKEWPI | 0.629 | 55 | WB | Small t | A0201 |
| 153 | TLQWWVQII | 0.605 | 71 | WB | Small t | A0201 |
| 130 | LVWIDCYCI | 0.509 | 201 | WB | Small t | A0201 |
| 91 | TLYCKEWPI | 0.697 | 26 | SB | Small t | A0202 |
| 146 | GLDLTEETL | 0.429 | 483 | WB | Small t | A0202 |
| 153 | TLQWWVQII | 0.838 | 5 | SB | Small t | A0203 |
| 91 | TLYCKEWPI | 0.728 | 18 | SB | Small t | A0203 |
| 20 | RAAWGNLPL | 0.491 | 246 | WB | Small t | A0203 |
| 53 | RMNTLYKKM | 0.490 | 249 | WB | Small t | A0203 |
| 153 | TLQWWVQII | 0.535 | 152 | WB | Small t | A0204 |
| 91 | TLYCKEWPI | 0.525 | 170 | WB | Small t | A0204 |
| 59 | KKMEQDVKV | 0.514 | 191 | WB | Small t | A0204 |
| 158 | VQIIGETPF | 0.700 | 25 | SB | Small t | A0206 |
| 142 | TQWFGLDLT | 0.667 | 36 | SB | Small t | A0206 |
| 91 | TLYCKEWPI | 0.660 | 39 | SB | Small t | A0206 |
| 20 | RAAWGNLPL | 0.634 | 52 | WB | Small t | A0206 |
| 79 | SEVCADFPL | 0.515 | 189 | WB | Small t | A0206 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pospeptide | logscore | affinity (nM) | Bind Level | Protein Name | Allele |
|---|---|---|---|---|---|
| 10 MELMDLLGL | 0.496 | 233 | WB | Small t | A0206 |
| 21 AAWGNLPLM | 0.457 | 357 | WB | Small t | A0206 |
| 146 GLDLTEETL | 0.857 | 4 | SB | Small t | A0211 |
| 91 TLYCKEWPI | 0.856 | 4 | SB | Small t | A0211 |
| 153 TLQWWVQII | 0.797 | 8 | SB | Small t | A0211 |
| 20 RAAWGNLPL | 0.620 | 61 | WB | Small t | A0211 |
| 14 DLLGLERAA | 0.614 | 65 | WB | Small t | A0211 |
| 86 PLCPDTLYC | 0.564 | 111 | WB | Small t | A0211 |
| 130 LVWIDCYCI | 0.505 | 210 | WB | Small t | A0211 |
| 73 FGTWNSSEV | 0.481 | 274 | WB | Small t | A0211 |
| 21 AAWGNLPLM | 0.448 | 394 | WB | Small t | A0211 |
| 152 ETLQWWVQI | 0.445 | 404 | WB | Small t | A0211 |
| 98 PICSKKPSV | 0.436 | 448 | WB | Small t | A0211 |
| 129 PLVWIDCYC | 0.432 | 465 | WB | Small t | A0211 |
| 146 GLDLTEETL | 0.773 | 11 | SB | Small t | A0212 |
| 91 TLYCKEWPI | 0.751 | 14 | SB | Small t | A0212 |
| 153 TLQWWVQII | 0.666 | 37 | SB | Small t | A0212 |
| 14 DLLGLERAA | 0.548 | 133 | WB | Small t | A0212 |
| 141 FTQWFGLDL | 0.521 | 178 | WB | Small t | A0212 |
| 98 PICSKKPSV | 0.430 | 474 | WB | Small t | A0212 |
| 146 GLDLTEETL | 0.773 | 11 | SB | Small t | A0216 |
| 91 TLYCKEWPI | 0.720 | 20 | SB | Small t | A0216 |
| 98 PICSKKPSV | 0.617 | 62 | WB | Small t | A0216 |
| 153 TLQWWVQII | 0.518 | 184 | WB | Small t | A0216 |
| 129 PLVWIDCYC | 0.472 | 302 | WB | Small t | A0216 |
| 146 GLDLTEETL | 0.704 | 24 | SB | Small t | A0219 |
| 153 TLQWWVQII | 0.531 | 160 | WB | Small t | A0219 |
| 21 AAWGNLPLM | 0.506 | 209 | WB | Small t | A0219 |
| 91 TLYCKEWPI | 0.505 | 211 | WB | Small t | A0219 |
| 119 HLNRKFLRK | 0.834 | 6 | SB | Small t | A0301 |
| 28 LMRKAYLKK | 0.703 | 24 | SB | Small t | A0301 |
| 50 KMKRMNTLY | 0.654 | 42 | SB | Small t | A0301 |
| 27 PLMRKAYLK | 0.578 | 96 | WB | Small t | A0301 |
| 114 QLRLRHLNR | 0.447 | 397 | WB | Small t | A0301 |
| 119 HLNRKFLRK | 0.694 | 27 | SB | Small t | A1101 |
| 27 PLMRKAYLK | 0.576 | 98 | WB | Small t | A1101 |
| 159 QIIGETPFR | 0.516 | 187 | WB | Small t | A1101 |
| 32 AYLKKCKEF | 0.708 | 23 | SB | Small t | A2301 |
| 32 AYLKKCKEF | 0.523 | 174 | WB | Small t | A2402 |
| 32 AYLKKCKEF | 0.859 | 4 | SB | Small t | A2403 |
| 68 AHQPDFGTW | 0.542 | 142 | WB | Small t | A2403 |
| 8 ESMELMDLL | 0.463 | 335 | WB | Small t | A2601 |
| 163 ETPFRDLKL | 0.795 | 9 | SB | Small t | A2602 |
| 152 ETLQWWVQI | 0.499 | 225 | WB | Small t | A2602 |
| 8 ESMELMDLL | 0.476 | 290 | WB | Small t | A2602 |
| 50 KMKRMNTLY | 0.576 | 98 | WB | Small t | A2902 |
| 85 FPLCPDTLY | 0.475 | 291 | WB | Small t | A2902 |
| 28 LMRKAYLKK | 0.830 | 6 | SB | Small t | A3001 |
| 51 MKRMNTLYK | 0.827 | 6 | SB | Small t | A3001 |
| 36 KCKEFHPDK | 0.817 | 7 | SB | Small t | A3001 |
| 114 QLRLRHLNR | 0.516 | 187 | WB | Small t | A3001 |
| 50 KMKRMNTLY | 0.501 | 220 | WB | Small t | A3001 |
| 119 HLNRKFLRK | 0.445 | 405 | WB | Small t | A3001 |
| 27 PLMRKAYLK | 0.439 | 431 | WB | Small t | A3001 |
| 52 KRMNTLYKK | 0.435 | 453 | WB | Small t | A3001 |
| 50 KMKRMNTLY | 0.561 | 115 | WB | Small t | A3002 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 118 | RHLNRKFLR | 0.820 | 7 | SB | Small t | A3101 |
| 110 | CMLCQLRLR | 0.649 | 44 | SB | Small t | A3101 |
| 114 | QLRLRHLNR | 0.628 | 56 | WB | Small t | A3101 |
| 50 | KMKRMNTLY | 0.540 | 144 | WB | Small t | A3101 |
| 119 | HLNRKFLRK | 0.514 | 191 | WB | Small t | A3101 |
| 28 | LMRKAYLKK | 0.436 | 447 | WB | Small t | A3101 |
| 114 | QLRLRHLNR | 0.699 | 25 | SB | Small t | A3301 |
| 159 | QIIGETPFR | 0.822 | 6 | SB | Small t | A6801 |
| 108 | CPCMLCQLR | 0.553 | 125 | WB | Small t | A6801 |
| 8 | ESMELMDLL | 0.767 | 12 | SB | Small t | A6802 |
| 139 | DCFTQWFGL | 0.659 | 40 | SB | Small t | A6802 |
| 73 | FGTWNSSEV | 0.580 | 94 | WB | Small t | A6802 |
| 152 | ETLQWWVQI | 0.522 | 175 | WB | Small t | A6802 |
| 134 | DCYCIDCFT | 0.491 | 247 | WB | Small t | A6802 |
| 163 | ETPFRDLKL | 0.490 | 247 | WB | Small t | A6802 |
| 152 | ETLQWWVQI | 0.832 | 6 | SB | Small t | A6901 |
| 8 | ESMELMDLL | 0.609 | 68 | WB | Small t | A6901 |
| 91 | TLYCKEWPI | 0.506 | 210 | WB | Small t | A6901 |
| 130 | LVWIDCYCI | 0.492 | 244 | WB | Small t | A6901 |
| 21 | AAWGNLPLM | 0.483 | 267 | WB | Small t | A6901 |
| 20 | RAAWGNLPL | 0.721 | 20 | SB | Small t | B0702 |
| 26 | LPLMRKAYL | 0.719 | 20 | SB | Small t | B0702 |
| 103 | KPSVHCPCM | 0.431 | 472 | WB | Small t | B0702 |
| 158 | VQIIGETPF | 0.615 | 64 | WB | Small t | B1501 |
| 50 | KMKRMNTLY | 0.561 | 115 | WB | Small t | B1501 |
| 116 | RLRHLNRKF | 0.503 | 216 | WB | Small t | B1501 |
| 20 | RAAWGNLPL | 0.444 | 411 | WB | Small t | B1501 |
| 10 | MELMDLLGL | 0.722 | 20 | SB | Small t | B1801 |
| 150 | TEETLQWWV | 0.497 | 230 | WB | Small t | B1801 |
| 79 | SEVCADFPL | 0.470 | 308 | WB | Small t | B1801 |
| 52 | KRMNTLYKK | 0.656 | 41 | SB | Small t | B2705 |
| 85 | FPLCPDTLY | 0.805 | 8 | SB | Small t | B3501 |
| 128 | EPLVWIDCY | 0.750 | 14 | SB | Small t | B3501 |
| 20 | RAAWGNLPL | 0.618 | 62 | WB | Small t | B3501 |
| 21 | AAWGNLPLM | 0.545 | 137 | WB | Small t | B3501 |
| 103 | KPSVHCPCM | 0.451 | 377 | WB | Small t | B3501 |
| 10 | MELMDLLGL | 0.751 | 14 | SB | Small t | B4001 |
| 79 | SEVCADFPL | 0.738 | 16 | SB | Small t | B4001 |
| 7 | EESMELMDL | 0.561 | 115 | WB | Small t | B4001 |
| 18 | LERAAWGNL | 0.497 | 231 | WB | Small t | B4001 |
| 79 | SEVCADFPL | 0.455 | 365 | WB | Small t | B4002 |
| 79 | SEVCADFPL | 0.591 | 83 | WB | Small t | B4403 |
| 151 | EETLQWWVQ | 0.463 | 334 | WB | Small t | B4403 |
| 85 | FPLCPDTLY | 0.710 | 23 | SB | Small t | B5301 |
| 128 | EPLVWIDCY | 0.651 | 43 | SB | Small t | B5301 |
| 26 | LPLMRKAYL | 0.625 | 57 | WB | Small t | B5301 |
| 97 | WPICSKKPS | 0.548 | 132 | WB | Small t | B5401 |
| 149 | LTEETLQWW | 0.564 | 112 | WB | Small t | B5701 |
| 124 | FLRKEPLVW | 0.534 | 154 | WB | Small t | B5801 |
| 20 | RAAWGNLPL | 0.460 | 344 | WB | Small t | B5801 |

10-mers

| 124 | FLRKEPLVWI | 0.574 | 100 | WB | Small t | A0201 |
|---|---|---|---|---|---|---|
| 56 | TLYKKMEQDV | 0.485 | 263 | WB | Small t | A0201 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 12 | LMDLLGLERA | 0.456 | 361 | WB | Small t | A0201 |
| 3 | VLNREESMEL | 0.434 | 454 | WB | Small t | A0201 |
| 111 | MLCQLRLRHL | 0.647 | 45 | SB | Small t | A0202 |
| 124 | FLRKEPLVWI | 0.608 | 69 | WB | Small t | A0202 |
| 12 | LMDLLGLERA | 0.607 | 70 | WB | Small t | A0202 |
| 3 | VLNREESMEL | 0.562 | 114 | WB | Small t | A0202 |
| 56 | TLYKKMEQDV | 0.516 | 187 | WB | Small t | A0202 |
| 145 | FGLDLTEETL | 0.516 | 188 | WB | Small t | A0202 |
| 9 | SMELMDLLGL | 0.507 | 206 | WB | Small t | A0202 |
| 25 | NLPLMRKAYL | 0.483 | 269 | WB | Small t | A0202 |
| 124 | FLRKEPLVWI | 0.870 | 4 | SB | Small t | A0203 |
| 56 | TLYKKMEQDV | 0.707 | 23 | SB | Small t | A0203 |
| 3 | VLNREESMEL | 0.666 | 37 | SB | Small t | A0203 |
| 111 | MLCQLRLRHL | 0.549 | 131 | WB | Small t | A0203 |
| 12 | LMDLLGLERA | 0.468 | 314 | WB | Small t | A0203 |
| 9 | SMELMDLLGL | 0.462 | 338 | WB | Small t | A0203 |
| 116 | RLRHLNRKFL | 0.429 | 484 | WB | Small t | A0203 |
| 149 | LTEETLQWWV | 0.571 | 104 | WB | Small t | A0204 |
| 3 | VLNREESMEL | 0.557 | 120 | WB | Small t | A0204 |
| 124 | FLRKEPLVWI | 0.500 | 223 | WB | Small t | A0204 |
| 149 | LTEETLQWWV | 0.581 | 93 | WB | Small t | A0206 |
| 154 | LQWWVQIIGE | 0.521 | 177 | WB | Small t | A0206 |
| 20 | RAAWGNLPLM | 0.518 | 184 | WB | Small t | A0206 |
| 142 | TQWFGLDLTE | 0.463 | 334 | WB | Small t | A0206 |
| 124 | FLRKEPLVWI | 0.430 | 474 | WB | Small t | A0206 |
| 56 | TLYKKMEQDV | 0.875 | 3 | SB | Small t | A0211 |
| 3 | VLNREESMEL | 0.824 | 6 | SB | Small t | A0211 |
| 149 | LTEETLQWWV | 0.779 | 10 | SB | Small t | A0211 |
| 12 | LMDLLGLERA | 0.757 | 13 | SB | Small t | A0211 |
| 124 | FLRKEPLVWI | 0.715 | 21 | SB | Small t | A0211 |
| 9 | SMELMDLLGL | 0.706 | 24 | SB | Small t | A0211 |
| 111 | MLCQLRLRHL | 0.689 | 28 | SB | Small t | A0211 |
| 25 | NLPLMRKAYL | 0.682 | 31 | SB | Small t | A0211 |
| 129 | PLVWIDCYCI | 0.681 | 31 | SB | Small t | A0211 |
| 116 | RLRHLNRKFL | 0.554 | 124 | WB | Small t | A0211 |
| 146 | GLDLTEETLQ | 0.516 | 188 | WB | Small t | A0211 |
| 17 | GLERAAWGNL | 0.502 | 219 | WB | Small t | A0211 |
| 145 | FGLDLTEETL | 0.451 | 381 | WB | Small t | A0211 |
| 56 | TLYKKMEQDV | 0.893 | 3 | SB | Small t | A0212 |
| 3 | VLNREESMEL | 0.788 | 9 | SB | Small t | A0212 |
| 124 | FLRKEPLVWI | 0.756 | 13 | SB | Small t | A0212 |
| 149 | LTEETLQWWV | 0.727 | 19 | SB | Small t | A0212 |
| 12 | LMDLLGLERA | 0.604 | 72 | WB | Small t | A0212 |
| 111 | MLCQLRLRHL | 0.584 | 90 | WB | Small t | A0212 |
| 9 | SMELMDLLGL | 0.579 | 95 | WB | Small t | A0212 |
| 145 | FGLDLTEETL | 0.484 | 264 | WB | Small t | A0212 |
| 25 | NLPLMRKAYL | 0.477 | 287 | WB | Small t | A0212 |
| 116 | RLRHLNRKFL | 0.449 | 386 | WB | Small t | A0212 |
| 17 | GLERAAWGNL | 0.430 | 474 | WB | Small t | A0212 |
| 56 | TLYKKMEQDV | 0.842 | 5 | SB | Small t | A0216 |
| 3 | VLNREESMEL | 0.768 | 12 | SB | Small t | A0216 |
| 25 | NLPLMRKAYL | 0.703 | 24 | SB | Small t | A0216 |
| 124 | FLRKEPLVWI | 0.687 | 29 | SB | Small t | A0216 |
| 149 | LTEETLQWWV | 0.632 | 53 | WB | Small t | A0216 |
| 111 | MLCQLRLRHL | 0.627 | 56 | WB | Small t | A0216 |
| 116 | RLRHLNRKFL | 0.566 | 110 | WB | Small t | A0216 |
| 17 | GLERAAWGNL | 0.545 | 137 | WB | Small t | A0216 |
| 129 | PLVWIDCYCI | 0.522 | 175 | WB | Small t | A0216 |
| 12 | LMDLLGLERA | 0.484 | 265 | WB | Small t | A0216 |
| 9 | SMELMDLLGL | 0.468 | 316 | WB | Small t | A0216 |
| 149 | LTEETLQWWV | 0.627 | 56 | WB | Small t | A0219 |
| 3 | VLNREESMEL | 0.573 | 101 | WB | Small t | A0219 |
| 56 | TLYKKMEQDV | 0.570 | 104 | WB | Small t | A0219 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 124 | FLRKEPLVWI | 0.551 | 128 | WB | Small t | A0219 |
| 12 | LMDLLGLERA | 0.486 | 260 | WB | Small t | A0219 |
| 50 | KMKRMNTLYK | 0.754 | 14 | SB | Small t | A0301 |
| 118 | RHLNRKFLRK | 0.678 | 32 | SB | Small t | A0301 |
| 27 | PLMRKAYLKK | 0.663 | 38 | SB | Small t | A0301 |
| 114 | QLRLRHLNRK | 0.562 | 114 | WB | Small t | A0301 |
| 22 | AWGNLPLMRK | 0.533 | 156 | WB | Small t | A0301 |
| 26 | LPLMRKAYLK | 0.500 | 222 | WB | Small t | A0301 |
| 50 | KMKRMNTLYK | 0.700 | 25 | SB | Small t | A1101 |
| 27 | PLMRKAYLKK | 0.478 | 284 | WB | Small t | A1101 |
| 21 | AAWGNLPLMR | 0.475 | 293 | WB | Small t | A1101 |
| 22 | AWGNLPLMRK | 0.449 | 387 | WB | Small t | A1101 |
| 86 | PLCPDTLYCK | 0.444 | 410 | WB | Small t | A1101 |
| 135 | CYCIDCFTQW | 0.623 | 58 | WB | Small t | A2301 |
| 57 | LYKKMEQDVK | 0.531 | 160 | WB | Small t | A2301 |
| 136 | YCIDCFTQWF | 0.433 | 463 | WB | Small t | A2301 |
| 135 | CYCIDCFTQW | 0.616 | 63 | WB | Small t | A2403 |
| 123 | KFLRKEPLVW | 0.549 | 132 | WB | Small t | A2403 |
| 64 | DVKVAHQPDF | 0.665 | 37 | SB | Small t | A2602 |
| 152 | ETLQWWVQII | 0.483 | 269 | WB | Small t | A2602 |
| 84 | DFPLCPDTLY | 0.458 | 353 | WB | Small t | A2902 |
| 50 | KMKRMNTLYK | 0.848 | 5 | SB | Small t | A3001 |
| 114 | QLRLRHLNRK | 0.729 | 18 | SB | Small t | A3001 |
| 51 | MKRMNTLYKK | 0.685 | 30 | SB | Small t | A3001 |
| 27 | PLMRKAYLKK | 0.500 | 224 | WB | Small t | A3001 |
| 116 | RLRHLNRKFL | 0.497 | 231 | WB | Small t | A3001 |
| 29 | MRKAYLKKCK | 0.488 | 255 | WB | Small t | A3001 |
| 117 | LRHLNRKFLR | 0.676 | 33 | SB | Small t | A3101 |
| 113 | CQLRLRHLNR | 0.674 | 34 | SB | Small t | A3101 |
| 50 | KMKRMNTLYK | 0.640 | 49 | SB | Small t | A3101 |
| 51 | MKRMNTLYKK | 0.468 | 316 | WB | Small t | A3101 |
| 118 | RHLNRKFLRK | 0.446 | 400 | WB | Small t | A3101 |
| 11 | ELMDLLGLER | 0.512 | 196 | WB | Small t | A3301 |
| 117 | LRHLNRKFLR | 0.430 | 476 | WB | Small t | A3301 |
| 11 | ELMDLLGLER | 0.720 | 20 | SB | Small t | A6801 |
| 90 | DTLYCKEWPI | 0.574 | 99 | WB | Small t | A6802 |
| 152 | ETLQWWVQII | 0.456 | 358 | WB | Small t | A6802 |
| 19 | ERAAWGNLPL | 0.452 | 375 | WB | Small t | A6802 |
| 152 | ETLQWWVQII | 0.795 | 9 | SB | Small t | A6901 |
| 90 | DTLYCKEWPI | 0.586 | 88 | WB | Small t | A6901 |
| 149 | LTEETLQWWV | 0.575 | 98 | WB | Small t | A6901 |
| 97 | WPICSKKPSV | 0.518 | 184 | WB | Small t | A6901 |
| 103 | KPSVHCPCML | 0.703 | 24 | SB | Small t | B0702 |
| 97 | WPICSKKPSV | 0.563 | 113 | WB | Small t | B0702 |
| 116 | RLRHLNRKFL | 0.471 | 304 | WB | Small t | B0702 |
| 157 | WVQIIGETPF | 0.540 | 145 | WB | Small t | B1501 |
| 52 | KRMNTLYKKM | 0.591 | 83 | WB | Small t | B2705 |
| 157 | WVQIIGETPF | 0.638 | 50 | WB | Small t | B3501 |
| 20 | RAAWGNLPLM | 0.595 | 80 | WB | Small t | B3501 |
| 136 | YCIDCFTQWF | 0.429 | 483 | WB | Small t | B3501 |
| 19 | ERAAWGNLPL | 0.539 | 147 | WB | Small t | B3901 |
| 6 | REESMELMDL | 0.707 | 23 | SB | Small t | B4001 |
| 162 | GETPFRDLKL | 0.618 | 62 | WB | Small t | B4001 |
| 7 | EESMELMDLL | 0.488 | 253 | WB | Small t | B4001 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 7 | EESMELMDLL | 0.482 | 271 | WB | Small t | B4002 |
| 127 | KEPLVWIDCY | 0.429 | 481 | WB | Small t | B4402 |
| 151 | EETLQWWVQI | 0.495 | 235 | WB | Small t | B4403 |
| 127 | KEPLVWIDCY | 0.434 | 456 | WB | Small t | B4403 |
| 97 | WPICSKKPSV | 0.434 | 454 | WB | Small t | B5101 |
| 97 | WPICSKKPSV | 0.735 | 17 | SB | Small t | B5401 |
| 26 | LPLMRKAYLK | 0.511 | 197 | WB | Small t | B5401 |
| 67 | VAHQPDFGTW | 0.448 | 393 | WB | Small t | B5701 |
| 123 | KFLRKEPLVW | 0.620 | 60 | WB | Small t | B5801 |
| 67 | VAHQPDFGTW | 0.537 | 149 | WB | Small t | B5801 |
| 20 | RAAWGNLPLM | 0.485 | 263 | WB | Small t | B5801 |
| 31 | KAYLKKCKEF | 0.431 | 473 | WB | Small t | B5801 |
| | | | 11-mers | | | |
| 11 | ELMDLLGLERA | 0.458 | 351 | WB | Small t | A0201 |
| 2 | KVLNREESMEL | 0.432 | 467 | WB | Small t | A0201 |
| 11 | ELMDLLGLERA | 0.582 | 92 | WB | Small t | A0202 |
| 137 | CIDCFTQWFGL | 0.516 | 187 | WB | Small t | A0202 |
| 3 | VLNREESMELM | 0.491 | 245 | WB | Small t | A0202 |
| 148 | DLTEETLQWWV | 0.445 | 404 | WB | Small t | A0202 |
| 11 | ELMDLLGLERA | 0.652 | 42 | SB | Small t | A0203 |
| 110 | CMLCQLRLRHL | 0.520 | 180 | WB | Small t | A0203 |
| 3 | VLNREESMELM | 0.473 | 298 | WB | Small t | A0203 |
| 105 | SVHCPCMLCQL | 0.449 | 389 | WB | Small t | A0203 |
| 2 | KVLNREESMEL | 0.525 | 170 | WB | Small t | A0204 |
| 148 | DLTEETLQWWV | 0.453 | 372 | WB | Small t | A0204 |
| 105 | SVHCPCMLCQL | 0.450 | 384 | WB | Small t | A0204 |
| 2 | KVLNREESMEL | 0.620 | 61 | WB | Small t | A0206 |
| 154 | LQWWVQIIGET | 0.600 | 75 | WB | Small t | A0206 |
| 137 | CIDCFTQWFGL | 0.565 | 110 | WB | Small t | A0206 |
| 142 | TQWFGLDLTEE | 0.519 | 182 | WB | Small t | A0206 |
| 132 | WIDCYCIDCFT | 0.435 | 452 | WB | Small t | A0206 |
| 148 | DLTEETLQWWV | 0.957 | 1 | SB | Small t | A0211 |
| 11 | ELMDLLGLERA | 0.815 | 7 | SB | Small t | A0211 |
| 137 | CIDCFTQWFGL | 0.698 | 26 | SB | Small t | A0211 |
| 12 | LMDLLGLERAA | 0.669 | 35 | SB | Small t | A0211 |
| 2 | KVLNREESMEL | 0.597 | 77 | WB | Small t | A0211 |
| 105 | SVHCPCMLCQL | 0.539 | 146 | WB | Small t | A0211 |
| 3 | VLNREESMELM | 0.535 | 153 | WB | Small t | A0211 |
| 148 | DLTEETLQWWV | 0.806 | 8 | SB | Small t | A0212 |
| 11 | ELMDLLGLERA | 0.654 | 42 | SB | Small t | A0212 |
| 12 | LMDLLGLERAA | 0.577 | 96 | WB | Small t | A0212 |
| 137 | CIDCFTQWFGL | 0.551 | 128 | WB | Small t | A0212 |
| 3 | VLNREESMELM | 0.514 | 192 | WB | Small t | A0212 |
| 2 | KVLNREESMEL | 0.481 | 273 | WB | Small t | A0212 |
| 148 | DLTEETLQWWV | 0.886 | 3 | SB | Small t | A0216 |
| 11 | ELMDLLGLERA | 0.650 | 43 | SB | Small t | A0216 |
| 2 | KVLNREESMEL | 0.514 | 191 | WB | Small t | A0216 |
| 105 | SVHCPCMLCQL | 0.496 | 233 | WB | Small t | A0216 |
| 137 | CIDCFTQWFGL | 0.440 | 427 | WB | Small t | A0216 |
| 148 | DLTEETLQWWV | 0.849 | 5 | SB | Small t | A0219 |
| 11 | ELMDLLGLERA | 0.602 | 73 | WB | Small t | A0219 |
| 137 | CIDCFTQWFGL | 0.566 | 109 | WB | Small t | A0219 |
| 50 | KMKRMNTLYKK | 0.667 | 36 | SB | Small t | A0301 |
| 116 | RLRHLNRKFLR | 0.645 | 46 | SB | Small t | A0301 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 56 | TLYKKMEQDVK | 0.645 | 46 | SB | Small t | A0301 |
| 21 | AAWGNLPLMRK | 0.508 | 205 | WB | Small t | A0301 |
| 28 | LMRKAYLKKCK | 0.454 | 369 | WB | Small t | A0301 |
| 160 | IIGETPFRDLK | 0.432 | 464 | WB | Small t | A0301 |
| 21 | AAWGNLPLMRK | 0.742 | 16 | SB | Small t | A1101 |
| 56 | TLYKKMEQDVK | 0.640 | 49 | SB | Small t | A1101 |
| 50 | KMKRMNTLYKK | 0.634 | 52 | WB | Small t | A1101 |
| 160 | IIGETPFRDLK | 0.632 | 53 | WB | Small t | A1101 |
| 113 | CQLRLRHLNRK | 0.537 | 149 | WB | Small t | A1101 |
| 20 | RAAWGNLPLMR | 0.531 | 160 | WB | Small t | A1101 |
| 135 | CYCIDCFTQWF | 0.785 | 10 | SB | Small t | A2301 |
| 131 | VWIDCYCIDCF | 0.697 | 26 | SB | Small t | A2301 |
| 92 | LYCKEWPICSK | 0.544 | 139 | WB | Small t | A2301 |
| 156 | WWVQIIGETPF | 0.530 | 161 | WB | Small t | A2301 |
| 75 | TWNSSEVCADF | 0.493 | 240 | WB | Small t | A2301 |
| 131 | VWIDCYCIDCF | 0.708 | 23 | SB | Small t | A2402 |
| 135 | CYCIDCFTQWF | 0.672 | 34 | SB | Small t | A2402 |
| 156 | WWVQIIGETPF | 0.515 | 190 | WB | Small t | A2402 |
| 123 | KFLRKEPLVWI | 0.489 | 251 | WB | Small t | A2402 |
| 75 | TWNSSEVCADF | 0.462 | 339 | WB | Small t | A2402 |
| 135 | CYCIDCFTQWF | 0.775 | 11 | SB | Small t | A2403 |
| 123 | KFLRKEPLVWI | 0.525 | 170 | WB | Small t | A2403 |
| 75 | TWNSSEVCADF | 0.428 | 485 | WB | Small t | A2403 |
| 8 | ESMELMDLLGL | 0.474 | 297 | WB | Small t | A2601 |
| 159 | QIIGETPFRDL | 0.618 | 62 | WB | Small t | A2602 |
| 8 | ESMELMDLLGL | 0.433 | 462 | WB | Small t | A2602 |
| 50 | KMKRMNTLYKK | 0.760 | 13 | SB | Small t | A3001 |
| 28 | LMRKAYLKKCK | 0.745 | 15 | SB | Small t | A3001 |
| 116 | RLRHLNRKFLR | 0.667 | 36 | SB | Small t | A3001 |
| 117 | LRHLNRKFLRK | 0.531 | 160 | WB | Small t | A3001 |
| 34 | LKKCKEFHPDK | 0.429 | 482 | WB | Small t | A3001 |
| 116 | RLRHLNRKFLR | 0.853 | 4 | SB | Small t | A3101 |
| 50 | KMKRMNTLYKK | 0.838 | 5 | SB | Small t | A3101 |
| 20 | RAAWGNLPLMR | 0.617 | 63 | WB | Small t | A3101 |
| 157 | WVQIIGETPFR | 0.496 | 232 | WB | Small t | A3101 |
| 112 | LCQLRLRHLNR | 0.451 | 380 | WB | Small t | A3101 |
| 31 | KAYLKKCKEFH | 0.448 | 392 | WB | Small t | A3101 |
| 113 | CQLRLRHLNRK | 0.434 | 458 | WB | Small t | A3101 |
| 28 | LMRKAYLKKCK | 0.433 | 461 | WB | Small t | A3101 |
| 116 | RLRHLNRKFLR | 0.594 | 80 | WB | Small t | A3301 |
| 157 | WVQIIGETPFR | 0.716 | 21 | SB | Small t | A6801 |
| 20 | RAAWGNLPLMR | 0.562 | 114 | WB | Small t | A6801 |
| 56 | TLYKKMEQDVK | 0.549 | 131 | WB | Small t | A6801 |
| 25 | NLPLMRKAYLK | 0.482 | 272 | WB | Small t | A6801 |
| 108 | CPCMLCQLRLR | 0.467 | 319 | WB | Small t | A6801 |
| 8 | ESMELMDLLGL | 0.653 | 42 | SB | Small t | A6802 |
| 77 | NSSEVCADFPL | 0.649 | 44 | SB | Small t | A6802 |
| 11 | ELMDLLGLERA | 0.570 | 105 | WB | Small t | A6802 |
| 105 | SVHCPCMLCQL | 0.506 | 209 | WB | Small t | A6802 |
| 137 | CIDCFTQWFGL | 0.468 | 315 | WB | Small t | A6802 |
| 128 | EPLVWIDCYCI | 0.606 | 71 | WB | Small t | A6901 |
| 8 | ESMELMDLLGL | 0.560 | 116 | WB | Small t | A6901 |
| 11 | ELMDLLGLERA | 0.539 | 145 | WB | Small t | A6901 |
| 148 | DLTEETLQWWV | 0.482 | 273 | WB | Small t | A6901 |
| 55 | NTLYKKMEQDV | 0.432 | 464 | WB | Small t | A6901 |
| 114 | QLRLRHLNRKF | 0.463 | 333 | WB | Small t | B0801 |
| 114 | QLRLRHLNRKF | 0.473 | 298 | WB | Small t | B1501 |
| 18 | LERAAWGNLPL | 0.572 | 102 | WB | Small t | B1801 |

TABLE L-continued

Prediction of BK virus small t protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 41 | HPDKGGDEDKM | 0.545 | 136 | WB | Small t | B3501 |
| 97 | WPICSKKPSVH | 0.529 | 164 | WB | Small t | B3501 |
| 156 | WWVQIIGETPF | 0.482 | 270 | WB | Small t | B3501 |
| 6 | REESMELMDLL | 0.673 | 34 | SB | Small t | B4001 |
| 18 | LERAAWGNLPL | 0.630 | 54 | WB | Small t | B4001 |
| 47 | DEDKMKRMNTL | 0.434 | 458 | WB | Small t | B4001 |
| 6 | REESMELMDLL | 0.511 | 198 | WB | Small t | B4002 |
| 151 | EETLQWWVQII | 0.500 | 224 | WB | Small t | B4002 |
| 128 | EPLVWIDCYCI | 0.605 | 72 | WB | Small t | B5101 |
| 128 | EPLVWIDCYCI | 0.529 | 163 | WB | Small t | B5301 |
| 85 | FPLCPDTLYCK | 0.471 | 304 | WB | Small t | B5401 |
| 66 | KVAHQPDFGTW | 0.658 | 40 | SB | Small t | B5801 |
| 122 | RKFLRKEPLVW | 0.499 | 225 | WB | Small t | B5801 |

SEQ ID NOS.: 54918-55453

Preferred BK virus fragments of large T antigen capable of interacting with one or more MHC class 1 molecules are listed in Table M.

TABLE M

Prediction of BK virus Large T protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| | | | 8-mers | | | |
| 77 | NSSEVPTY | 0.514 | 193 | WB | Large T | A0101 |
| 611 | YTFSRMKY | 0.480 | 276 | WB | Large T | A0101 |
| 175 | KLMEKYSV | 0.847 | 5 | SB | Large T | A0201 |
| 388 | YMAGVAWL | 0.833 | 6 | SB | Large T | A0201 |
| 287 | FLLLGMYL | 0.807 | 8 | SB | Large T | A0201 |
| 501 | YLDGSVKV | 0.800 | 8 | SB | Large T | A0201 |
| 272 | KLITEYAV | 0.733 | 18 | SB | Large T | A0201 |
| 469 | YMVVFEDV | 0.711 | 22 | SB | Large T | A0201 |
| 579 | LLIWFRPV | 0.705 | 24 | SB | Large T | A0201 |
| 372 | KMDLIFGA | 0.695 | 27 | SB | Large T | A0201 |
| 155 | RTLACFAV | 0.663 | 38 | SB | Large T | A0201 |
| 293 | YLEFQYNV | 0.656 | 41 | SB | Large T | A0201 |
| 527 | VTMNEYPV | 0.629 | 55 | WB | Large T | A0201 |
| 563 | FLLEKRIL | 0.620 | 61 | WB | Large T | A0201 |
| 322 | FANAIIFA | 0.612 | 66 | WB | Large T | A0201 |
| 231 | YLLYSALT | 0.611 | 67 | WB | Large T | A0201 |
| 557 | SLQNSEFL | 0.608 | 69 | WB | Large T | A0201 |
| 11 | ELMDLLGL | 0.599 | 76 | WB | Large T | A0201 |
| 215 | KLCTFSFL | 0.590 | 84 | WB | Large T | A0201 |
| 457 | RLTFELGV | 0.587 | 86 | WB | Large T | A0201 |
| 398 | LLPKMDSV | 0.582 | 91 | WB | Large T | A0201 |
| 465 | AIDQYMVV | 0.565 | 111 | WB | Large T | A0201 |
| 369 | ILDKMDLI | 0.551 | 128 | WB | Large T | A0201 |
| 74 | GTWNSSEV | 0.542 | 141 | WB | Large T | A0201 |
| 603 | RLDSEISM | 0.535 | 153 | WB | Large T | A0201 |
| 569 | ILQSGMTL | 0.529 | 164 | WB | Large T | A0201 |
| 573 | GMTLLLLL | 0.519 | 181 | WB | Large T | A0201 |
| 146 | FLSQAVFS | 0.495 | 234 | WB | Large T | A0201 |
| 21 | AAWGNLPL | 0.473 | 297 | WB | Large T | A0201 |
| 448 | ALNVNLPM | 0.468 | 316 | WB | Large T | A0201 |
| 609 | SMYTFSRM | 0.459 | 347 | WB | Large T | A0201 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 574 | MTLLLLLI | 0.458 | 350 | WB | Large T | A0201 |
| 60 | KMEQDVKV | 0.452 | 375 | WB | Large T | A0201 |
| 388 | YMAGVAWL | 0.861 | 4 | SB | Large T | A0202 |
| 175 | KLMEKYSV | 0.858 | 4 | SB | Large T | A0202 |
| 293 | YLEFQYNV | 0.811 | 7 | SB | Large T | A0202 |
| 287 | FLLLGMYL | 0.800 | 8 | SB | Large T | A0202 |
| 272 | KLITEYAV | 0.772 | 11 | SB | Large T | A0202 |
| 11 | ELMDLLGL | 0.762 | 13 | SB | Large T | A0202 |
| 146 | FLSQAVFS | 0.740 | 16 | SB | Large T | A0202 |
| 322 | FANAIIFA | 0.740 | 16 | SB | Large T | A0202 |
| 215 | KLCTFSFL | 0.732 | 18 | SB | Large T | A0202 |
| 398 | LLPKMDSV | 0.721 | 20 | SB | Large T | A0202 |
| 501 | YLDGSVKV | 0.716 | 21 | SB | Large T | A0202 |
| 557 | SLQNSEFL | 0.712 | 22 | SB | Large T | A0202 |
| 570 | LQSGMTLL | 0.696 | 26 | SB | Large T | A0202 |
| 372 | KMDLIFGA | 0.672 | 34 | SB | Large T | A0202 |
| 457 | RLTFELGV | 0.666 | 37 | SB | Large T | A0202 |
| 573 | GMTLLLLL | 0.655 | 41 | SB | Large T | A0202 |
| 579 | LLIWFRPV | 0.643 | 47 | SB | Large T | A0202 |
| 9 | SMELMDLL | 0.628 | 56 | WB | Large T | A0202 |
| 469 | YMVVFEDV | 0.606 | 70 | WB | Large T | A0202 |
| 558 | LQNSEFLL | 0.596 | 78 | WB | Large T | A0202 |
| 563 | FLLEKRIL | 0.593 | 81 | WB | Large T | A0202 |
| 50 | KMKRMNTL | 0.586 | 88 | WB | Large T | A0202 |
| 369 | ILDKMDLI | 0.585 | 89 | WB | Large T | A0202 |
| 391 | GVAWLHCL | 0.577 | 96 | WB | Large T | A0202 |
| 491 | GINNLDSL | 0.576 | 98 | WB | Large T | A0202 |
| 184 | FISRHMCA | 0.571 | 103 | WB | Large T | A0202 |
| 514 | HLNKRTQI | 0.561 | 115 | WB | Large T | A0202 |
| 377 | FGAHGNAV | 0.549 | 131 | WB | Large T | A0202 |
| 569 | ILQSGMTL | 0.546 | 135 | WB | Large T | A0202 |
| 527 | VTMNEYPV | 0.533 | 156 | WB | Large T | A0202 |
| 226 | GVNKEYLL | 0.525 | 171 | WB | Large T | A0202 |
| 448 | ALNVNLPM | 0.512 | 196 | WB | Large T | A0202 |
| 355 | HMTREEML | 0.510 | 200 | WB | Large T | A0202 |
| 60 | KMEQDVKV | 0.505 | 211 | WB | Large T | A0202 |
| 27 | PLMRKAYL | 0.488 | 254 | WB | Large T | A0202 |
| 603 | RLDSEISM | 0.481 | 276 | WB | Large T | A0202 |
| 144 | HQFLSQAV | 0.472 | 301 | WB | Large T | A0202 |
| 465 | AIDQYMVV | 0.458 | 353 | WB | Large T | A0202 |
| 155 | RTLACFAV | 0.443 | 412 | WB | Large T | A0202 |
| 609 | SMYTFSRM | 0.442 | 419 | WB | Large T | A0202 |
| 464 | VAIDQYMV | 0.429 | 483 | WB | Large T | A0202 |
| 388 | YMAGVAWL | 0.893 | 3 | SB | Large T | A0203 |
| 579 | LLIWFRPV | 0.884 | 3 | SB | Large T | A0203 |
| 175 | KLMEKYSV | 0.870 | 4 | SB | Large T | A0203 |
| 501 | YLDGSVKV | 0.811 | 7 | SB | Large T | A0203 |
| 457 | RLTFELGV | 0.781 | 10 | SB | Large T | A0203 |
| 287 | FLLLGMYL | 0.780 | 10 | SB | Large T | A0203 |
| 272 | KLITEYAV | 0.779 | 10 | SB | Large T | A0203 |
| 398 | LLPKMDSV | 0.777 | 11 | SB | Large T | A0203 |
| 293 | YLEFQYNV | 0.769 | 12 | SB | Large T | A0203 |
| 50 | KMKRMNTL | 0.758 | 13 | SB | Large T | A0203 |
| 469 | YMVVFEDV | 0.736 | 17 | SB | Large T | A0203 |
| 11 | ELMDLLGL | 0.712 | 22 | SB | Large T | A0203 |
| 569 | ILQSGMTL | 0.711 | 22 | SB | Large T | A0203 |
| 322 | FANAIIFA | 0.697 | 26 | SB | Large T | A0203 |
| 184 | FISRHMCA | 0.689 | 28 | SB | Large T | A0203 |
| 514 | HLNKRTQI | 0.680 | 31 | SB | Large T | A0203 |
| 609 | SMYTFSRM | 0.642 | 48 | SB | Large T | A0203 |
| 563 | FLLEKRIL | 0.628 | 55 | WB | Large T | A0203 |
| 372 | KMDLIFGA | 0.622 | 59 | WB | Large T | A0203 |
| 570 | LQSGMTLL | 0.608 | 69 | WB | Large T | A0203 |
| 215 | KLCTFSFL | 0.607 | 70 | WB | Large T | A0203 |
| 391 | GVAWLHCL | 0.570 | 104 | WB | Large T | A0203 |
| 448 | ALNVNLPM | 0.556 | 122 | WB | Large T | A0203 |
| 188 | HMCAGHNI | 0.551 | 128 | WB | Large T | A0203 |
| 527 | VTMNEYPV | 0.548 | 132 | WB | Large T | A0203 |
| 573 | GMTLLLLL | 0.535 | 153 | WB | Large T | A0203 |
| 520 | QIFPPGLV | 0.531 | 159 | WB | Large T | A0203 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 146 | FLSQAVFS | 0.528 | 165 | WB | Large T | A0203 |
| 144 | HQFLSQAV | 0.527 | 166 | WB | Large T | A0203 |
| 491 | GINNLDSL | 0.526 | 168 | WB | Large T | A0203 |
| 557 | SLQNSEFL | 0.517 | 186 | WB | Large T | A0203 |
| 465 | AIDQYMVV | 0.513 | 193 | WB | Large T | A0203 |
| 155 | RTLACFAV | 0.509 | 202 | WB | Large T | A0203 |
| 464 | VAIDQYMV | 0.497 | 232 | WB | Large T | A0203 |
| 551 | KIYLRKSL | 0.489 | 252 | WB | Large T | A0203 |
| 369 | ILDKMDLI | 0.466 | 321 | WB | Large T | A0203 |
| 654 | SQVSDTSA | 0.462 | 338 | WB | Large T | A0203 |
| 231 | YLLYSALT | 0.453 | 372 | WB | Large T | A0203 |
| 199 | LTPHRHRV | 0.447 | 394 | WB | Large T | A0203 |
| 60 | KMEQDVKV | 0.429 | 484 | WB | Large T | A0203 |
| 615 | RMKYNICM | 0.427 | 490 | WB | Large T | A0203 |
| 175 | KLMEKYSV | 0.762 | 13 | SB | Large T | A0204 |
| 388 | YMAGVAWL | 0.708 | 23 | SB | Large T | A0204 |
| 272 | KLITEYAV | 0.652 | 43 | SB | Large T | A0204 |
| 527 | VTMNEYPV | 0.635 | 52 | WB | Large T | A0204 |
| 579 | LLIWFRPV | 0.627 | 56 | WB | Large T | A0204 |
| 60 | KMEQDVKV | 0.615 | 64 | WB | Large T | A0204 |
| 287 | FLLLGMYL | 0.601 | 75 | WB | Large T | A0204 |
| 569 | ILQSGMTL | 0.572 | 102 | WB | Large T | A0204 |
| 501 | YLDGSVKV | 0.571 | 104 | WB | Large T | A0204 |
| 557 | SLQNSEFL | 0.565 | 110 | WB | Large T | A0204 |
| 563 | FLLEKRIL | 0.554 | 124 | WB | Large T | A0204 |
| 293 | YLEFQYNV | 0.537 | 149 | WB | Large T | A0204 |
| 215 | KLCTFSFL | 0.534 | 154 | WB | Large T | A0204 |
| 11 | ELMDLLGL | 0.521 | 178 | WB | Large T | A0204 |
| 469 | YMVVFEDV | 0.512 | 195 | WB | Large T | A0204 |
| 464 | VAIDQYMV | 0.512 | 196 | WB | Large T | A0204 |
| 536 | KTLQARFV | 0.494 | 239 | WB | Large T | A0204 |
| 155 | RTLACFAV | 0.475 | 293 | WB | Large T | A0204 |
| 398 | LLPKMDSV | 0.460 | 345 | WB | Large T | A0204 |
| 465 | AIDQYMVV | 0.459 | 349 | WB | Large T | A0204 |
| 457 | RLTFELGV | 0.448 | 393 | WB | Large T | A0204 |
| 50 | KMKRMNTL | 0.443 | 412 | WB | Large T | A0204 |
| 175 | KLMEKYSV | 0.879 | 3 | SB | Large T | A0206 |
| 155 | RTLACFAV | 0.822 | 6 | SB | Large T | A0206 |
| 272 | KLITEYAV | 0.820 | 6 | SB | Large T | A0206 |
| 579 | LLIWFRPV | 0.813 | 7 | SB | Large T | A0206 |
| 287 | FLLLGMYL | 0.784 | 10 | SB | Large T | A0206 |
| 654 | SQVSDTSA | 0.782 | 10 | SB | Large T | A0206 |
| 501 | YLDGSVKV | 0.771 | 11 | SB | Large T | A0206 |
| 388 | YMAGVAWL | 0.737 | 17 | SB | Large T | A0206 |
| 469 | YMVVFEDV | 0.730 | 18 | SB | Large T | A0206 |
| 267 | KQVSWKLI | 0.720 | 20 | SB | Large T | A0206 |
| 144 | HQFLSQAV | 0.705 | 24 | SB | Large T | A0206 |
| 372 | KMDLIFGA | 0.695 | 27 | SB | Large T | A0206 |
| 570 | LQSGMTLL | 0.694 | 27 | SB | Large T | A0206 |
| 296 | FQYNVEEC | 0.688 | 29 | SB | Large T | A0206 |
| 457 | RLTFELGV | 0.678 | 32 | SB | Large T | A0206 |
| 398 | LLPKMDSV | 0.673 | 34 | SB | Large T | A0206 |
| 558 | LQNSEFLL | 0.665 | 37 | SB | Large T | A0206 |
| 338 | CQQAVDTV | 0.654 | 42 | SB | Large T | A0206 |
| 322 | FANAIIFA | 0.648 | 45 | SB | Large T | A0206 |
| 465 | AIDQYMVV | 0.646 | 45 | SB | Large T | A0206 |
| 74 | GTWNSSEV | 0.645 | 46 | SB | Large T | A0206 |
| 527 | VTMNEYPV | 0.615 | 64 | WB | Large T | A0206 |
| 293 | YLEFQYNV | 0.613 | 65 | WB | Large T | A0206 |
| 11 | ELMDLLGL | 0.594 | 80 | WB | Large T | A0206 |
| 536 | KTLQARFV | 0.593 | 81 | WB | Large T | A0206 |
| 464 | VAIDQYMV | 0.572 | 102 | WB | Large T | A0206 |
| 21 | AAWGNLPL | 0.571 | 104 | WB | Large T | A0206 |
| 383 | AVLEQYMA | 0.539 | 146 | WB | Large T | A0206 |
| 563 | FLLEKRIL | 0.534 | 155 | WB | Large T | A0206 |
| 574 | MTLLLLLI | 0.517 | 185 | WB | Large T | A0206 |
| 215 | KLCTFSFL | 0.512 | 195 | WB | Large T | A0206 |
| 184 | FISRHMCA | 0.511 | 197 | WB | Large T | A0206 |
| 519 | TQIFPPGL | 0.505 | 210 | WB | Large T | A0206 |
| 377 | FGAHGNAV | 0.470 | 308 | WB | Large T | A0206 |

TABLE M-continued

Prediction of BK virus Large T protein specific MHC class1,
8-, 9-, 10-, 11-mer peptide binders for 42 MHC class 1 alleles
(see FIG. 11) using the www.cbs.dtu.dk/services/
NetMHC/ database. The MHC class 1 molecules for which
no binders were found are not listed.

| pos | peptide | logscore | affinity (nM) | Bind Level | Protein Name | Allele |
|---|---|---|---|---|---|---|
| 335 | KSICQQAV | 0.469 | 311 | WB | Large T | A0206 |
| 369 | ILDKMDLI | 0.464 | 328 | WB | Large T | A0206 |
| 520 | QIFPPGLV | 0.458 | 352 | WB | Large T | A0206 |
| 391 | GVAWLHCL | 0.457 | 355 | WB | Large T | A0206 |
| 231 | YLLYSALT | 0.451 | 380 | WB | Large T | A0206 |
| 569 | ILQSGMTL | 0.445 | 406 | WB | Large T | A0206 |
| 339 | QQAVDTVL | 0.443 | 414 | WB | Large T | A0206 |
| 146 | FLSQAVFS | 0.438 | 436 | WB | Large T | A0206 |
| 169 | AQILYKKL | 0.435 | 453 | WB | Large T | A0206 |
| 60 | KMEQDVKV | 0.427 | 490 | WB | Large T | A0206 |
| 501 | YLDGSVKV | 0.977 | 1 | SB | Large T | A0211 |
| 388 | YMAGVAWL | 0.963 | 1 | SB | Large T | A0211 |
| 175 | KLMEKYSV | 0.945 | 1 | SB | Large T | A0211 |
| 287 | FLLLGMYL | 0.937 | 1 | SB | Large T | A0211 |
| 579 | LLIWFRPV | 0.922 | 2 | SB | Large T | A0211 |
| 465 | AIDQYMVV | 0.919 | 2 | SB | Large T | A0211 |
| 272 | KLITEYAV | 0.906 | 2 | SB | Large T | A0211 |
| 11 | ELMDLLGL | 0.904 | 2 | SB | Large T | A0211 |
| 398 | LLPKMDSV | 0.900 | 2 | SB | Large T | A0211 |
| 457 | RLTFELGV | 0.899 | 2 | SB | Large T | A0211 |
| 293 | YLEFQYNV | 0.897 | 3 | SB | Large T | A0211 |
| 557 | SLQNSEFL | 0.882 | 3 | SB | Large T | A0211 |
| 569 | ILQSGMTL | 0.870 | 4 | SB | Large T | A0211 |
| 469 | YMVVFEDV | 0.866 | 4 | SB | Large T | A0211 |
| 563 | FLLEKRIL | 0.862 | 4 | SB | Large T | A0211 |
| 603 | RLDSEISM | 0.848 | 5 | SB | Large T | A0211 |
| 60 | KMEQDVKV | 0.845 | 5 | SB | Large T | A0211 |
| 369 | ILDKMDLI | 0.828 | 6 | SB | Large T | A0211 |
| 573 | GMTLLLLL | 0.824 | 6 | SB | Large T | A0211 |
| 215 | KLCTFSFL | 0.821 | 6 | SB | Large T | A0211 |
| 520 | QIFPPGLV | 0.811 | 7 | SB | Large T | A0211 |
| 609 | SMYTFSRM | 0.780 | 10 | SB | Large T | A0211 |
| 372 | KMDLIFGA | 0.777 | 11 | SB | Large T | A0211 |
| 464 | VAIDQYMV | 0.743 | 16 | SB | Large T | A0211 |
| 14 | DLLGLERA | 0.725 | 19 | SB | Large T | A0211 |
| 74 | GTWNSSEV | 0.720 | 20 | SB | Large T | A0211 |
| 391 | GVAWLHCL | 0.719 | 20 | SB | Large T | A0211 |
| 485 | DLPSGHGI | 0.719 | 21 | SB | Large T | A0211 |
| 155 | RTLACFAV | 0.693 | 27 | SB | Large T | A0211 |
| 442 | DLCGGKAL | 0.686 | 29 | SB | Large T | A0211 |
| 231 | YLLYSALT | 0.682 | 31 | SB | Large T | A0211 |
| 536 | KTLQARFV | 0.668 | 36 | SB | Large T | A0211 |
| 355 | HMTREEML | 0.667 | 36 | SB | Large T | A0211 |
| 27 | PLMRKAYL | 0.666 | 37 | SB | Large T | A0211 |
| 406 | IFDFLHCV | 0.646 | 46 | SB | Large T | A0211 |
| 514 | HLNKRTQI | 0.642 | 48 | SB | Large T | A0211 |
| 21 | AAWGNLPL | 0.638 | 50 | WB | Large T | A0211 |
| 9 | SMELMDLL | 0.635 | 51 | WB | Large T | A0211 |
| 56 | TLYKKMEQ | 0.625 | 57 | WB | Large T | A0211 |
| 188 | HMCAGHNI | 0.618 | 62 | WB | Large T | A0211 |
| 576 | LLLLLIWF | 0.614 | 64 | WB | Large T | A0211 |
| 146 | FLSQAVFS | 0.597 | 78 | WB | Large T | A0211 |
| 383 | AVLEQYMA | 0.594 | 81 | WB | Large T | A0211 |
| 405 | VIFDFLHC | 0.587 | 87 | WB | Large T | A0211 |
| 344 | TVLAKKRV | 0.583 | 91 | WB | Large T | A0211 |
| 50 | KMKRMNTL | 0.582 | 92 | WB | Large T | A0211 |
| 288 | LLLGMYLE | 0.577 | 96 | WB | Large T | A0211 |
| 448 | ALNVNLPM | 0.573 | 100 | WB | Large T | A0211 |
| 368 | HILDKMDL | 0.570 | 104 | WB | Large T | A0211 |
| 527 | VTMNEYPV | 0.561 | 115 | WB | Large T | A0211 |
| 150 | AVFSNRTL | 0.555 | 122 | WB | Large T | A0211 |
| 184 | FISRHMCA | 0.545 | 137 | WB | Large T | A0211 |
| 199 | LTPHRHRV | 0.543 | 140 | WB | Large T | A0211 |
| 551 | KIYLRKSL | 0.523 | 173 | WB | Large T | A0211 |
| 3 | VLNREESM | 0.494 | 239 | WB | Large T | A0211 |
| 491 | GINNLDSL | 0.485 | 262 | WB | Large T | A0211 |
| 291 | GMYLEFQY | 0.468 | 315 | WB | Large T | A0211 |
| 350 | RVDTLHMT | 0.466 | 322 | WB | Large T | A0211 |
| 142 | DLHQFLSQ | 0.459 | 348 | WB | Large T | A0211 |
| 401 | KMDSVIFD | 0.458 | 350 | WB | Large T | A0211 |
| 673 | HLCKGFQC | 0.458 | 350 | WB | Large T | A0211 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 289 | LLGMYLEF | 0.450 | 383 | WB | Large T | A0211 |
| 577 | LLLLIWFR | 0.450 | 384 | WB | Large T | A0211 |
| 439 | GLLDLCGG | 0.448 | 390 | WB | Large T | A0211 |
| 501 | YLDGSVKV | 0.940 | 1 | SB | Large T | A0212 |
| 388 | YMAGVAWL | 0.924 | 2 | SB | Large T | A0212 |
| 175 | KLMEKYSV | 0.912 | 2 | SB | Large T | A0212 |
| 287 | FLLLGMYL | 0.903 | 2 | SB | Large T | A0212 |
| 398 | LLPKMDSV | 0.879 | 3 | SB | Large T | A0212 |
| 469 | YMVVFEDV | 0.878 | 3 | SB | Large T | A0212 |
| 293 | YLEFQYNV | 0.872 | 4 | SB | Large T | A0212 |
| 579 | LLIWFRPV | 0.853 | 4 | SB | Large T | A0212 |
| 563 | FLLEKRIL | 0.852 | 4 | SB | Large T | A0212 |
| 272 | KLITEYAV | 0.852 | 4 | SB | Large T | A0212 |
| 465 | AIDQYMVV | 0.843 | 5 | SB | Large T | A0212 |
| 11 | ELMDLLGL | 0.842 | 5 | SB | Large T | A0212 |
| 569 | ILQSGMTL | 0.821 | 6 | SB | Large T | A0212 |
| 457 | RLTFELGV | 0.787 | 10 | SB | Large T | A0212 |
| 557 | SLQNSEFL | 0.757 | 13 | SB | Large T | A0212 |
| 609 | SMYTFSRM | 0.711 | 22 | SB | Large T | A0212 |
| 464 | VAIDQYMV | 0.698 | 26 | SB | Large T | A0212 |
| 60 | KMEQDVKV | 0.666 | 37 | SB | Large T | A0212 |
| 355 | HMTREEML | 0.663 | 38 | SB | Large T | A0212 |
| 603 | RLDSEISM | 0.662 | 38 | SB | Large T | A0212 |
| 368 | HILDKMDL | 0.659 | 39 | SB | Large T | A0212 |
| 3 | VLNREESM | 0.639 | 49 | SB | Large T | A0212 |
| 184 | FISRHMCA | 0.635 | 52 | WB | Large T | A0212 |
| 405 | VIFDFLHC | 0.629 | 55 | WB | Large T | A0212 |
| 215 | KLCTFSFL | 0.615 | 64 | WB | Large T | A0212 |
| 369 | ILDKMDLI | 0.609 | 68 | WB | Large T | A0212 |
| 27 | PLMRKAYL | 0.597 | 78 | WB | Large T | A0212 |
| 372 | KMDLIFGA | 0.588 | 86 | WB | Large T | A0212 |
| 50 | KMKRMNTL | 0.579 | 94 | WB | Large T | A0212 |
| 520 | QIFPPGLV | 0.577 | 96 | WB | Large T | A0212 |
| 573 | GMTLLLLL | 0.577 | 96 | WB | Large T | A0212 |
| 527 | VTMNEYPV | 0.571 | 104 | WB | Large T | A0212 |
| 188 | HMCAGHNI | 0.546 | 135 | WB | Large T | A0212 |
| 14 | DLLGLERA | 0.523 | 174 | WB | Large T | A0212 |
| 442 | DLCGGKAL | 0.521 | 178 | WB | Large T | A0212 |
| 74 | GTWNSSEV | 0.521 | 178 | WB | Large T | A0212 |
| 56 | TLYKKMEQ | 0.520 | 180 | WB | Large T | A0212 |
| 485 | DLPSGHGI | 0.518 | 183 | WB | Large T | A0212 |
| 21 | AAWGNLPL | 0.511 | 197 | WB | Large T | A0212 |
| 391 | GVAWLHCL | 0.511 | 199 | WB | Large T | A0212 |
| 231 | YLLYSALT | 0.504 | 213 | WB | Large T | A0212 |
| 288 | LLLGMYLE | 0.486 | 259 | WB | Large T | A0212 |
| 514 | HLNKRTQI | 0.480 | 276 | WB | Large T | A0212 |
| 199 | LTPHRHRV | 0.477 | 285 | WB | Large T | A0212 |
| 155 | RTLACFAV | 0.476 | 290 | WB | Large T | A0212 |
| 377 | FGAHGNAV | 0.461 | 340 | WB | Large T | A0212 |
| 146 | FLSQAVFS | 0.442 | 418 | WB | Large T | A0212 |
| 9 | SMELMDLL | 0.426 | 495 | WB | Large T | A0212 |
| 501 | YLDGSVKV | 0.928 | 2 | SB | Large T | A0216 |
| 388 | YMAGVAWL | 0.917 | 2 | SB | Large T | A0216 |
| 175 | KLMEKYSV | 0.905 | 2 | SB | Large T | A0216 |
| 398 | LLPKMDSV | 0.895 | 3 | SB | Large T | A0216 |
| 287 | FLLLGMYL | 0.891 | 3 | SB | Large T | A0216 |
| 293 | YLEFQYNV | 0.849 | 5 | SB | Large T | A0216 |
| 557 | SLQNSEFL | 0.846 | 5 | SB | Large T | A0216 |
| 569 | ILQSGMTL | 0.836 | 5 | SB | Large T | A0216 |
| 272 | KLITEYAV | 0.832 | 6 | SB | Large T | A0216 |
| 465 | AIDQYMVV | 0.829 | 6 | SB | Large T | A0216 |
| 27 | PLMRKAYL | 0.829 | 6 | SB | Large T | A0216 |
| 579 | LLIWFRPV | 0.804 | 8 | SB | Large T | A0216 |
| 215 | KLCTFSFL | 0.784 | 10 | SB | Large T | A0216 |
| 11 | ELMDLLGL | 0.740 | 16 | SB | Large T | A0216 |
| 74 | GTWNSSEV | 0.734 | 17 | SB | Large T | A0216 |
| 60 | KMEQDVKV | 0.732 | 18 | SB | Large T | A0216 |
| 457 | RLTFELGV | 0.727 | 19 | SB | Large T | A0216 |
| 469 | YMVVFEDV | 0.718 | 21 | SB | Large T | A0216 |
| 563 | FLLEKRIL | 0.709 | 23 | SB | Large T | A0216 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 520 | QIFPPGLV | 0.701 | 25 | SB | Large T | A0216 |
| 514 | HLNKRTQI | 0.689 | 29 | SB | Large T | A0216 |
| 369 | ILDKMDLI | 0.673 | 34 | SB | Large T | A0216 |
| 56 | TLYKKMEQ | 0.662 | 38 | SB | Large T | A0216 |
| 50 | KMKRMNTL | 0.651 | 43 | SB | Large T | A0216 |
| 609 | SMYTFSRM | 0.647 | 45 | SB | Large T | A0216 |
| 603 | RLDSEISM | 0.626 | 56 | WB | Large T | A0216 |
| 355 | HMTREEML | 0.623 | 58 | WB | Large T | A0216 |
| 21 | AAWGNLPL | 0.600 | 75 | WB | Large T | A0216 |
| 442 | DLCGGKAL | 0.597 | 78 | WB | Large T | A0216 |
| 573 | GMTLLLLL | 0.595 | 79 | WB | Large T | A0216 |
| 464 | VAIDQYMV | 0.593 | 82 | WB | Large T | A0216 |
| 344 | TVLAKKRV | 0.583 | 91 | WB | Large T | A0216 |
| 199 | LTPHRHRV | 0.568 | 106 | WB | Large T | A0216 |
| 14 | DLLGLERA | 0.566 | 109 | WB | Large T | A0216 |
| 485 | DLPSGHGI | 0.550 | 130 | WB | Large T | A0216 |
| 536 | KTLQARFV | 0.548 | 132 | WB | Large T | A0216 |
| 9 | SMELMDLL | 0.532 | 158 | WB | Large T | A0216 |
| 391 | GVAWLHCL | 0.522 | 176 | WB | Large T | A0216 |
| 150 | AVFSNRTL | 0.516 | 187 | WB | Large T | A0216 |
| 188 | HMCAGHNI | 0.512 | 195 | WB | Large T | A0216 |
| 527 | VTMNEYPV | 0.506 | 210 | WB | Large T | A0216 |
| 146 | FLSQAVFS | 0.504 | 213 | WB | Large T | A0216 |
| 231 | YLLYSALT | 0.501 | 220 | WB | Large T | A0216 |
| 491 | GINNLDSL | 0.476 | 290 | WB | Large T | A0216 |
| 184 | FISRHMCA | 0.474 | 296 | WB | Large T | A0216 |
| 551 | KIYLRKSL | 0.468 | 315 | WB | Large T | A0216 |
| 155 | RTLACFAV | 0.465 | 327 | WB | Large T | A0216 |
| 673 | HLCKGFQC | 0.463 | 334 | WB | Large T | A0216 |
| 448 | ALNVNLPM | 0.442 | 418 | WB | Large T | A0216 |
| 372 | KMDLIFGA | 0.442 | 419 | WB | Large T | A0216 |
| 406 | IFDFLHCV | 0.433 | 460 | WB | Large T | A0216 |
| 3 | VLNREESM | 0.429 | 482 | WB | Large T | A0216 |
| 501 | YLDGSVKV | 0.939 | 1 | SB | Large T | A0219 |
| 388 | YMAGVAWL | 0.930 | 2 | SB | Large T | A0219 |
| 287 | FLLLGMYL | 0.835 | 5 | SB | Large T | A0219 |
| 11 | ELMDLLGL | 0.807 | 8 | SB | Large T | A0219 |
| 175 | KLMEKYSV | 0.800 | 8 | SB | Large T | A0219 |
| 569 | ILQSGMTL | 0.780 | 10 | SB | Large T | A0219 |
| 398 | LLPKMDSV | 0.713 | 22 | SB | Large T | A0219 |
| 293 | YLEFQYNV | 0.711 | 22 | SB | Large T | A0219 |
| 557 | SLQNSEFL | 0.660 | 39 | SB | Large T | A0219 |
| 465 | AIDQYMVV | 0.659 | 39 | SB | Large T | A0219 |
| 272 | KLITEYAV | 0.651 | 43 | SB | Large T | A0219 |
| 21 | AAWGNLPL | 0.637 | 51 | WB | Large T | A0219 |
| 457 | RLTFELGV | 0.599 | 76 | WB | Large T | A0219 |
| 27 | PLMRKAYL | 0.589 | 85 | WB | Large T | A0219 |
| 603 | RLDSEISM | 0.574 | 100 | WB | Large T | A0219 |
| 369 | ILDKMDLI | 0.567 | 108 | WB | Large T | A0219 |
| 469 | YMVVFEDV | 0.565 | 111 | WB | Large T | A0219 |
| 579 | LLIWFRPV | 0.564 | 112 | WB | Large T | A0219 |
| 563 | FLLEKRIL | 0.555 | 123 | WB | Large T | A0219 |
| 485 | DLPSGHGI | 0.542 | 142 | WB | Large T | A0219 |
| 74 | GTWNSSEV | 0.540 | 145 | WB | Large T | A0219 |
| 464 | VAIDQYMV | 0.507 | 208 | WB | Large T | A0219 |
| 355 | HMTREEML | 0.497 | 230 | WB | Large T | A0219 |
| 372 | KMDLIFGA | 0.431 | 469 | WB | Large T | A0219 |
| 406 | IFDFLHCV | 0.429 | 482 | WB | Large T | A0219 |
| 573 | GMTLLLLL | 0.426 | 497 | WB | Large T | A0219 |
| 53 | RMNTLYKK | 0.719 | 20 | SB | Large T | A0301 |
| 232 | LLYSALTR | 0.673 | 34 | SB | Large T | A0301 |
| 28 | LMRKAYLK | 0.671 | 35 | SB | Large T | A0301 |
| 394 | WLHCLLPK | 0.536 | 150 | WB | Large T | A0301 |
| 208 | AINNFCQK | 0.529 | 162 | WB | Large T | A0301 |
| 161 | AVYTTKEK | 0.526 | 169 | WB | Large T | A0301 |
| 577 | LLLLIWFR | 0.513 | 193 | WB | Large T | A0301 |
| 365 | RFNHILDK | 0.512 | 196 | WB | Large T | A0301 |
| 291 | GMYLEFQY | 0.507 | 207 | WB | Large T | A0301 |
| 31 | KAYLKKCK | 0.506 | 210 | WB | Large T | A0301 |
| 608 | ISMYTFSR | 0.489 | 252 | WB | Large T | A0301 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pospeptide | logscore | affinity (nM) | Bind Level | Protein Name | Allele |
|---|---|---|---|---|---|
| 413 VVFNVPKR | 0.483 | 270 | WB | Large T | A0301 |
| 121 SQHSTPPK | 0.481 | 274 | WB | Large T | A0301 |
| 156 TLACFAVY | 0.475 | 294 | WB | Large T | A0301 |
| 222 LICKGVNK | 0.438 | 435 | WB | Large T | A0301 |
| 195 IIFFLTPH | 0.434 | 456 | WB | Large T | A0301 |
| 412 CVVFNVPK | 0.428 | 486 | WB | Large T | A0301 |
|  |  |  |  |  |  |
| 208 AINNFCQK | 0.764 | 12 | SB | Large T | A1101 |
| 161 AVYTTKEK | 0.761 | 13 | SB | Large T | A1101 |
| 121 SQHSTPPK | 0.746 | 15 | SB | Large T | A1101 |
| 325 AIIFAESK | 0.737 | 17 | SB | Large T | A1101 |
| 341 AVDTVLAK | 0.732 | 18 | SB | Large T | A1101 |
| 53 RMNTLYKK | 0.727 | 19 | SB | Large T | A1101 |
| 608 ISMYTFSR | 0.721 | 20 | SB | Large T | A1101 |
| 544 RQIDFRPK | 0.709 | 23 | SB | Large T | A1101 |
| 505 SVKVNLEK | 0.695 | 27 | SB | Large T | A1101 |
| 168 KAQILYKK | 0.672 | 34 | SB | Large T | A1101 |
| 412 CVVFNVPK | 0.665 | 37 | SB | Large T | A1101 |
| 669 SQELHLCK | 0.657 | 40 | SB | Large T | A1101 |
| 31 KAYLKKCK | 0.639 | 49 | SB | Large T | A1101 |
| 218 TFSFLICK | 0.626 | 57 | WB | Large T | A1101 |
| 413 VVFNVPKR | 0.613 | 65 | WB | Large T | A1101 |
| 537 TLQARFVR | 0.609 | 68 | WB | Large T | A1101 |
| 470 MVVFEDVK | 0.604 | 72 | WB | Large T | A1101 |
| 404 SVIFDPLH | 0.596 | 79 | WB | Large T | A1101 |
| 222 LICKGVNK | 0.581 | 93 | WB | Large T | A1101 |
| 560 NSEFLLEK | 0.574 | 100 | WB | Large T | A1101 |
| 611 YTFSRMKY | 0.568 | 107 | WB | Large T | A1101 |
| 148 SQAVFSNR | 0.553 | 125 | WB | Large T | A1101 |
| 450 NVNLPMER | 0.526 | 168 | WB | Large T | A1101 |
| 394 WLHCLLPK | 0.499 | 226 | WB | Large T | A1101 |
| 291 GMYLEFQY | 0.497 | 231 | WB | Large T | A1101 |
| 617 KYNICMGK | 0.464 | 328 | WB | Large T | A1101 |
| 247 ESIQGGLK | 0.464 | 331 | WB | Large T | A1101 |
| 577 LLLLIWFR | 0.462 | 338 | WB | Large T | A1101 |
| 52 KRMNTLYK | 0.454 | 367 | WB | Large T | A1101 |
| 678 FQCFKRPK | 0.440 | 426 | WB | Large T | A1101 |
| 28 LMRKAYLK | 0.435 | 452 | WB | Large T | A1101 |
| 365 RFNHILDK | 0.427 | 494 | WB | Large T | A1101 |
|  |  |  |  |  |  |
| 408 DFLHCVVF | 0.671 | 35 | SB | Large T | A2301 |
| 541 RFVRQIDF | 0.664 | 37 | SB | Large T | A2301 |
| 610 MYTFSRMK | 0.660 | 39 | SB | Large T | A2301 |
| 321 HFANAIIF | 0.633 | 53 | WB | Large T | A2301 |
| 172 LYKKLMEK | 0.626 | 57 | WB | Large T | A2301 |
| 104 LFCHEDMF | 0.617 | 63 | WB | Large T | A2301 |
| 500 DYLDGSVK | 0.609 | 68 | WB | Large T | A2301 |
| 582 WFRPVADF | 0.608 | 69 | WB | Large T | A2301 |
| 230 EYLLYSAL | 0.601 | 75 | WB | Large T | A2301 |
| 617 KYNICMGK | 0.599 | 76 | WB | Large T | A2301 |
| 205 RVSAINNF | 0.504 | 214 | WB | Large T | A2301 |
| 387 QYMAGVAW | 0.502 | 219 | WB | Large T | A2301 |
| 576 LLLLLIWF | 0.493 | 241 | WB | Large T | A2301 |
| 92 WWSSFNEK | 0.492 | 243 | WB | Large T | A2301 |
| 145 QFLSQAVF | 0.489 | 252 | WB | Large T | A2301 |
| 365 RFNHILDK | 0.475 | 292 | WB | Large T | A2301 |
| 556 KSLQNSEF | 0.460 | 343 | WB | Large T | A2301 |
| 159 CFAVYTTK | 0.441 | 423 | WB | Large T | A2301 |
|  |  |  |  |  |  |
| 230 EYLLYSAL | 0.680 | 32 | SB | Large T | A2402 |
| 145 QFLSQAVF | 0.522 | 176 | WB | Large T | A2402 |
| 408 DFLHCVVF | 0.519 | 182 | WB | Large T | A2402 |
| 531 EYPVPKTL | 0.510 | 199 | WB | Large T | A2402 |
| 321 HFANAIIF | 0.507 | 206 | WB | Large T | A2402 |
| 422 YWLFKGPI | 0.506 | 210 | WB | Large T | A2402 |
| 541 RFVRQIDF | 0.460 | 344 | WB | Large T | A2402 |
| 387 QYMAGVAW | 0.445 | 405 | WB | Large T | A2402 |
|  |  |  |  |  |  |
| 387 QYMAGVAW | 0.768 | 12 | SB | Large T | A2403 |
| 582 WFRPVADF | 0.765 | 12 | SB | Large T | A2403 |
| 145 QFLSQAVF | 0.713 | 22 | SB | Large T | A2403 |
| 541 RFVRQIDF | 0.706 | 24 | SB | Large T | A2403 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 321 | HFANAIIF | 0.691 | 28 | SB | Large T | A2403 |
| 230 | EYLLYSAL | 0.591 | 83 | WB | Large T | A2403 |
| 408 | DFLHCVVF | 0.567 | 108 | WB | Large T | A2403 |
| 556 | KSLQNSEF | 0.546 | 135 | WB | Large T | A2403 |
| 104 | LFCHEDMF | 0.497 | 230 | WB | Large T | A2403 |
| 531 | EYPVPKTL | 0.496 | 233 | WB | Large T | A2403 |
| 611 | YTFSRMKY | 0.680 | 31 | SB | Large T | A2601 |
| 285 | DVFLLLGM | 0.588 | 86 | WB | Large T | A2601 |
| 11 | ELMDLLGL | 0.486 | 259 | WB | Large T | A2601 |
| 611 | YTFSRMKY | 0.903 | 2 | SB | Large T | A2602 |
| 285 | DVFLLLGM | 0.810 | 7 | SB | Large T | A2602 |
| 280 | ETKCEDVF | 0.737 | 17 | SB | Large T | A2602 |
| 66 | KVAHQPDF | 0.563 | 112 | WB | Large T | A2602 |
| 11 | ELMDLLGL | 0.500 | 224 | WB | Large T | A2602 |
| 463 | GVAIDQYM | 0.486 | 261 | WB | Large T | A2602 |
| 80 | EVPTYGTE | 0.485 | 262 | WB | Large T | A2602 |
| 291 | GMYLEFQY | 0.680 | 31 | SB | Large T | A2902 |
| 286 | VFLLLGMY | 0.624 | 58 | WB | Large T | A2902 |
| 611 | YTFSRMKY | 0.617 | 63 | WB | Large T | A2902 |
| 156 | TLACFAVY | 0.552 | 127 | WB | Large T | A2902 |
| 270 | SWKLITEY | 0.500 | 223 | WB | Large T | A2902 |
| 121 | SQHSTPPK | 0.836 | 5 | SB | Large T | A3001 |
| 419 | KRRYWLFK | 0.811 | 7 | SB | Large T | A3001 |
| 28 | LMRKAYLK | 0.805 | 8 | SB | Large T | A3001 |
| 544 | RQIDFRPK | 0.771 | 11 | SB | Large T | A3001 |
| 683 | RPKTPPPK | 0.740 | 16 | SB | Large T | A3001 |
| 505 | SVKVNLEK | 0.732 | 18 | SB | Large T | A3001 |
| 53 | RMNTLYKK | 0.672 | 34 | SB | Large T | A3001 |
| 394 | WLHCLLPK | 0.669 | 36 | SB | Large T | A3001 |
| 309 | KDQPYHFK | 0.647 | 45 | SB | Large T | A3001 |
| 31 | KAYLKKCK | 0.628 | 55 | WB | Large T | A3001 |
| 52 | KRMNTLYK | 0.620 | 60 | WB | Large T | A3001 |
| 161 | AVYTTKEK | 0.613 | 65 | WB | Large T | A3001 |
| 29 | MRKAYLKK | 0.612 | 66 | WB | Large T | A3001 |
| 594 | QSRIVEWK | 0.594 | 80 | WB | Large T | A3001 |
| 168 | KAQILYKK | 0.583 | 91 | WB | Large T | A3001 |
| 549 | RPKIYLRK | 0.571 | 103 | WB | Large T | A3001 |
| 172 | LYKKLMEK | 0.566 | 109 | WB | Large T | A3001 |
| 130 | KRKVEDPK | 0.560 | 116 | WB | Large T | A3001 |
| 617 | KYNICMGK | 0.549 | 131 | WB | Large T | A3001 |
| 610 | MYTFSRMK | 0.541 | 142 | WB | Large T | A3001 |
| 365 | RFNHILDK | 0.516 | 188 | WB | Large T | A3001 |
| 196 | IFFLTPHR | 0.458 | 350 | WB | Large T | A3001 |
| 208 | AINNFCQK | 0.450 | 382 | WB | Large T | A3001 |
| 237 | LTRDPYHI | 0.443 | 416 | WB | Large T | A3001 |
| 205 | RVSAINNF | 0.506 | 210 | WB | Large T | A3002 |
| 611 | YTFSRMKY | 0.440 | 428 | WB | Large T | A3002 |
| 577 | LLLLIWFR | 0.818 | 7 | SB | Large T | A3101 |
| 53 | RMNTLYKK | 0.816 | 7 | SB | Large T | A3101 |
| 608 | ISMYTFSR | 0.791 | 9 | SB | Large T | A3101 |
| 537 | TLQARFVR | 0.773 | 11 | SB | Large T | A3101 |
| 196 | IFFLTPHR | 0.772 | 11 | SB | Large T | A3101 |
| 414 | VFNVPKRR | 0.682 | 31 | SB | Large T | A3101 |
| 148 | SQAVFSNR | 0.678 | 32 | SB | Large T | A3101 |
| 180 | YSVTFISR | 0.672 | 34 | SB | Large T | A3101 |
| 676 | KGFQCFKR | 0.671 | 35 | SB | Large T | A3101 |
| 413 | VVFNVPKR | 0.665 | 37 | SB | Large T | A3101 |
| 617 | KYNICMGK | 0.648 | 45 | SB | Large T | A3101 |
| 28 | LMRKAYLK | 0.646 | 46 | SB | Large T | A3101 |
| 544 | RQIDFRPK | 0.646 | 46 | SB | Large T | A3101 |
| 232 | LLYSALTR | 0.630 | 55 | WB | Large T | A3101 |
| 168 | KAQILYKK | 0.618 | 62 | WB | Large T | A3101 |
| 542 | FVRQIDFR | 0.590 | 84 | WB | Large T | A3101 |
| 589 | FSKDIQSR | 0.590 | 84 | WB | Large T | A3101 |
| 596 | RIVEWKER | 0.580 | 93 | WB | Large T | A3101 |
| 198 | FLTPHRHR | 0.569 | 106 | WB | Large T | A3101 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 172 | LYKKLMEK | 0.550 | 129 | WB | Large T | A3101 |
| 365 | RFNHILDK | 0.540 | 145 | WB | Large T | A3101 |
| 610 | MYTFSRMK | 0.532 | 157 | WB | Large T | A3101 |
| 450 | NVNLPMER | 0.515 | 189 | WB | Large T | A3101 |
| 31 | KAYLKKCK | 0.504 | 214 | WB | Large T | A3101 |
| 208 | AINNFCQK | 0.461 | 339 | WB | Large T | A3101 |
| 155 | RTLACFAV | 0.460 | 345 | WB | Large T | A3101 |
| 121 | SQHSTPPK | 0.452 | 376 | WB | Large T | A3101 |
| 577 | LLLLIWFR | 0.795 | 9 | SB | Large T | A3301 |
| 196 | IFFLTPHR | 0.758 | 13 | SB | Large T | A3301 |
| 608 | ISMYTFSR | 0.631 | 54 | WB | Large T | A3301 |
| 450 | NVNLPMER | 0.631 | 54 | WB | Large T | A3301 |
| 542 | FVRQIDFR | 0.628 | 55 | WB | Large T | A3301 |
| 537 | TLQARFVR | 0.608 | 69 | WB | Large T | A3301 |
| 343 | DTVLAKKR | 0.575 | 99 | WB | Large T | A3301 |
| 180 | YSVTFISR | 0.574 | 100 | WB | Large T | A3301 |
| 589 | FSKDIQSR | 0.535 | 152 | WB | Large T | A3301 |
| 547 | DFRPKIYL | 0.526 | 169 | WB | Large T | A3301 |
| 500 | DYLDGSVK | 0.521 | 178 | WB | Large T | A3301 |
| 198 | FLTPHRHR | 0.504 | 215 | WB | Large T | A3301 |
| 265 | ETKQVSWK | 0.447 | 397 | WB | Large T | A3301 |
| 265 | ETKQVSWK | 0.836 | 5 | SB | Large T | A6801 |
| 608 | ISMYTFSR | 0.827 | 6 | SB | Large T | A6801 |
| 470 | MVVFEDVK | 0.812 | 7 | SB | Large T | A6801 |
| 180 | YSVTFISR | 0.805 | 8 | SB | Large T | A6801 |
| 343 | DTVLAKKR | 0.798 | 8 | SB | Large T | A6801 |
| 412 | CVVFNVPK | 0.772 | 11 | SB | Large T | A6801 |
| 450 | NVNLPMER | 0.771 | 11 | SB | Large T | A6801 |
| 542 | FVRQIDFR | 0.764 | 12 | SB | Large T | A6801 |
| 611 | YTFSRMKY | 0.753 | 14 | SB | Large T | A6801 |
| 610 | MYTFSRMK | 0.746 | 15 | SB | Large T | A6801 |
| 413 | VVFNVPKR | 0.728 | 19 | SB | Large T | A6801 |
| 247 | ESIQGGLK | 0.662 | 38 | SB | Large T | A6801 |
| 232 | LLYSALTR | 0.652 | 43 | SB | Large T | A6801 |
| 589 | FSKDIQSR | 0.648 | 44 | SB | Large T | A6801 |
| 537 | TLQARFVR | 0.632 | 53 | WB | Large T | A6801 |
| 196 | IFFLTPHR | 0.626 | 57 | WB | Large T | A6801 |
| 577 | LLLLIWFR | 0.606 | 71 | WB | Large T | A6801 |
| 218 | TFSFLICK | 0.597 | 78 | WB | Large T | A6801 |
| 560 | NSEFLLEK | 0.575 | 99 | WB | Large T | A6801 |
| 325 | AIIFAESK | 0.570 | 105 | WB | Large T | A6801 |
| 198 | FLTPHRHR | 0.567 | 108 | WB | Large T | A6801 |
| 505 | SVKVNLEK | 0.553 | 126 | WB | Large T | A6801 |
| 167 | EKAQILYK | 0.548 | 132 | WB | Large T | A6801 |
| 148 | SQAVFSNR | 0.536 | 151 | WB | Large T | A6801 |
| 159 | CFAVYTTK | 0.531 | 159 | WB | Large T | A6801 |
| 161 | AVYTTKEK | 0.529 | 163 | WB | Large T | A6801 |
| 208 | AINNFCQK | 0.516 | 188 | WB | Large T | A6801 |
| 328 | FAESKNQK | 0.505 | 212 | WB | Large T | A6801 |
| 596 | RIVEWKER | 0.471 | 306 | WB | Large T | A6801 |
| 492 | INNLDSLR | 0.464 | 329 | WB | Large T | A6801 |
| 156 | TLACFAVY | 0.458 | 351 | WB | Large T | A6801 |
| 124 | STPPKKKR | 0.453 | 371 | WB | Large T | A6801 |
| 275 | TEYAVETK | 0.432 | 465 | WB | Large T | A6801 |
| 123 | HSTPPKKK | 0.429 | 482 | WB | Large T | A6801 |
| 404 | SVIFDFLH | 0.427 | 492 | WB | Large T | A6801 |
| 313 | YHFKYHEK | 0.426 | 496 | WB | Large T | A6801 |
| 322 | FANAIIFA | 0.703 | 24 | SB | Large T | A6802 |
| 520 | QIFPPGLV | 0.669 | 35 | SB | Large T | A6802 |
| 155 | RTLACFAV | 0.653 | 42 | SB | Large T | A6802 |
| 377 | FGAHGNAV | 0.634 | 52 | WB | Large T | A6802 |
| 527 | VTMNEYPV | 0.617 | 63 | WB | Large T | A6802 |
| 403 | DSVIFDFL | 0.603 | 73 | WB | Large T | A6802 |
| 11 | ELMDLLGL | 0.583 | 90 | WB | Large T | A6802 |
| 189 | MCAGHNII | 0.575 | 99 | WB | Large T | A6802 |
| 8 | ESMELMDL | 0.563 | 113 | WB | Large T | A6802 |
| 199 | LTPHRHRV | 0.555 | 123 | WB | Large T | A6802 |
| 178 | EKYSVTFI | 0.531 | 160 | WB | Large T | A6802 |
| 388 | YMAGVAWL | 0.523 | 174 | WB | Large T | A6802 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pospeptide | logscore | affinity (nM) | Bind Level | Protein Name | Allele |
|---|---|---|---|---|---|
| 574 MTLLLLLI | 0.480 | 278 | WB | Large T | A6802 |
| 464 VAIDQYMV | 0.479 | 281 | WB | Large T | A6802 |
| 579 LLIWFRPV | 0.477 | 286 | WB | Large T | A6802 |
| 649 QSQCSSQV | 0.455 | 365 | WB | Large T | A6802 |
| 19 ERAAWGNL | 0.434 | 456 | WB | Large T | A6802 |
| 434 TTLAAGLL | 0.431 | 470 | WB | Large T | A6802 |
| 216 LCTFSFLI | 0.428 | 489 | WB | Large T | A6802 |
| 520 QIFPPGLV | 0.711 | 22 | SB | Large T | A6901 |
| 11 ELMDLLGL | 0.667 | 36 | SB | Large T | A6901 |
| 155 RTLACFAV | 0.636 | 51 | WB | Large T | A6901 |
| 574 MTLLLLLI | 0.613 | 66 | WB | Large T | A6901 |
| 527 VTMNEYPV | 0.575 | 99 | WB | Large T | A6901 |
| 434 TTLAAGLL | 0.571 | 103 | WB | Large T | A6901 |
| 501 YLDGSVKV | 0.546 | 135 | WB | Large T | A6901 |
| 74 GTWNSSEV | 0.545 | 137 | WB | Large T | A6901 |
| 464 VAIDQYMV | 0.523 | 175 | WB | Large T | A6901 |
| 322 FANAIIFA | 0.514 | 192 | WB | Large T | A6901 |
| 21 AAWGNLPL | 0.513 | 193 | WB | Large T | A6901 |
| 579 LLIWFRPV | 0.508 | 205 | WB | Large T | A6901 |
| 287 FLLLGMYL | 0.504 | 214 | WB | Large T | A6901 |
| 388 YMAGVAWL | 0.494 | 238 | WB | Large T | A6901 |
| 340 QAVDTVLA | 0.464 | 328 | WB | Large T | A6901 |
| 8 ESMELMDL | 0.453 | 372 | WB | Large T | A6901 |
| 458 LTFELGVA | 0.433 | 462 | WB | Large T | A6901 |
| 377 FGAHGNAV | 0.431 | 472 | WB | Large T | A6901 |
| 383 AVLEQYMA | 0.426 | 499 | WB | Large T | A6901 |
| 453 LPMERLTF | 0.735 | 17 | SB | Large T | B0702 |
| 417 VPKRRYWL | 0.608 | 69 | WB | Large T | B0702 |
| 399 LPKMDSVI | 0.500 | 223 | WB | Large T | B0702 |
| 21 AAWGNLPL | 0.482 | 270 | WB | Large T | B0702 |
| 139 FPSDLHQF | 0.479 | 281 | WB | Large T | B0702 |
| 26 LPLMRKAY | 0.431 | 472 | WB | Large T | B0702 |
| 417 VPKRRYWL | 0.555 | 123 | WB | Large T | B0801 |
| 50 KMKRMNTL | 0.479 | 282 | WB | Large T | B0801 |
| 33 YLKKCKEF | 0.446 | 401 | WB | Large T | B0801 |
| 205 RVSAINNF | 0.544 | 139 | WB | Large T | B1501 |
| 306 CQKKDQPY | 0.511 | 199 | WB | Large T | B1501 |
| 339 QQAVDTVL | 0.504 | 214 | WB | Large T | B1501 |
| 615 RMKYNICM | 0.498 | 228 | WB | Large T | B1501 |
| 33 YLKKCKEF | 0.496 | 232 | WB | Large T | B1501 |
| 388 YMAGVAWL | 0.493 | 240 | WB | Large T | B1501 |
| 611 YTFSRMKY | 0.492 | 244 | WB | Large T | B1501 |
| 291 GMYLEFQY | 0.486 | 261 | WB | Large T | B1501 |
| 144 HQFLSQAV | 0.476 | 288 | WB | Large T | B1501 |
| 50 KMKRMNTL | 0.474 | 294 | WB | Large T | B1501 |
| 156 TLACFAVY | 0.469 | 311 | WB | Large T | B1501 |
| 570 LQSGMTLL | 0.441 | 424 | WB | Large T | B1501 |
| 89 WESWWSSF | 0.814 | 7 | SB | Large T | B1801 |
| 455 MERLTFEL | 0.686 | 29 | SB | Large T | B1801 |
| 606 SEISMYTF | 0.646 | 45 | SB | Large T | B1801 |
| 177 MEKYSVTF | 0.627 | 56 | WB | Large T | B1801 |
| 363 TERFNHIL | 0.449 | 388 | WB | Large T | B1801 |
| 86 TEEWESWW | 0.434 | 458 | WB | Large T | B1801 |
| 52 KRMNTLYK | 0.623 | 58 | WB | Large T | B2705 |
| 567 KRILQSGM | 0.555 | 122 | WB | Large T | B2705 |
| 544 RQIDFRPK | 0.533 | 155 | WB | Large T | B2705 |
| 419 KRRYWLFK | 0.506 | 209 | WB | Large T | B2705 |
| 349 KRVDTLHM | 0.461 | 341 | WB | Large T | B2705 |
| 29 MRKAYLKK | 0.430 | 477 | WB | Large T | B2705 |
| 139 FPSDLHQF | 0.796 | 9 | SB | Large T | B3501 |
| 522 FPPGLVTM | 0.773 | 11 | SB | Large T | B3501 |
| 453 LPMERLTF | 0.752 | 14 | SB | Large T | B3501 |
| 26 LPLMRKAY | 0.749 | 15 | SB | Large T | B3501 |
| 235 SALTRDPY | 0.599 | 76 | WB | Large T | B3501 |
| 382 NAVLEQYM | 0.558 | 119 | WB | Large T | B3501 |

TABLE M-continued

Prediction of BK virus Large T protein specific MHC class1,
8-, 9-, 10-, 11-mer peptide binders for 42 MHC class 1 alleles
(see FIG. 11) using the www.cbs.dtu.dk/services/
NetMHC/ database. The MHC class 1 molecules for which
no binders were found are not listed.

| pos | peptide | logscore | affinity (nM) | Bind Level | Protein Name | Allele |
|---|---|---|---|---|---|---|
| 111 | FASDEEAT | 0.538 | 148 | WB | Large T | B3501 |
| 156 | TLACFAVY | 0.533 | 156 | WB | Large T | B3501 |
| 321 | HFANAIIF | 0.513 | 193 | WB | Large T | B3501 |
| 21 | AAWGNLPL | 0.509 | 203 | WB | Large T | B3501 |
| 77 | NSSEVPTY | 0.502 | 218 | WB | Large T | B3501 |
| 98 | EKWDEDLF | 0.451 | 381 | WB | Large T | B3501 |
| 145 | QFLSQAVF | 0.450 | 384 | WB | Large T | B3501 |
| 89 | WESWWSSF | 0.445 | 407 | WB | Large T | B3501 |
| 5 | NREESMEL | 0.555 | 123 | WB | Large T | B3901 |
| 339 | QQAVDTVL | 0.464 | 330 | WB | Large T | B3901 |
| 388 | YMAGVAWL | 0.429 | 483 | WB | Large T | B3901 |
| 455 | MERLTFEL | 0.676 | 33 | SB | Large T | B4001 |
| 363 | TERFNHIL | 0.626 | 57 | WB | Large T | B4001 |
| 283 | CEDVFLLL | 0.595 | 80 | WB | Large T | B4001 |
| 606 | SEISMYTF | 0.593 | 81 | WB | Large T | B4001 |
| 6 | REESMELM | 0.511 | 197 | WB | Large T | B4001 |
| 177 | MEKYSVTF | 0.487 | 257 | WB | Large T | B4001 |
| 246 | EESIQGGL | 0.432 | 465 | WB | Large T | B4001 |
| 606 | SEISMYTF | 0.568 | 107 | WB | Large T | B4002 |
| 89 | WESWWSSF | 0.495 | 237 | WB | Large T | B4002 |
| 166 | KEKAQILY | 0.489 | 250 | WB | Large T | B4002 |
| 359 | EEMLTERF | 0.489 | 251 | WB | Large T | B4002 |
| 246 | EESIQGGL | 0.464 | 328 | WB | Large T | B4002 |
| 177 | MEKYSVTF | 0.454 | 367 | WB | Large T | B4002 |
| 264 | EETKQVSW | 0.446 | 403 | WB | Large T | B4002 |
| 6 | REESMELM | 0.433 | 463 | WB | Large T | B4002 |
| 264 | EETKQVSW | 0.514 | 193 | WB | Large T | B4402 |
| 606 | SEISMYTF | 0.472 | 303 | WB | Large T | B4402 |
| 86 | TEEWESWW | 0.464 | 329 | WB | Large T | B4402 |
| 166 | KEKAQILY | 0.461 | 342 | WB | Large T | B4402 |
| 359 | EEMLTERF | 0.449 | 388 | WB | Large T | B4402 |
| 606 | SEISMYTF | 0.549 | 131 | WB | Large T | B4403 |
| 359 | EEMLTERF | 0.526 | 167 | WB | Large T | B4403 |
| 359 | EEMLTERF | 0.512 | 196 | WB | Large T | B4501 |
| 329 | AESKNQKS | 0.443 | 415 | WB | Large T | B4501 |
| 246 | EESIQGGL | 0.433 | 460 | WB | Large T | B4501 |
| 481 | AESKDLPS | 0.431 | 470 | WB | Large T | B4501 |
| 522 | FPPGLVTM | 0.629 | 55 | WB | Large T | B5101 |
| 453 | LPMERLTF | 0.621 | 60 | WB | Large T | B5101 |
| 399 | LPKMDSVI | 0.598 | 77 | WB | Large T | B5101 |
| 453 | LPMERLTF | 0.755 | 14 | SB | Large T | B5301 |
| 139 | FPSDLHQF | 0.729 | 18 | SB | Large T | B5301 |
| 26 | LPLMRKAY | 0.636 | 51 | WB | Large T | B5301 |
| 399 | LPKMDSVI | 0.632 | 53 | WB | Large T | B5301 |
| 522 | FPPGLVTM | 0.582 | 91 | WB | Large T | B5301 |
| 522 | FPPGLVTM | 0.577 | 97 | WB | Large T | B5401 |
| 322 | FANAIIFA | 0.511 | 198 | WB | Large T | B5401 |
| 26 | LPLMRKAY | 0.482 | 271 | WB | Large T | B5401 |
| 82 | PTYGTEEW | 0.517 | 186 | WB | Large T | B5701 |
| 93 | WSSFNEKW | 0.678 | 32 | SB | Large T | B5801 |
| 556 | KSLQNSEF | 0.602 | 74 | WB | Large T | B5801 |
| 593 | IQSRIVEW | 0.573 | 101 | WB | Large T | B5801 |
| 205 | RVSAINNF | 0.525 | 169 | WB | Large T | B5801 |
| 82 | PTYGTEEW | 0.504 | 215 | WB | Large T | B5801 |
| 66 | KVAHQPDF | 0.491 | 246 | WB | Large T | B5801 |
| 16 | LGLERAAW | 0.439 | 430 | WB | Large T | B5801 |
| 77 | NSSEVPTY | 0.431 | 469 | WB | Large T | B5801 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| | | | 9-mers | | | |
| 603 | RLDSEISMY | 0.648 | 44 | SB | Large T | A0101 |
| 226 | GVNKEYLLY | 0.477 | 286 | WB | Large T | A0101 |
| 234 | YSALTRDPY | 0.471 | 304 | WB | Large T | A0101 |
| | | | | | | |
| 409 | FLHCVVFNV | 0.891 | 3 | SB | Large T | A0201 |
| 405 | VIFDFLHCV | 0.842 | 5 | SB | Large T | A0201 |
| 215 | KLCTFSFLI | 0.747 | 15 | SB | Large T | A0201 |
| 198 | FLTPHRHRV | 0.693 | 27 | SB | Large T | A0201 |
| 578 | LLLIWFRPV | 0.690 | 28 | SB | Large T | A0201 |
| 384 | VLEQYMAGV | 0.680 | 31 | SB | Large T | A0201 |
| 557 | SLQNSEFLL | 0.658 | 40 | SB | Large T | A0201 |
| 397 | CLLPKMDSV | 0.639 | 49 | SB | Large T | A0201 |
| 569 | ILQSGMTLL | 0.614 | 64 | WB | Large T | A0201 |
| 175 | KLMEKYSVT | 0.580 | 94 | WB | Large T | A0201 |
| 435 | TLAAGLLDL | 0.578 | 95 | WB | Large T | A0201 |
| 361 | MLTERFNHI | 0.562 | 114 | WB | Large T | A0201 |
| 579 | LLIWFRPVA | 0.505 | 212 | WB | Large T | A0201 |
| 573 | GMTLLLLLI | 0.494 | 237 | WB | Large T | A0201 |
| 368 | HILDKMDLI | 0.488 | 254 | WB | Large T | A0201 |
| 621 | CMGKCILDI | 0.465 | 327 | WB | Large T | A0201 |
| 394 | WLHCLLPKM | 0.443 | 412 | WB | Large T | A0201 |
| 156 | TLACFAVYT | 0.437 | 440 | WB | Large T | A0201 |
| | | | | | | |
| 409 | FLHCVVFNV | 0.885 | 3 | SB | Large T | A0202 |
| 198 | FLTPHRHRV | 0.824 | 6 | SB | Large T | A0202 |
| 361 | MLTERFNHI | 0.774 | 11 | SB | Large T | A0202 |
| 569 | ILQSGMTLL | 0.765 | 12 | SB | Large T | A0202 |
| 405 | VIFDFLHCV | 0.742 | 16 | SB | Large T | A0202 |
| 384 | VLEQYMAGV | 0.728 | 19 | SB | Large T | A0202 |
| 494 | NLDSLRDYL | 0.687 | 29 | SB | Large T | A0202 |
| 557 | SLQNSEFLL | 0.676 | 33 | SB | Large T | A0202 |
| 570 | LQSGMTLLL | 0.676 | 33 | SB | Large T | A0202 |
| 397 | CLLPKMDSV | 0.658 | 40 | SB | Large T | A0202 |
| 402 | MDSVIFDFL | 0.642 | 48 | SB | Large T | A0202 |
| 215 | KLCTFSFLI | 0.640 | 49 | SB | Large T | A0202 |
| 497 | SLRDYLDGS | 0.630 | 54 | WB | Large T | A0202 |
| 463 | GVAIDQYMV | 0.614 | 65 | WB | Large T | A0202 |
| 435 | TLAAGLLDL | 0.605 | 71 | WB | Large T | A0202 |
| 175 | KLMEKYSVT | 0.560 | 116 | WB | Large T | A0202 |
| 573 | GMTLLLLLI | 0.558 | 119 | WB | Large T | A0202 |
| 156 | TLACFAVYT | 0.554 | 124 | WB | Large T | A0202 |
| 289 | LLGMYLEFQ | 0.542 | 142 | WB | Large T | A0202 |
| 648 | SQSQCSSQV | 0.542 | 142 | WB | Large T | A0202 |
| 391 | GVAWLHCLL | 0.529 | 163 | WB | Large T | A0202 |
| 219 | FSFLICKGV | 0.528 | 165 | WB | Large T | A0202 |
| 208 | AINNFCQKL | 0.524 | 173 | WB | Large T | A0202 |
| 191 | AGHNIIFFL | 0.514 | 191 | WB | Large T | A0202 |
| 111 | FASDEEATA | 0.506 | 208 | WB | Large T | A0202 |
| 139 | FPSDLHQFL | 0.505 | 211 | WB | Large T | A0202 |
| 236 | ALTRDPYHI | 0.501 | 220 | WB | Large T | A0202 |
| 589 | FSKDIQSRI | 0.499 | 226 | WB | Large T | A0202 |
| 526 | LVTMNEYPV | 0.493 | 240 | WB | Large T | A0202 |
| 146 | FLSQAVFSN | 0.480 | 278 | WB | Large T | A0202 |
| 578 | LLLIWFRPV | 0.466 | 321 | WB | Large T | A0202 |
| 377 | FGAHGNAVL | 0.465 | 327 | WB | Large T | A0202 |
| 458 | LTFELGVAI | 0.452 | 376 | WB | Large T | A0202 |
| 572 | SGMTLLLLL | 0.450 | 385 | WB | Large T | A0202 |
| 398 | LLPKMDSVI | 0.448 | 392 | WB | Large T | A0202 |
| 368 | HILDKMDLI | 0.438 | 438 | WB | Large T | A0202 |
| | | | | | | |
| 409 | FLHCVVFNV | 0.911 | 2 | SB | Large T | A0203 |
| 198 | FLTPHRHRV | 0.891 | 3 | SB | Large T | A0203 |
| 361 | MLTERFNHI | 0.884 | 3 | SB | Large T | A0203 |
| 384 | VLEQYMAGV | 0.838 | 5 | SB | Large T | A0203 |
| 578 | LLLIWFRPV | 0.819 | 7 | SB | Large T | A0203 |
| 397 | CLLPKMDSV | 0.815 | 7 | SB | Large T | A0203 |
| 569 | ILQSGMTLL | 0.803 | 8 | SB | Large T | A0203 |
| 405 | VIFDFLHCV | 0.796 | 9 | SB | Large T | A0203 |
| 435 | TLAAGLLDL | 0.744 | 16 | SB | Large T | A0203 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 175 | KLMEKYSVT | 0.694 | 27 | SB | Large T | A0203 |
| 457 | RLTFELGVA | 0.683 | 30 | SB | Large T | A0203 |
| 497 | SLRDYLDGS | 0.596 | 79 | WB | Large T | A0203 |
| 579 | LLIWFRPVA | 0.575 | 99 | WB | Large T | A0203 |
| 553 | YLRKSLQNS | 0.569 | 105 | WB | Large T | A0203 |
| 215 | KLCTFSFLI | 0.566 | 108 | WB | Large T | A0203 |
| 236 | ALTRDPYHI | 0.540 | 144 | WB | Large T | A0203 |
| 375 | LIFGAHGNA | 0.540 | 145 | WB | Large T | A0203 |
| 573 | GMTLLLLLI | 0.537 | 150 | WB | Large T | A0203 |
| 570 | LQSGMTLLL | 0.528 | 165 | WB | Large T | A0203 |
| 156 | TLACFAVYT | 0.527 | 166 | WB | Large T | A0203 |
| 648 | SQSQCSSQV | 0.520 | 179 | WB | Large T | A0203 |
| 391 | GVAWLHCLL | 0.517 | 185 | WB | Large T | A0203 |
| 398 | LLPKMDSVI | 0.516 | 188 | WB | Large T | A0203 |
| 394 | WLHCLLPKM | 0.513 | 194 | WB | Large T | A0203 |
| 464 | VAIDQYMVV | 0.512 | 195 | WB | Large T | A0203 |
| 188 | HMCAGHNII | 0.510 | 199 | WB | Large T | A0203 |
| 519 | TQIFPPGLV | 0.506 | 210 | WB | Large T | A0203 |
| 208 | AINNFCQKL | 0.501 | 220 | WB | Large T | A0203 |
| 368 | HILDKMDLI | 0.496 | 232 | WB | Large T | A0203 |
| 20 | RAAWGNLPL | 0.491 | 246 | WB | Large T | A0203 |
| 53 | RMNTLYKKM | 0.490 | 249 | WB | Large T | A0203 |
| 568 | RILQSGMTL | 0.485 | 263 | WB | Large T | A0203 |
| 538 | LQARFVRQI | 0.458 | 352 | WB | Large T | A0203 |
| 289 | LLGMYLEFQ | 0.456 | 360 | WB | Large T | A0203 |
| 557 | SLQNSEFLL | 0.447 | 396 | WB | Large T | A0203 |
| 596 | RIVEWKERL | 0.441 | 423 | WB | Large T | A0203 |
| 463 | GVAIDQYMV | 0.432 | 464 | WB | Large T | A0203 |
| 198 | FLTPHRHRV | 0.766 | 12 | SB | Large T | A0204 |
| 409 | FLHCVVFNV | 0.744 | 15 | SB | Large T | A0204 |
| 405 | VIFDFLHCV | 0.645 | 46 | SB | Large T | A0204 |
| 578 | LLLIWFRPV | 0.640 | 48 | SB | Large T | A0204 |
| 384 | VLEQYMAGV | 0.607 | 70 | WB | Large T | A0204 |
| 464 | VAIDQYMVV | 0.564 | 111 | WB | Large T | A0204 |
| 557 | SLQNSEFLL | 0.552 | 127 | WB | Large T | A0204 |
| 59 | KKMEQDVKV | 0.514 | 191 | WB | Large T | A0204 |
| 526 | LVTMNEYPV | 0.512 | 196 | WB | Large T | A0204 |
| 435 | TLAAGLLDL | 0.489 | 251 | WB | Large T | A0204 |
| 292 | MYLEFQYNV | 0.488 | 255 | WB | Large T | A0204 |
| 569 | ILQSGMTLL | 0.485 | 264 | WB | Large T | A0204 |
| 208 | AINNFCQKL | 0.474 | 296 | WB | Large T | A0204 |
| 397 | CLLPKMDSV | 0.468 | 315 | WB | Large T | A0204 |
| 175 | KLMEKYSVT | 0.464 | 329 | WB | Large T | A0204 |
| 361 | MLTERFNHI | 0.447 | 395 | WB | Large T | A0204 |
| 236 | ALTRDPYHI | 0.447 | 398 | WB | Large T | A0204 |
| 215 | KLCTFSFLI | 0.445 | 404 | WB | Large T | A0204 |
| 361 | MLTERFNHI | 0.848 | 5 | SB | Large T | A0206 |
| 397 | CLLPKMDSV | 0.834 | 6 | SB | Large T | A0206 |
| 409 | FLHCVVFNV | 0.819 | 7 | SB | Large T | A0206 |
| 578 | LLLIWFRPV | 0.801 | 8 | SB | Large T | A0206 |
| 198 | FLTPHRHRV | 0.793 | 9 | SB | Large T | A0206 |
| 405 | VIFDFLHCV | 0.746 | 15 | SB | Large T | A0206 |
| 544 | RQIDFRPKI | 0.739 | 16 | SB | Large T | A0206 |
| 648 | SQSQCSSQV | 0.729 | 18 | SB | Large T | A0206 |
| 384 | VLEQYMAGV | 0.692 | 27 | SB | Large T | A0206 |
| 570 | LQSGMTLLL | 0.683 | 30 | SB | Large T | A0206 |
| 596 | RIVEWKERL | 0.674 | 34 | SB | Large T | A0206 |
| 568 | RILQSGMTL | 0.638 | 50 | WB | Large T | A0206 |
| 20 | RAAWGNLPL | 0.634 | 52 | WB | Large T | A0206 |
| 435 | TLAAGLLDL | 0.583 | 91 | WB | Large T | A0206 |
| 215 | KLCTFSFLI | 0.560 | 116 | WB | Large T | A0206 |
| 464 | VAIDQYMVV | 0.560 | 117 | WB | Large T | A0206 |
| 368 | HILDKMDLI | 0.550 | 130 | WB | Large T | A0206 |
| 339 | QQAVDTVLA | 0.549 | 131 | WB | Large T | A0206 |
| 569 | ILQSGMTLL | 0.520 | 180 | WB | Large T | A0206 |
| 111 | FASDEEATA | 0.520 | 180 | WB | Large T | A0206 |
| 267 | KQVSWKLIT | 0.516 | 188 | WB | Large T | A0206 |
| 579 | LLIWFRPVA | 0.507 | 206 | WB | Large T | A0206 |
| 458 | LTFELGVAI | 0.503 | 216 | WB | Large T | A0206 |
| 10 | MELMDLLGL | 0.496 | 233 | WB | Large T | A0206 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pospeptide | logscore | affinity (nM) | Bind Level | Protein Name | Allele |
|---|---|---|---|---|---|
| 391 GVAWLHCLL | 0.476 | 291 | WB | Large T | A0206 |
| 287 FLLLGMYLE | 0.473 | 298 | WB | Large T | A0206 |
| 519 TQIFPPGLV | 0.470 | 308 | WB | Large T | A0206 |
| 288 LLLGMYLEF | 0.469 | 312 | WB | Large T | A0206 |
| 447 KALNVNLPM | 0.457 | 357 | WB | Large T | A0206 |
| 21 AAWGNLPLM | 0.457 | 357 | WB | Large T | A0206 |
| 394 WLHCLLPKM | 0.451 | 379 | WB | Large T | A0206 |
| 526 LVTMNEYPV | 0.441 | 421 | WB | Large T | A0206 |
| 175 KLMEKYSVT | 0.439 | 432 | WB | Large T | A0206 |
| 148 SQAVFSNRT | 0.438 | 437 | WB | Large T | A0206 |
| 198 FLTPHRHRV | 0.978 | 1 | SB | Large T | A0211 |
| 405 VIFDFLHCV | 0.968 | 1 | SB | Large T | A0211 |
| 409 FLHCVVFNV | 0.933 | 2 | SB | Large T | A0211 |
| 397 CLLPKMDSV | 0.929 | 2 | SB | Large T | A0211 |
| 384 VLEQYMAGV | 0.926 | 2 | SB | Large T | A0211 |
| 557 SLQNSEFLL | 0.912 | 2 | SB | Large T | A0211 |
| 494 NLDSLRDYL | 0.903 | 2 | SB | Large T | A0211 |
| 569 ILQSGMTLL | 0.890 | 3 | SB | Large T | A0211 |
| 435 TLAAGLLDL | 0.890 | 3 | SB | Large T | A0211 |
| 215 KLCTFSFLI | 0.876 | 3 | SB | Large T | A0211 |
| 578 LLLIWFRPV | 0.862 | 4 | SB | Large T | A0211 |
| 563 FLLEKRILQ | 0.862 | 4 | SB | Large T | A0211 |
| 579 LLIWFRPVA | 0.849 | 5 | SB | Large T | A0211 |
| 292 MYLEFQYNV | 0.832 | 6 | SB | Large T | A0211 |
| 388 YMAGVAWLH | 0.799 | 8 | SB | Large T | A0211 |
| 463 GVAIDQYMV | 0.796 | 9 | SB | Large T | A0211 |
| 428 PIDSGKTTL | 0.778 | 11 | SB | Large T | A0211 |
| 573 GMTLLLLLI | 0.771 | 11 | SB | Large T | A0211 |
| 500 DYLDGSVKV | 0.751 | 14 | SB | Large T | A0211 |
| 454 PMERLTFEL | 0.736 | 17 | SB | Large T | A0211 |
| 288 LLLGMYLEF | 0.733 | 17 | SB | Large T | A0211 |
| 526 LVTMNEYPV | 0.733 | 18 | SB | Large T | A0211 |
| 391 GVAWLHCLL | 0.725 | 19 | SB | Large T | A0211 |
| 464 VAIDQYMVV | 0.721 | 20 | SB | Large T | A0211 |
| 568 RILQSGMTL | 0.720 | 20 | SB | Large T | A0211 |
| 142 DLHQFLSQA | 0.703 | 24 | SB | Large T | A0211 |
| 361 MLTERFNHI | 0.692 | 28 | SB | Large T | A0211 |
| 236 ALTRDPYHI | 0.685 | 30 | SB | Large T | A0211 |
| 596 RIVEWKERL | 0.685 | 30 | SB | Large T | A0211 |
| 156 TLACFAVYT | 0.663 | 38 | SB | Large T | A0211 |
| 287 FLLLGMYLE | 0.659 | 40 | SB | Large T | A0211 |
| 208 AINNFCQKL | 0.637 | 50 | WB | Large T | A0211 |
| 575 TLLLLLIWF | 0.632 | 53 | WB | Large T | A0211 |
| 20 RAAWGNLPL | 0.620 | 61 | WB | Large T | A0211 |
| 14 DLLGLERAA | 0.614 | 65 | WB | Large T | A0211 |
| 289 LLGMYLEFQ | 0.602 | 74 | WB | Large T | A0211 |
| 603 RLDSEISMY | 0.592 | 82 | WB | Large T | A0211 |
| 368 HILDKMDLI | 0.590 | 84 | WB | Large T | A0211 |
| 576 LLLLLIWFR | 0.575 | 99 | WB | Large T | A0211 |
| 394 WLHCLLPKM | 0.569 | 106 | WB | Large T | A0211 |
| 353 TLHMTREEM | 0.558 | 119 | WB | Large T | A0211 |
| 273 LITEYAVET | 0.545 | 137 | WB | Large T | A0211 |
| 398 LLPKMDSVI | 0.535 | 152 | WB | Large T | A0211 |
| 401 KMDSVIFDF | 0.531 | 160 | WB | Large T | A0211 |
| 146 FLSQAVFSN | 0.527 | 166 | WB | Large T | A0211 |
| 188 HMCAGHNII | 0.524 | 172 | WB | Large T | A0211 |
| 406 IFDFLHCVV | 0.519 | 181 | WB | Large T | A0211 |
| 648 SQSQCSSQV | 0.514 | 191 | WB | Large T | A0211 |
| 458 LTFELGVAI | 0.508 | 204 | WB | Large T | A0211 |
| 497 SLRDYLDGS | 0.503 | 216 | WB | Large T | A0211 |
| 501 YLDGSVKVN | 0.501 | 220 | WB | Large T | A0211 |
| 171 ILYKKLMEK | 0.485 | 264 | WB | Large T | A0211 |
| 73 FGTWNSSEV | 0.481 | 274 | WB | Large T | A0211 |
| 609 SMYTFSRMK | 0.474 | 295 | WB | Large T | A0211 |
| 416 NVPKRRYWL | 0.464 | 330 | WB | Large T | A0211 |
| 109 DMFASDEEA | 0.459 | 346 | WB | Large T | A0211 |
| 139 FPSDLHQFL | 0.459 | 349 | WB | Large T | A0211 |
| 439 GLLDLCGGK | 0.452 | 377 | WB | Large T | A0211 |
| 465 AIDQYMVVF | 0.449 | 389 | WB | Large T | A0211 |
| 21 AAWGNLPLM | 0.448 | 394 | WB | Large T | A0211 |
| 521 IFPPGLVTM | 0.438 | 438 | WB | Large T | A0211 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 175 | KLMEKYSVT | 0.437 | 440 | WB | Large T | A0211 |
| 457 | RLTFELGVA | 0.430 | 478 | WB | Large T | A0211 |
| 150 | AVFSNRTLA | 0.428 | 486 | WB | Large T | A0211 |
| 198 | FLTPHRHRV | 0.950 | 1 | SB | Large T | A0212 |
| 405 | VIFDFLHCV | 0.944 | 1 | SB | Large T | A0212 |
| 384 | VLEQYMAGV | 0.915 | 2 | SB | Large T | A0212 |
| 397 | CLLPKMDSV | 0.909 | 2 | SB | Large T | A0212 |
| 409 | FLHCVVFNV | 0.905 | 2 | SB | Large T | A0212 |
| 435 | TLAAGLLDL | 0.836 | 5 | SB | Large T | A0212 |
| 569 | ILQSGMTLL | 0.822 | 6 | SB | Large T | A0212 |
| 292 | MYLEFQYNV | 0.776 | 11 | SB | Large T | A0212 |
| 578 | LLLIWFRPV | 0.774 | 11 | SB | Large T | A0212 |
| 557 | SLQNSEFLL | 0.763 | 12 | SB | Large T | A0212 |
| 563 | FLLEKRILQ | 0.736 | 17 | SB | Large T | A0212 |
| 464 | VAIDQYMVV | 0.723 | 20 | SB | Large T | A0212 |
| 494 | NLDSLRDYL | 0.711 | 22 | SB | Large T | A0212 |
| 361 | MLTERFNHI | 0.692 | 27 | SB | Large T | A0212 |
| 579 | LLIWFRPVA | 0.684 | 30 | SB | Large T | A0212 |
| 288 | LLLGMYLEF | 0.636 | 51 | WB | Large T | A0212 |
| 497 | SLRDYLDGS | 0.636 | 51 | WB | Large T | A0212 |
| 215 | KLCTFSFLI | 0.619 | 61 | WB | Large T | A0212 |
| 596 | RIVEWKERL | 0.610 | 68 | WB | Large T | A0212 |
| 388 | YMAGVAWLH | 0.607 | 69 | WB | Large T | A0212 |
| 287 | FLLLGMYLE | 0.598 | 77 | WB | Large T | A0212 |
| 428 | PIDSGKTTL | 0.561 | 115 | WB | Large T | A0212 |
| 14 | DLLGLERAA | 0.548 | 133 | WB | Large T | A0212 |
| 454 | PMERLTFEL | 0.545 | 137 | WB | Large T | A0212 |
| 526 | LVTMNEYPV | 0.533 | 155 | WB | Large T | A0212 |
| 458 | LTFELGVAI | 0.531 | 160 | WB | Large T | A0212 |
| 236 | ALTRDPYHI | 0.525 | 171 | WB | Large T | A0212 |
| 208 | AINNFCQKL | 0.521 | 177 | WB | Large T | A0212 |
| 500 | DYLDGSVKV | 0.517 | 185 | WB | Large T | A0212 |
| 111 | FASDEEATA | 0.507 | 206 | WB | Large T | A0212 |
| 289 | LLGMYLEFQ | 0.505 | 212 | WB | Large T | A0212 |
| 188 | HMCAGHNII | 0.504 | 214 | WB | Large T | A0212 |
| 368 | HILDKMDLI | 0.496 | 232 | WB | Large T | A0212 |
| 398 | LLPKMDSVI | 0.494 | 239 | WB | Large T | A0212 |
| 463 | GVAIDQYMV | 0.481 | 275 | WB | Large T | A0212 |
| 401 | KMDSVIFDF | 0.477 | 286 | WB | Large T | A0212 |
| 171 | ILYKKLMEK | 0.476 | 289 | WB | Large T | A0212 |
| 568 | RILQSGMTL | 0.453 | 370 | WB | Large T | A0212 |
| 139 | FPSDLHQFL | 0.450 | 385 | WB | Large T | A0212 |
| 394 | WLHCLLPKM | 0.439 | 434 | WB | Large T | A0212 |
| 198 | FLTPHRHRV | 0.957 | 1 | SB | Large T | A0216 |
| 405 | VIFDFLHCV | 0.924 | 2 | SB | Large T | A0216 |
| 384 | VLEQYMAGV | 0.898 | 2 | SB | Large T | A0216 |
| 397 | CLLPKMDSV | 0.898 | 3 | SB | Large T | A0216 |
| 409 | FLHCVVFNV | 0.881 | 3 | SB | Large T | A0216 |
| 569 | ILQSGMTLL | 0.861 | 4 | SB | Large T | A0216 |
| 494 | NLDSLRDYL | 0.860 | 4 | SB | Large T | A0216 |
| 557 | SLQNSEFLL | 0.844 | 5 | SB | Large T | A0216 |
| 454 | PMERLTFEL | 0.756 | 13 | SB | Large T | A0216 |
| 428 | PIDSGKTTL | 0.749 | 15 | SB | Large T | A0216 |
| 578 | LLLIWFRPV | 0.694 | 27 | SB | Large T | A0216 |
| 435 | TLAAGLLDL | 0.679 | 32 | SB | Large T | A0216 |
| 526 | LVTMNEYPV | 0.669 | 36 | SB | Large T | A0216 |
| 289 | LLGMYLEFQ | 0.657 | 40 | SB | Large T | A0216 |
| 215 | KLCTFSFLI | 0.657 | 41 | SB | Large T | A0216 |
| 142 | DLHQFLSQA | 0.655 | 41 | SB | Large T | A0216 |
| 292 | MYLEFQYNV | 0.655 | 41 | SB | Large T | A0216 |
| 563 | FLLEKRILQ | 0.646 | 45 | SB | Large T | A0216 |
| 596 | RIVEWKERL | 0.646 | 46 | SB | Large T | A0216 |
| 236 | ALTRDPYHI | 0.645 | 46 | SB | Large T | A0216 |
| 416 | NVPKRRYWL | 0.628 | 55 | WB | Large T | A0216 |
| 463 | GVAIDQYMV | 0.626 | 57 | WB | Large T | A0216 |
| 361 | MLTERFNHI | 0.601 | 74 | WB | Large T | A0216 |
| 156 | TLACFAVYT | 0.590 | 84 | WB | Large T | A0216 |
| 208 | AINNFCQKL | 0.578 | 96 | WB | Large T | A0216 |
| 568 | RILQSGMTL | 0.574 | 99 | WB | Large T | A0216 |
| 500 | DYLDGSVKV | 0.539 | 146 | WB | Large T | A0216 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 398 | LLPKMDSVI | 0.537 | 149 | WB | Large T | A0216 |
| 579 | LLIWFRPVA | 0.529 | 163 | WB | Large T | A0216 |
| 391 | GVAWLHCLL | 0.519 | 181 | WB | Large T | A0216 |
| 353 | TLHMTREEM | 0.510 | 200 | WB | Large T | A0216 |
| 619 | NICMGKCIL | 0.500 | 224 | WB | Large T | A0216 |
| 648 | SQSQCSSQV | 0.495 | 236 | WB | Large T | A0216 |
| 171 | ILYKKLMEK | 0.463 | 333 | WB | Large T | A0216 |
| 464 | VAIDQYMVV | 0.456 | 359 | WB | Large T | A0216 |
| 188 | HMCAGHNII | 0.440 | 428 | WB | Large T | A0216 |
| 368 | HILDKMDLI | 0.426 | 497 | WB | Large T | A0216 |
| 198 | FLTPHRHRV | 0.947 | 1 | SB | Large T | A0219 |
| 405 | VIFDFLHCV | 0.932 | 2 | SB | Large T | A0219 |
| 409 | FLHCVVFNV | 0.879 | 3 | SB | Large T | A0219 |
| 397 | CLLPKMDSV | 0.868 | 4 | SB | Large T | A0219 |
| 569 | ILQSGMTLL | 0.849 | 5 | SB | Large T | A0219 |
| 435 | TLAAGLLDL | 0.795 | 9 | SB | Large T | A0219 |
| 384 | VLEQYMAGV | 0.766 | 12 | SB | Large T | A0219 |
| 494 | NLDSLRDYL | 0.716 | 21 | SB | Large T | A0219 |
| 428 | PIDSGKTTL | 0.697 | 26 | SB | Large T | A0219 |
| 557 | SLQNSEFLL | 0.621 | 60 | WB | Large T | A0219 |
| 578 | LLLIWFRPV | 0.588 | 86 | WB | Large T | A0219 |
| 292 | MYLEFQYNV | 0.530 | 162 | WB | Large T | A0219 |
| 526 | LVTMNEYPV | 0.519 | 182 | WB | Large T | A0219 |
| 361 | MLTERFNHI | 0.518 | 183 | WB | Large T | A0219 |
| 500 | DYLDGSVKV | 0.508 | 205 | WB | Large T | A0219 |
| 21 | AAWGNLPLM | 0.506 | 209 | WB | Large T | A0219 |
| 454 | PMERLTFEL | 0.461 | 340 | WB | Large T | A0219 |
| 236 | ALTRDPYHI | 0.459 | 349 | WB | Large T | A0219 |
| 146 | FLSQAVFSN | 0.428 | 486 | WB | Large T | A0219 |
| 171 | ILYKKLMEK | 0.858 | 4 | SB | Large T | A0301 |
| 609 | SMYTFSRMK | 0.762 | 13 | SB | Large T | A0301 |
| 28 | LMRKAYLKK | 0.703 | 24 | SB | Large T | A0301 |
| 195 | IIFFLTPHR | 0.658 | 40 | SB | Large T | A0301 |
| 50 | KMKRMNTLY | 0.654 | 42 | SB | Large T | A0301 |
| 217 | CTFSFLICK | 0.640 | 49 | SB | Large T | A0301 |
| 221 | FLICKGVNK | 0.633 | 52 | WB | Large T | A0301 |
| 528 | TMNEYPVPK | 0.599 | 76 | WB | Large T | A0301 |
| 155 | RTLACFAVY | 0.595 | 79 | WB | Large T | A0301 |
| 27 | PLMRKAYLK | 0.578 | 96 | WB | Large T | A0301 |
| 226 | GVNKEYLLY | 0.545 | 137 | WB | Large T | A0301 |
| 121 | SQHSTPPKK | 0.490 | 248 | WB | Large T | A0301 |
| 231 | YLLYSALTR | 0.475 | 294 | WB | Large T | A0301 |
| 341 | AVDTVLAKK | 0.472 | 302 | WB | Large T | A0301 |
| 576 | LLLLLIWFR | 0.467 | 318 | WB | Large T | A0301 |
| 668 | HSQELHLCK | 0.464 | 331 | WB | Large T | A0301 |
| 504 | GSVKVNLEK | 0.452 | 376 | WB | Large T | A0301 |
| 509 | NLEKKHLNK | 0.452 | 377 | WB | Large T | A0301 |
| 350 | RVDTLHMTR | 0.444 | 409 | WB | Large T | A0301 |
| 603 | RLDSEISMY | 0.433 | 461 | WB | Large T | A0301 |
| 217 | CTFSFLICK | 0.826 | 6 | SB | Large T | A1101 |
| 528 | TMNEYPVPK | 0.817 | 7 | SB | Large T | A1101 |
| 609 | SMYTFSRMK | 0.802 | 8 | SB | Large T | A1101 |
| 207 | SAINNFCQK | 0.774 | 11 | SB | Large T | A1101 |
| 171 | ILYKKLMEK | 0.747 | 15 | SB | Large T | A1101 |
| 668 | HSQELHLCK | 0.730 | 18 | SB | Large T | A1101 |
| 341 | AVDTVLAKK | 0.703 | 24 | SB | Large T | A1101 |
| 195 | IIFFLTPHR | 0.686 | 30 | SB | Large T | A1101 |
| 504 | GSVKVNLEK | 0.679 | 32 | SB | Large T | A1101 |
| 121 | SQHSTPPKK | 0.674 | 33 | SB | Large T | A1101 |
| 147 | LSQAVFSNR | 0.654 | 42 | SB | Large T | A1101 |
| 536 | KTLQARFVR | 0.650 | 44 | SB | Large T | A1101 |
| 155 | RTLACFAVY | 0.646 | 46 | SB | Large T | A1101 |
| 340 | QAVDTVLAK | 0.602 | 74 | WB | Large T | A1101 |
| 505 | SVKVNLEKK | 0.583 | 91 | WB | Large T | A1101 |
| 27 | PLMRKAYLK | 0.576 | 98 | WB | Large T | A1101 |
| 120 | DSQHSTPPK | 0.567 | 108 | WB | Large T | A1101 |
| 393 | AWLHCLLPK | 0.566 | 109 | WB | Large T | A1101 |
| 413 | VVFNVPKRR | 0.559 | 118 | WB | Large T | A1101 |
| 439 | GLLDLCGGK | 0.551 | 129 | WB | Large T | A1101 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 324 | NAIIFAESK | 0.539 | 146 | WB | Large T | A1101 |
| 350 | RVDTLHMTR | 0.529 | 163 | WB | Large T | A1101 |
| 226 | GVNKEYLLY | 0.518 | 184 | WB | Large T | A1101 |
| 607 | EISMYTFSR | 0.496 | 233 | WB | Large T | A1101 |
| 274 | ITEYAVETK | 0.491 | 247 | WB | Large T | A1101 |
| 593 | IQSRIVEWK | 0.489 | 252 | WB | Large T | A1101 |
| 491 | GINNLDSLR | 0.488 | 254 | WB | Large T | A1101 |
| 296 | FQYNVEECK | 0.478 | 285 | WB | Large T | A1101 |
| 576 | LLLLLIWFR | 0.466 | 321 | WB | Large T | A1101 |
| 91 | SWWSSFNEK | 0.461 | 340 | WB | Large T | A1101 |
| 158 | ACFAVYTTK | 0.456 | 360 | WB | Large T | A1101 |
| 221 | FLICKGVNK | 0.446 | 399 | WB | Large T | A1101 |
| 32 | AYLKKCKEF | 0.708 | 23 | SB | Large T | A2301 |
| 581 | IWFRPVADF | 0.678 | 32 | SB | Large T | A2301 |
| 312 | PYHFKYHEK | 0.647 | 45 | SB | Large T | A2301 |
| 91 | SWWSSFNEK | 0.552 | 126 | WB | Large T | A2301 |
| 387 | QYMAGVAWL | 0.546 | 135 | WB | Large T | A2301 |
| 190 | CAGHNIIFF | 0.527 | 166 | WB | Large T | A2301 |
| 401 | KMDSVIFDF | 0.522 | 176 | WB | Large T | A2301 |
| 286 | VFLLLGMYL | 0.518 | 183 | WB | Large T | A2301 |
| 292 | MYLEFQYNV | 0.512 | 196 | WB | Large T | A2301 |
| 138 | DFPSDLHQF | 0.501 | 220 | WB | Large T | A2301 |
| 314 | HFKYHEKHF | 0.501 | 222 | WB | Large T | A2301 |
| 575 | TLLLLLIWF | 0.496 | 233 | WB | Large T | A2301 |
| 213 | CQKLCTFSF | 0.485 | 263 | WB | Large T | A2301 |
| 393 | AWLHCLLPK | 0.471 | 305 | WB | Large T | A2301 |
| 288 | LLLGMYLEF | 0.464 | 331 | WB | Large T | A2301 |
| 320 | KHFANAIIF | 0.463 | 334 | WB | Large T | A2301 |
| 327 | IFAESKNQK | 0.458 | 352 | WB | Large T | A2301 |
| 610 | MYTFSRMKY | 0.455 | 365 | WB | Large T | A2301 |
| 211 | NFCQKLCTF | 0.454 | 368 | WB | Large T | A2301 |
| 612 | TFSRMKYNI | 0.440 | 427 | WB | Large T | A2301 |
| 88 | EWESWWSSF | 0.597 | 78 | WB | Large T | A2402 |
| 387 | QYMAGVAWL | 0.587 | 87 | WB | Large T | A2402 |
| 138 | DFPSDLHQF | 0.544 | 138 | WB | Large T | A2402 |
| 241 | PYHIIEESI | 0.536 | 150 | WB | Large T | A2402 |
| 32 | AYLKKCKEF | 0.523 | 174 | WB | Large T | A2402 |
| 581 | IWFRPVADF | 0.503 | 216 | WB | Large T | A2402 |
| 468 | QYMVVFEDV | 0.502 | 219 | WB | Large T | A2402 |
| 612 | TFSRMKYNI | 0.451 | 381 | WB | Large T | A2402 |
| 286 | VFLLLGMYL | 0.434 | 456 | WB | Large T | A2402 |
| 417 | VPKRRYWLF | 0.432 | 466 | WB | Large T | A2402 |
| 32 | AYLKKCKEF | 0.859 | 4 | SB | Large T | A2403 |
| 387 | QYMAGVAWL | 0.773 | 11 | SB | Large T | A2403 |
| 138 | DFPSDLHQF | 0.618 | 62 | WB | Large T | A2403 |
| 320 | KHFANAIIF | 0.569 | 105 | WB | Large T | A2403 |
| 521 | IFPPGLVTM | 0.551 | 129 | WB | Large T | A2403 |
| 68 | AHQPDFGTW | 0.542 | 142 | WB | Large T | A2403 |
| 286 | VFLLLGMYL | 0.532 | 158 | WB | Large T | A2403 |
| 581 | IWFRPVADF | 0.506 | 209 | WB | Large T | A2403 |
| 401 | KMDSVIFDF | 0.462 | 338 | WB | Large T | A2403 |
| 190 | CAGHNIIFF | 0.458 | 351 | WB | Large T | A2403 |
| 468 | QYMVVFEDV | 0.446 | 400 | WB | Large T | A2403 |
| 211 | NFCQKLCTF | 0.433 | 461 | WB | Large T | A2403 |
| 285 | DVFLLLGMY | 0.689 | 29 | SB | Large T | A2601 |
| 265 | ETKQVSWKL | 0.506 | 209 | WB | Large T | A2601 |
| 8 | ESMELMDLL | 0.463 | 335 | WB | Large T | A2601 |
| 285 | DVFLLLGMY | 0.923 | 2 | SB | Large T | A2602 |
| 465 | AIDQYMVVF | 0.801 | 8 | SB | Large T | A2602 |
| 280 | ETKCEDVFL | 0.742 | 16 | SB | Large T | A2602 |
| 545 | QIDFRPKIY | 0.724 | 19 | SB | Large T | A2602 |
| 138 | DFPSDLHQF | 0.617 | 63 | WB | Large T | A2602 |
| 226 | GVNKEYLLY | 0.612 | 66 | WB | Large T | A2602 |
| 155 | RTLACFAVY | 0.609 | 68 | WB | Large T | A2602 |
| 152 | FSNRTLACF | 0.590 | 84 | WB | Large T | A2602 |
| 265 | ETKQVSWKL | 0.518 | 183 | WB | Large T | A2602 |
| 8 | ESMELMDLL | 0.476 | 290 | WB | Large T | A2602 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 103 | DLFCHEDMF | 0.457 | 358 | WB | Large T | A2602 |
| 450 | NVNLPMERL | 0.447 | 396 | WB | Large T | A2602 |
| 164 | TTKEKAQIL | 0.437 | 441 | WB | Large T | A2602 |
| 290 | LGMYLEFQY | 0.593 | 81 | WB | Large T | A2902 |
| 50 | KMKRMNTLY | 0.576 | 98 | WB | Large T | A2902 |
| 269 | VSWKLITEY | 0.552 | 127 | WB | Large T | A2902 |
| 285 | DVFLLLGMY | 0.538 | 148 | WB | Large T | A2902 |
| 226 | GVNKEYLLY | 0.508 | 204 | WB | Large T | A2902 |
| 610 | MYTFSRMKY | 0.474 | 295 | WB | Large T | A2902 |
| 414 | VFNVPKRRY | 0.429 | 480 | WB | Large T | A2902 |
| 28 | LMRKAYLKK | 0.830 | 6 | SB | Large T | A3001 |
| 51 | MKRMNTLYK | 0.827 | 6 | SB | Large T | A3001 |
| 36 | KCKEFHPDK | 0.817 | 7 | SB | Large T | A3001 |
| 418 | PKRRYWLFK | 0.813 | 7 | SB | Large T | A3001 |
| 121 | SQHSTPPKK | 0.755 | 14 | SB | Large T | A3001 |
| 682 | KRPKTPPPK | 0.723 | 19 | SB | Large T | A3001 |
| 528 | TMNEYPVPK | 0.716 | 21 | SB | Large T | A3001 |
| 677 | GFQCFKRPK | 0.683 | 30 | SB | Large T | A3001 |
| 120 | DSQHSTPPK | 0.675 | 33 | SB | Large T | A3001 |
| 674 | LCKGFQCFK | 0.669 | 36 | SB | Large T | A3001 |
| 129 | KKRKVEDPK | 0.666 | 37 | SB | Large T | A3001 |
| 158 | ACFAVYTTK | 0.657 | 40 | SB | Large T | A3001 |
| 536 | KTLQARFVR | 0.637 | 51 | WB | Large T | A3001 |
| 505 | SVKVNLEKK | 0.634 | 52 | WB | Large T | A3001 |
| 609 | SMYTFSRMK | 0.598 | 77 | WB | Large T | A3001 |
| 166 | KEKAQILYK | 0.579 | 95 | WB | Large T | A3001 |
| 312 | PYHFKYHEK | 0.574 | 100 | WB | Large T | A3001 |
| 195 | IIFFLTPHR | 0.569 | 105 | WB | Large T | A3001 |
| 393 | AWLHCLLPK | 0.519 | 181 | WB | Large T | A3001 |
| 50 | KMKRMNTLY | 0.501 | 220 | WB | Large T | A3001 |
| 340 | QAVDTVLAK | 0.481 | 273 | WB | Large T | A3001 |
| 274 | ITEYAVETK | 0.481 | 274 | WB | Large T | A3001 |
| 124 | STPPKKKRK | 0.478 | 282 | WB | Large T | A3001 |
| 171 | ILYKKLMEK | 0.467 | 318 | WB | Large T | A3001 |
| 411 | HCVVFNVPK | 0.465 | 325 | WB | Large T | A3001 |
| 27 | PLMRKAYLK | 0.439 | 431 | WB | Large T | A3001 |
| 544 | RQIDFRPKI | 0.437 | 440 | WB | Large T | A3001 |
| 668 | HSQELHLCK | 0.436 | 445 | WB | Large T | A3001 |
| 52 | KRMNTLYKK | 0.435 | 453 | WB | Large T | A3001 |
| 50 | KMKRMNTLY | 0.561 | 115 | WB | Large T | A3002 |
| 401 | KMDSVIFDF | 0.525 | 169 | WB | Large T | A3002 |
| 172 | LYKKLMEKY | 0.524 | 172 | WB | Large T | A3002 |
| 285 | DVFLLLGMY | 0.509 | 201 | WB | Large T | A3002 |
| 610 | MYTFSRMKY | 0.502 | 218 | WB | Large T | A3002 |
| 226 | GVNKEYLLY | 0.497 | 231 | WB | Large T | A3002 |
| 603 | RLDSEISMY | 0.483 | 269 | WB | Large T | A3002 |
| 536 | KTLQARFVR | 0.856 | 4 | SB | Large T | A3101 |
| 576 | LLLLLIWFR | 0.848 | 5 | SB | Large T | A3101 |
| 179 | KYSVTFISR | 0.844 | 5 | SB | Large T | A3101 |
| 541 | RFVRQIDFR | 0.836 | 5 | SB | Large T | A3101 |
| 147 | LSQAVFSNR | 0.821 | 6 | SB | Large T | A3101 |
| 547 | DFRPKIYLR | 0.799 | 8 | SB | Large T | A3101 |
| 195 | IIFFLTPHR | 0.720 | 20 | SB | Large T | A3101 |
| 528 | TMNEYPVPK | 0.713 | 22 | SB | Large T | A3101 |
| 350 | RVDTLHMTR | 0.712 | 22 | SB | Large T | A3101 |
| 197 | FFLTPHRHR | 0.682 | 31 | SB | Large T | A3101 |
| 491 | GINNLDSLR | 0.668 | 36 | SB | Large T | A3101 |
| 413 | VVFNVPKRR | 0.651 | 43 | SB | Large T | A3101 |
| 607 | EISMYTFSR | 0.604 | 72 | WB | Large T | A3101 |
| 155 | RTLACFAVY | 0.573 | 101 | WB | Large T | A3101 |
| 609 | SMYTFSRMK | 0.567 | 108 | WB | Large T | A3101 |
| 217 | CTFSFLICK | 0.563 | 113 | WB | Large T | A3101 |
| 50 | KMKRMNTLY | 0.540 | 144 | WB | Large T | A3101 |
| 91 | SWWSSFNEK | 0.515 | 190 | WB | Large T | A3101 |
| 123 | HSTPPKKKR | 0.487 | 257 | WB | Large T | A3101 |
| 292 | MYLEFQYNV | 0.476 | 289 | WB | Large T | A3101 |
| 677 | GFQCFKRPK | 0.472 | 301 | WB | Large T | A3101 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 231 | YLLYSALTR | 0.438 | 439 | WB | Large T | A3101 |
| 28 | LMRKAYLKK | 0.436 | 447 | WB | Large T | A3101 |
| 547 | DFRPKIYLR | 0.938 | 1 | SB | Large T | A3301 |
| 576 | LLLLLIWFR | 0.827 | 6 | SB | Large T | A3301 |
| 607 | EISMYTFSR | 0.826 | 6 | SB | Large T | A3301 |
| 195 | IIFFLTPHR | 0.692 | 27 | SB | Large T | A3301 |
| 588 | DFSKDIQSR | 0.669 | 35 | SB | Large T | A3301 |
| 197 | FFLTPHRHR | 0.615 | 64 | WB | Large T | A3301 |
| 147 | LSQAVFSNR | 0.592 | 82 | WB | Large T | A3301 |
| 231 | YLLYSALTR | 0.473 | 299 | WB | Large T | A3301 |
| 607 | EISMYTFSR | 0.908 | 2 | SB | Large T | A6801 |
| 412 | CVVFNVPKR | 0.851 | 5 | SB | Large T | A6801 |
| 195 | IIFFLTPHR | 0.838 | 5 | SB | Large T | A6801 |
| 217 | CTFSFLICK | 0.813 | 7 | SB | Large T | A6801 |
| 324 | NAIIFAESK | 0.796 | 9 | SB | Large T | A6801 |
| 207 | SAINNFCQK | 0.749 | 15 | SB | Large T | A6801 |
| 160 | FAVYTTKEK | 0.721 | 20 | SB | Large T | A6801 |
| 274 | ITEYAVETK | 0.648 | 44 | SB | Large T | A6801 |
| 147 | LSQAVFSNR | 0.643 | 47 | SB | Large T | A6801 |
| 536 | KTLQARFVR | 0.643 | 47 | SB | Large T | A6801 |
| 231 | YLLYSALTR | 0.628 | 56 | WB | Large T | A6801 |
| 616 | MKYNICMGK | 0.625 | 58 | WB | Large T | A6801 |
| 491 | GINNLDSLR | 0.625 | 58 | WB | Large T | A6801 |
| 413 | VVFNVPKRR | 0.622 | 60 | WB | Large T | A6801 |
| 560 | NSEFLLEKR | 0.620 | 61 | WB | Large T | A6801 |
| 609 | SMYTFSRMK | 0.595 | 80 | WB | Large T | A6801 |
| 167 | EKAQILYKK | 0.595 | 80 | WB | Large T | A6801 |
| 610 | MYTFSRMKY | 0.588 | 86 | WB | Large T | A6801 |
| 576 | LLLLLIWFR | 0.573 | 101 | WB | Large T | A6801 |
| 469 | YMVVFEDVK | 0.567 | 108 | WB | Large T | A6801 |
| 296 | FQYNVEECK | 0.534 | 153 | WB | Large T | A6801 |
| 123 | HSTPPKKKR | 0.530 | 162 | WB | Large T | A6801 |
| 340 | QAVDTVLAK | 0.527 | 167 | WB | Large T | A6801 |
| 668 | HSQELHLCK | 0.512 | 196 | WB | Large T | A6801 |
| 505 | SVKVNLEKK | 0.501 | 220 | WB | Large T | A6801 |
| 120 | DSQHSTPPK | 0.485 | 263 | WB | Large T | A6801 |
| 528 | TMNEYPVPK | 0.481 | 275 | WB | Large T | A6801 |
| 171 | ILYKKLMEK | 0.479 | 281 | WB | Large T | A6801 |
| 504 | GSVKVNLEK | 0.451 | 380 | WB | Large T | A6801 |
| 285 | DVFLLLGMY | 0.450 | 385 | WB | Large T | A6801 |
| 449 | LNVNLPMER | 0.448 | 390 | WB | Large T | A6801 |
| 350 | RVDTLHMTR | 0.441 | 422 | WB | Large T | A6801 |
| 403 | DSVIFDFLH | 0.439 | 432 | WB | Large T | A6801 |
| 388 | YMAGVAWLH | 0.437 | 440 | WB | Large T | A6801 |
| 588 | DFSKDIQSR | 0.437 | 444 | WB | Large T | A6801 |
| 547 | DFRPKIYLR | 0.427 | 492 | WB | Large T | A6801 |
| 8 | ESMELMDLL | 0.767 | 12 | SB | Large T | A6802 |
| 409 | FLHCVVFNV | 0.700 | 25 | SB | Large T | A6802 |
| 402 | MDSVIFDFL | 0.694 | 27 | SB | Large T | A6802 |
| 450 | NVNLPMERL | 0.691 | 28 | SB | Large T | A6802 |
| 219 | FSFLICKGV | 0.689 | 28 | SB | Large T | A6802 |
| 265 | ETKQVSWKL | 0.607 | 70 | WB | Large T | A6802 |
| 280 | ETKCEDVFL | 0.589 | 85 | WB | Large T | A6802 |
| 416 | NVPKRRYWL | 0.585 | 89 | WB | Large T | A6802 |
| 526 | LVTMNEYPV | 0.585 | 89 | WB | Large T | A6802 |
| 405 | VIFDFLHCV | 0.583 | 91 | WB | Large T | A6802 |
| 73 | FGTWNSSEV | 0.580 | 94 | WB | Large T | A6802 |
| 458 | LTFELGVAI | 0.577 | 96 | WB | Large T | A6802 |
| 371 | DKMDLIFGA | 0.565 | 110 | WB | Large T | A6802 |
| 589 | FSKDIQSRI | 0.558 | 119 | WB | Large T | A6802 |
| 198 | FLTPHRHRV | 0.543 | 140 | WB | Large T | A6802 |
| 519 | TQIFPPGLV | 0.515 | 189 | WB | Large T | A6802 |
| 377 | FGAHGNAVL | 0.502 | 218 | WB | Large T | A6802 |
| 156 | TLACFAVYT | 0.493 | 239 | WB | Large T | A6802 |
| 464 | VAIDQYMVV | 0.486 | 261 | WB | Large T | A6802 |
| 468 | QYMVVFEDV | 0.482 | 271 | WB | Large T | A6802 |
| 608 | ISMYTFSRM | 0.465 | 326 | WB | Large T | A6802 |
| 343 | DTVLAKKRV | 0.459 | 348 | WB | Large T | A6802 |
| 361 | MLTERFNHI | 0.450 | 382 | WB | Large T | A6802 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 191 | AGHNIIFFL | 0.447 | 396 | WB | Large T | A6802 |
| 154 | NRTLACFAV | 0.432 | 468 | WB | Large T | A6802 |
| 458 | LTFELGVAI | 0.702 | 25 | SB | Large T | A6901 |
| 405 | VIFDFLHCV | 0.691 | 28 | SB | Large T | A6901 |
| 409 | FLHCVVFNV | 0.683 | 30 | SB | Large T | A6901 |
| 578 | LLLIWFRPV | 0.630 | 54 | WB | Large T | A6901 |
| 8 | ESMELMDLL | 0.609 | 68 | WB | Large T | A6901 |
| 368 | HILDKMDLI | 0.587 | 87 | WB | Large T | A6901 |
| 139 | FPSDLHQFL | 0.553 | 125 | WB | Large T | A6901 |
| 292 | MYLEFQYNV | 0.522 | 176 | WB | Large T | A6901 |
| 21 | AAWGNLPLM | 0.483 | 267 | WB | Large T | A6901 |
| 198 | FLTPHRHRV | 0.481 | 274 | WB | Large T | A6901 |
| 265 | ETKQVSWKL | 0.457 | 355 | WB | Large T | A6901 |
| 500 | DYLDGSVKV | 0.449 | 389 | WB | Large T | A6901 |
| 464 | VAIDQYMVV | 0.431 | 472 | WB | Large T | A6901 |
| 20 | RAAWGNLPL | 0.721 | 20 | SB | Large T | B0702 |
| 26 | LPLMRKAYL | 0.719 | 20 | SB | Large T | B0702 |
| 200 | TPHRHRVSA | 0.662 | 38 | SB | Large T | B0702 |
| 532 | YPVPKTLQA | 0.651 | 43 | SB | Large T | B0702 |
| 399 | LPKMDSVIF | 0.516 | 187 | WB | Large T | B0702 |
| 568 | RILQSGMTL | 0.499 | 226 | WB | Large T | B0702 |
| 81 | VPTYGTEEW | 0.497 | 232 | WB | Large T | B0702 |
| 139 | FPSDLHQFL | 0.467 | 320 | WB | Large T | B0702 |
| 417 | VPKRRYWLF | 0.461 | 339 | WB | Large T | B0702 |
| 417 | VPKRRYWLF | 0.587 | 87 | WB | Large T | B0801 |
| 144 | HQFLSQAVF | 0.618 | 62 | WB | Large T | B1501 |
| 234 | YSALTRDPY | 0.569 | 105 | WB | Large T | B1501 |
| 50 | KMKRMNTLY | 0.561 | 115 | WB | Large T | B1501 |
| 213 | CQKLCTFSF | 0.528 | 165 | WB | Large T | B1501 |
| 155 | RTLACFAVY | 0.522 | 176 | WB | Large T | B1501 |
| 514 | HLNKRTQIF | 0.501 | 221 | WB | Large T | B1501 |
| 288 | LLLGMYLEF | 0.495 | 236 | WB | Large T | B1501 |
| 570 | LQSGMTLLL | 0.479 | 280 | WB | Large T | B1501 |
| 152 | FSNRTLACF | 0.468 | 315 | WB | Large T | B1501 |
| 176 | LMEKYSVTF | 0.466 | 324 | WB | Large T | B1501 |
| 20 | RAAWGNLPL | 0.444 | 411 | WB | Large T | B1501 |
| 388 | YMAGVAWLH | 0.439 | 434 | WB | Large T | B1501 |
| 10 | MELMDLLGL | 0.722 | 20 | SB | Large T | B1801 |
| 530 | NEYPVPKTL | 0.706 | 24 | SB | Large T | B1801 |
| 670 | QELHLCKGF | 0.692 | 27 | SB | Large T | B1801 |
| 229 | KEYLLYSAL | 0.571 | 104 | WB | Large T | B1801 |
| 664 | SENPHSQEL | 0.520 | 179 | WB | Large T | B1801 |
| 52 | KRMNTLYKK | 0.656 | 41 | SB | Large T | B2705 |
| 548 | FRPKIYLRK | 0.526 | 169 | WB | Large T | B2705 |
| 420 | RRYWLFKGP | 0.518 | 184 | WB | Large T | B2705 |
| 364 | ERFNHILDK | 0.460 | 343 | WB | Large T | B2705 |
| 614 | SRMKYNICM | 0.452 | 375 | WB | Large T | B2705 |
| 540 | ARFVRQIDF | 0.436 | 448 | WB | Large T | B2705 |
| 682 | KRPKTPPPK | 0.430 | 477 | WB | Large T | B2705 |
| 399 | LPKMDSVIF | 0.752 | 14 | SB | Large T | B3501 |
| 139 | FPSDLHQFL | 0.633 | 52 | WB | Large T | B3501 |
| 20 | RAAWGNLPL | 0.618 | 62 | WB | Large T | B3501 |
| 234 | YSALTRDPY | 0.565 | 111 | WB | Large T | B3501 |
| 447 | KALNVNLPM | 0.561 | 115 | WB | Large T | B3501 |
| 21 | AAWGNLPLM | 0.545 | 137 | WB | Large T | B3501 |
| 189 | MCAGHNIIF | 0.537 | 149 | WB | Large T | B3501 |
| 111 | FASDEEATA | 0.509 | 202 | WB | Large T | B3501 |
| 534 | VPKTLQARF | 0.498 | 229 | WB | Large T | B3501 |
| 81 | VPTYGTEEW | 0.486 | 260 | WB | Large T | B3501 |
| 269 | VSWKLITEY | 0.463 | 334 | WB | Large T | B3501 |
| 285 | DVFLLLGMY | 0.447 | 394 | WB | Large T | B3501 |
| 532 | YPVPKTLQA | 0.445 | 403 | WB | Large T | B3501 |
| 176 | LMEKYSVTF | 0.441 | 423 | WB | Large T | B3501 |
| 155 | RTLACFAVY | 0.434 | 455 | WB | Large T | B3501 |
| 666 | NPHSQELHL | 0.426 | 495 | WB | Large T | B3501 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 377 | FGAHGNAVL | 0.547 | 133 | WB | Large T | B3901 |
| 10 | MELMDLLGL | 0.751 | 14 | SB | Large T | B4001 |
| 229 | KEYLLYSAL | 0.690 | 28 | SB | Large T | B4001 |
| 664 | SENPHSQEL | 0.681 | 31 | SB | Large T | B4001 |
| 530 | NEYPVPKTL | 0.592 | 82 | WB | Large T | B4001 |
| 7 | EESMELMDL | 0.561 | 115 | WB | Large T | B4001 |
| 245 | IEESIQGGL | 0.552 | 127 | WB | Large T | B4001 |
| 561 | SEFLLEKRI | 0.498 | 227 | WB | Large T | B4001 |
| 18 | LERAAWGNL | 0.497 | 231 | WB | Large T | B4001 |
| 358 | REEMLTERF | 0.441 | 422 | WB | Large T | B4001 |
| 664 | SENPHSQEL | 0.630 | 54 | WB | Large T | B4002 |
| 229 | KEYLLYSAL | 0.583 | 91 | WB | Large T | B4002 |
| 606 | SEISMYTFS | 0.489 | 252 | WB | Large T | B4002 |
| 279 | VETKCEDVF | 0.469 | 314 | WB | Large T | B4002 |
| 177 | MEKYSVTFI | 0.462 | 335 | WB | Large T | B4002 |
| 606 | SEISMYTFS | 0.521 | 177 | WB | Large T | B4403 |
| 561 | SEFLLEKRI | 0.458 | 353 | WB | Large T | B4403 |
| 664 | SENPHSQEL | 0.446 | 403 | WB | Large T | B4403 |
| 329 | AESKNQKSI | 0.497 | 229 | WB | Large T | B4501 |
| 453 | LPMERLTFE | 0.451 | 378 | WB | Large T | B5101 |
| 139 | FPSDLHQFL | 0.438 | 437 | WB | Large T | B5101 |
| 81 | VPTYGTEEW | 0.673 | 34 | SB | Large T | B5301 |
| 399 | LPKMDSVIF | 0.628 | 55 | WB | Large T | B5301 |
| 26 | LPLMRKAYL | 0.625 | 57 | WB | Large T | B5301 |
| 666 | NPHSQELHL | 0.553 | 126 | WB | Large T | B5301 |
| 139 | FPSDLHQFL | 0.509 | 202 | WB | Large T | B5301 |
| 574 | MTLLLLLIW | 0.454 | 366 | WB | Large T | B5301 |
| 522 | FPPGLVTMN | 0.672 | 34 | SB | Large T | B5401 |
| 200 | TPHRHRVSA | 0.530 | 162 | WB | Large T | B5401 |
| 219 | FSFLICKGV | 0.453 | 373 | WB | Large T | B5401 |
| 453 | LPMERLTFE | 0.432 | 466 | WB | Large T | B5401 |
| 574 | MTLLLLLIW | 0.446 | 399 | WB | Large T | B5701 |
| 401 | KMDSVIFDF | 0.615 | 64 | WB | Large T | B5801 |
| 574 | MTLLLLLIW | 0.594 | 80 | WB | Large T | B5801 |
| 152 | FSNRTLACF | 0.562 | 114 | WB | Large T | B5801 |
| 84 | YGTEEWESW | 0.553 | 125 | WB | Large T | B5801 |
| 20 | RAAWGNLPL | 0.460 | 344 | WB | Large T | B5801 |
| 447 | KALNVNLPM | 0.442 | 419 | WB | Large T | B5801 |
| 269 | VSWKLITEY | 0.429 | 482 | WB | Large T | B5801 |
| | | | 10-mers | | | |
| 164 | TTKEKAQILY | 0.528 | 165 | WB | Large T | A0101 |
| 401 | KMDSVIFDFL | 0.830 | 6 | SB | Large T | A0201 |
| 291 | GMYLEFQYNV | 0.761 | 13 | SB | Large T | A0201 |
| 405 | VIFDFLHCVV | 0.679 | 32 | SB | Large T | A0201 |
| 525 | GLVTMNEYPV | 0.676 | 33 | SB | Large T | A0201 |
| 501 | YLDGSVKVNL | 0.671 | 35 | SB | Large T | A0201 |
| 569 | ILQSGMTLLL | 0.658 | 40 | SB | Large T | A0201 |
| 577 | LLLLIWFRPV | 0.657 | 40 | SB | Large T | A0201 |
| 383 | AVLEQYMAGV | 0.637 | 50 | WB | Large T | A0201 |
| 361 | MLTERFNHIL | 0.616 | 63 | WB | Large T | A0201 |
| 176 | LMEKYSVTFI | 0.609 | 68 | WB | Large T | A0201 |
| 404 | SVIFDFLHCV | 0.585 | 89 | WB | Large T | A0201 |
| 603 | RLDSEISMYT | 0.583 | 90 | WB | Large T | A0201 |
| 497 | SLRDYLDGSV | 0.570 | 104 | WB | Large T | A0201 |
| 272 | KLITEYAVET | 0.543 | 140 | WB | Large T | A0201 |
| 578 | LLLIWFRPVA | 0.503 | 216 | WB | Large T | A0201 |
| 563 | FLLEKRILQS | 0.500 | 222 | WB | Large T | A0201 |
| 56 | TLYKKMEQDV | 0.485 | 263 | WB | Large T | A0201 |
| 528 | TMNEYPVPKT | 0.457 | 354 | WB | Large T | A0201 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 12 | LMDLLGLERA | 0.456 | 361 | WB | Large T | A0201 |
| 568 | RILQSGMTLL | 0.454 | 367 | WB | Large T | A0201 |
| 288 | LLLGMYLEFQ | 0.448 | 391 | WB | Large T | A0201 |
| 3 | VLNREESMEL | 0.434 | 454 | WB | Large T | A0201 |
| 401 | KMDSVIFDFL | 0.773 | 11 | SB | Large T | A0202 |
| 603 | RLDSEISMYT | 0.720 | 20 | SB | Large T | A0202 |
| 569 | ILQSGMTLLL | 0.716 | 21 | SB | Large T | A0202 |
| 291 | GMYLEFQYNV | 0.681 | 31 | SB | Large T | A0202 |
| 525 | GLVTMNEYPV | 0.674 | 33 | SB | Large T | A0202 |
| 497 | SLRDYLDGSV | 0.665 | 37 | SB | Large T | A0202 |
| 405 | VIFDFLHCVV | 0.649 | 44 | SB | Large T | A0202 |
| 501 | YLDGSVKVNL | 0.648 | 44 | SB | Large T | A0202 |
| 288 | LLLGMYLEFQ | 0.645 | 46 | SB | Large T | A0202 |
| 577 | LLLLIWFRPV | 0.628 | 55 | WB | Large T | A0202 |
| 287 | FLLLGMYLEF | 0.618 | 62 | WB | Large T | A0202 |
| 570 | LQSGMTLLLL | 0.609 | 69 | WB | Large T | A0202 |
| 12 | LMDLLGLERA | 0.607 | 70 | WB | Large T | A0202 |
| 388 | YMAGVAWLHC | 0.582 | 91 | WB | Large T | A0202 |
| 156 | TLACFAVYTT | 0.566 | 109 | WB | Large T | A0202 |
| 175 | KLMEKYSVTF | 0.566 | 109 | WB | Large T | A0202 |
| 3 | VLNREESMEL | 0.562 | 114 | WB | Large T | A0202 |
| 397 | CLLPKMDSVI | 0.561 | 115 | WB | Large T | A0202 |
| 285 | DVFLLLGMYL | 0.560 | 117 | WB | Large T | A0202 |
| 435 | TLAAGLLDLC | 0.550 | 130 | WB | Large T | A0202 |
| 361 | MLTERFNHIL | 0.543 | 140 | WB | Large T | A0202 |
| 383 | AVLEQYMAGV | 0.535 | 153 | WB | Large T | A0202 |
| 353 | TLHMTREEML | 0.532 | 157 | WB | Large T | A0202 |
| 461 | ELGVAIDQYM | 0.520 | 180 | WB | Large T | A0202 |
| 56 | TLYKKMEQDV | 0.516 | 187 | WB | Large T | A0202 |
| 103 | DLFCHEDMFA | 0.516 | 187 | WB | Large T | A0202 |
| 463 | GVAIDQYMVV | 0.509 | 202 | WB | Large T | A0202 |
| 9 | SMELMDLLGL | 0.507 | 206 | WB | Large T | A0202 |
| 142 | DLHQFLSQAV | 0.497 | 230 | WB | Large T | A0202 |
| 611 | YTFSRMKYNI | 0.493 | 240 | WB | Large T | A0202 |
| 272 | KLITEYAVET | 0.492 | 243 | WB | Large T | A0202 |
| 375 | LIFGAHGNAV | 0.491 | 247 | WB | Large T | A0202 |
| 563 | FLLEKRILQS | 0.488 | 253 | WB | Large T | A0202 |
| 440 | LLDLCGGKAL | 0.488 | 255 | WB | Large T | A0202 |
| 25 | NLPLMRKAYL | 0.483 | 269 | WB | Large T | A0202 |
| 568 | RILQSGMTLL | 0.478 | 285 | WB | Large T | A0202 |
| 176 | LMEKYSVTFI | 0.471 | 305 | WB | Large T | A0202 |
| 236 | ALTRDPYHII | 0.461 | 341 | WB | Large T | A0202 |
| 493 | NNLDSLRDYL | 0.454 | 366 | WB | Large T | A0202 |
| 572 | SGMTLLLLLI | 0.453 | 371 | WB | Large T | A0202 |
| 148 | SQAVFSNRTL | 0.450 | 383 | WB | Large T | A0202 |
| 439 | GLLDLCGGKA | 0.445 | 406 | WB | Large T | A0202 |
| 609 | SMYTFSRMKY | 0.445 | 406 | WB | Large T | A0202 |
| 345 | VLAKKRVDTL | 0.445 | 407 | WB | Large T | A0202 |
| 360 | EMLTERFNHI | 0.440 | 427 | WB | Large T | A0202 |
| 578 | LLLIWFRPVA | 0.438 | 435 | WB | Large T | A0202 |
| 556 | KSLQNSEFLL | 0.437 | 441 | WB | Large T | A0202 |
| 213 | CQKLCTFSFL | 0.433 | 461 | WB | Large T | A0202 |
| 497 | SLRDYLDGSV | 0.883 | 3 | SB | Large T | A0203 |
| 361 | MLTERFNHIL | 0.815 | 7 | SB | Large T | A0203 |
| 291 | GMYLEFQYNV | 0.792 | 9 | SB | Large T | A0203 |
| 525 | GLVTMNEYPV | 0.769 | 12 | SB | Large T | A0203 |
| 383 | AVLEQYMAGV | 0.755 | 14 | SB | Large T | A0203 |
| 569 | ILQSGMTLLL | 0.731 | 18 | SB | Large T | A0203 |
| 375 | LIFGAHGNAV | 0.731 | 18 | SB | Large T | A0203 |
| 577 | LLLLIWFRPV | 0.708 | 23 | SB | Large T | A0203 |
| 56 | TLYKKMEQDV | 0.707 | 23 | SB | Large T | A0203 |
| 405 | VIFDFLHCVV | 0.674 | 34 | SB | Large T | A0203 |
| 3 | VLNREESMEL | 0.666 | 37 | SB | Large T | A0203 |
| 457 | RLTFELGVAI | 0.665 | 37 | SB | Large T | A0203 |
| 404 | SVIFDFLHCV | 0.654 | 42 | SB | Large T | A0203 |
| 501 | YLDGSVKVNL | 0.627 | 56 | WB | Large T | A0203 |
| 345 | VLAKKRVDTL | 0.625 | 57 | WB | Large T | A0203 |
| 176 | LMEKYSVTFI | 0.611 | 67 | WB | Large T | A0203 |
| 156 | TLACFAVYTT | 0.600 | 75 | WB | Large T | A0203 |
| 236 | ALTRDPYHII | 0.576 | 98 | WB | Large T | A0203 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 401 | KMDSVIFDFL | 0.549 | 132 | WB | Large T | A0203 |
| 537 | TLQARFVRQI | 0.548 | 132 | WB | Large T | A0203 |
| 439 | GLLDLCGGKA | 0.546 | 136 | WB | Large T | A0203 |
| 570 | LQSGMTLLLL | 0.542 | 142 | WB | Large T | A0203 |
| 568 | RILQSGMTLL | 0.541 | 143 | WB | Large T | A0203 |
| 397 | CLLPKMDSVI | 0.534 | 154 | WB | Large T | A0203 |
| 611 | YTFSRMKYNI | 0.521 | 177 | WB | Large T | A0203 |
| 142 | DLHQFLSQAV | 0.503 | 217 | WB | Large T | A0203 |
| 603 | RLDSEISMYT | 0.488 | 254 | WB | Large T | A0203 |
| 578 | LLLIWFRPVA | 0.485 | 261 | WB | Large T | A0203 |
| 272 | KLITEYAVET | 0.485 | 263 | WB | Large T | A0203 |
| 213 | CQKLCTFSFL | 0.480 | 277 | WB | Large T | A0203 |
| 463 | GVAIDQYMVV | 0.473 | 298 | WB | Large T | A0203 |
| 12 | LMDLLGLERA | 0.468 | 314 | WB | Large T | A0203 |
| 528 | TMNEYPVPKT | 0.465 | 326 | WB | Large T | A0203 |
| 9 | SMELMDLLGL | 0.462 | 338 | WB | Large T | A0203 |
| 333 | NQKSICQQAV | 0.456 | 361 | WB | Large T | A0203 |
| 336 | SICQQAVDTV | 0.435 | 451 | WB | Large T | A0203 |
| 383 | AVLEQYMAGV | 0.666 | 37 | SB | Large T | A0204 |
| 525 | GLVTMNEYPV | 0.603 | 73 | WB | Large T | A0204 |
| 577 | LLLLIWFRPV | 0.591 | 83 | WB | Large T | A0204 |
| 361 | MLTERFNHIL | 0.573 | 101 | WB | Large T | A0204 |
| 497 | SLRDYLDGSV | 0.565 | 110 | WB | Large T | A0204 |
| 336 | SICQQAVDTV | 0.557 | 120 | WB | Large T | A0204 |
| 3 | VLNREESMEL | 0.557 | 120 | WB | Large T | A0204 |
| 291 | GMYLEFQYNV | 0.549 | 132 | WB | Large T | A0204 |
| 405 | VIFDFLHCVV | 0.533 | 155 | WB | Large T | A0204 |
| 375 | LIFGAHGNAV | 0.515 | 190 | WB | Large T | A0204 |
| 537 | TLQARFVRQI | 0.496 | 234 | WB | Large T | A0204 |
| 236 | ALTRDPYHII | 0.494 | 238 | WB | Large T | A0204 |
| 401 | KMDSVIFDFL | 0.484 | 266 | WB | Large T | A0204 |
| 528 | TMNEYPVPKT | 0.473 | 300 | WB | Large T | A0204 |
| 345 | VLAKKRVDTL | 0.461 | 339 | WB | Large T | A0204 |
| 175 | KLMEKYSVTF | 0.451 | 380 | WB | Large T | A0204 |
| 569 | ILQSGMTLLL | 0.446 | 401 | WB | Large T | A0204 |
| 176 | LMEKYSVTFI | 0.437 | 440 | WB | Large T | A0204 |
| 463 | GVAIDQYMVV | 0.434 | 454 | WB | Large T | A0204 |
| 518 | RTQIFPPGLV | 0.431 | 473 | WB | Large T | A0204 |
| 383 | AVLEQYMAGV | 0.832 | 6 | SB | Large T | A0206 |
| 404 | SVIFDFLHCV | 0.773 | 11 | SB | Large T | A0206 |
| 401 | KMDSVIFDFL | 0.762 | 13 | SB | Large T | A0206 |
| 577 | LLLLIWFRPV | 0.744 | 15 | SB | Large T | A0206 |
| 570 | LQSGMTLLLL | 0.714 | 22 | SB | Large T | A0206 |
| 525 | GLVTMNEYPV | 0.698 | 26 | SB | Large T | A0206 |
| 291 | GMYLEFQYNV | 0.682 | 31 | SB | Large T | A0206 |
| 405 | VIFDFLHCVV | 0.674 | 33 | SB | Large T | A0206 |
| 568 | RILQSGMTLL | 0.670 | 35 | SB | Large T | A0206 |
| 361 | MLTERFNHIL | 0.650 | 43 | SB | Large T | A0206 |
| 375 | LIFGAHGNAV | 0.644 | 47 | SB | Large T | A0206 |
| 287 | FLLLGMYLEF | 0.607 | 70 | WB | Large T | A0206 |
| 497 | SLRDYLDGSV | 0.596 | 79 | WB | Large T | A0206 |
| 267 | KQVSWKLITE | 0.564 | 112 | WB | Large T | A0206 |
| 175 | KLMEKYSVTF | 0.553 | 125 | WB | Large T | A0206 |
| 148 | SQAVFSNRTL | 0.535 | 153 | WB | Large T | A0206 |
| 20 | RAAWGNLPLM | 0.518 | 184 | WB | Large T | A0206 |
| 388 | YMAGVAWLHC | 0.510 | 201 | WB | Large T | A0206 |
| 213 | CQKLCTFSFL | 0.505 | 212 | WB | Large T | A0206 |
| 272 | KLITEYAVET | 0.494 | 237 | WB | Large T | A0206 |
| 578 | LLLIWFRPVA | 0.494 | 238 | WB | Large T | A0206 |
| 336 | SICQQAVDTV | 0.493 | 242 | WB | Large T | A0206 |
| 501 | YLDGSVKVNL | 0.487 | 257 | WB | Large T | A0206 |
| 569 | ILQSGMTLLL | 0.483 | 269 | WB | Large T | A0206 |
| 520 | QIFPPGLVTM | 0.482 | 272 | WB | Large T | A0206 |
| 338 | CQQAVDTVLA | 0.481 | 275 | WB | Large T | A0206 |
| 277 | YAVETKCEDV | 0.480 | 278 | WB | Large T | A0206 |
| 155 | RTLACFAVYT | 0.469 | 312 | WB | Large T | A0206 |
| 563 | FLLEKRILQS | 0.454 | 368 | WB | Large T | A0206 |
| 603 | RLDSEISMYT | 0.445 | 405 | WB | Large T | A0206 |
| 397 | CLLPKMDSVI | 0.441 | 422 | WB | Large T | A0206 |
| 457 | RLTFELGVAI | 0.437 | 440 | WB | Large T | A0206 |

TABLE M-continued

Prediction of BK virus Large T protein specific MHC class1,
8-, 9-, 10-, 11-mer peptide binders for 42 MHC class 1 alleles
(see FIG. 11) using the www.cbs.dtu.dk/services/
NetMHC/ database. The MHC class 1 molecules for which
no binders were found are not listed.

| pos | peptide | logscore | affinity (nM) | Bind Level | Protein Name | Allele |
|---|---|---|---|---|---|---|
| 207 | SAINNFCQKL | 0.433 | 463 | WB | Large T | A0206 |
| 463 | GVAIDQYMVV | 0.429 | 481 | WB | Large T | A0206 |
| 501 | YLDGSVKVNL | 0.958 | 1 | SB | Large T | A0211 |
| 405 | VIFDFLHCVV | 0.936 | 2 | SB | Large T | A0211 |
| 525 | GLVTMNEYPV | 0.915 | 2 | SB | Large T | A0211 |
| 291 | GMYLEFQYNV | 0.909 | 2 | SB | Large T | A0211 |
| 569 | ILQSGMTLLL | 0.902 | 2 | SB | Large T | A0211 |
| 142 | DLHQFLSQAV | 0.898 | 3 | SB | Large T | A0211 |
| 497 | SLRDYLDGSV | 0.895 | 3 | SB | Large T | A0211 |
| 401 | KMDSVIFDFL | 0.890 | 3 | SB | Large T | A0211 |
| 577 | LLLLIWFRPV | 0.888 | 3 | SB | Large T | A0211 |
| 56 | TLYKKMEQDV | 0.875 | 3 | SB | Large T | A0211 |
| 361 | MLTERFNHIL | 0.874 | 3 | SB | Large T | A0211 |
| 383 | AVLEQYMAGV | 0.866 | 4 | SB | Large T | A0211 |
| 442 | DLCGGKALNV | 0.854 | 4 | SB | Large T | A0211 |
| 375 | LIFGAHGNAV | 0.829 | 6 | SB | Large T | A0211 |
| 3 | VLNREESMEL | 0.824 | 6 | SB | Large T | A0211 |
| 288 | LLLGMYLEFQ | 0.816 | 7 | SB | Large T | A0211 |
| 603 | RLDSEISMYT | 0.797 | 9 | SB | Large T | A0211 |
| 404 | SVIFDFLHCV | 0.791 | 9 | SB | Large T | A0211 |
| 236 | ALTRDPYHII | 0.782 | 10 | SB | Large T | A0211 |
| 388 | YMAGVAWLHC | 0.782 | 10 | SB | Large T | A0211 |
| 12 | LMDLLGLERA | 0.757 | 13 | SB | Large T | A0211 |
| 287 | FLLLGMYLEF | 0.747 | 15 | SB | Large T | A0211 |
| 463 | GVAIDQYMVV | 0.742 | 16 | SB | Large T | A0211 |
| 336 | SICQQAVDTV | 0.736 | 17 | SB | Large T | A0211 |
| 345 | VLAKKRVDTL | 0.725 | 19 | SB | Large T | A0211 |
| 353 | TLHMTREEML | 0.722 | 20 | SB | Large T | A0211 |
| 568 | RILQSGMTLL | 0.720 | 20 | SB | Large T | A0211 |
| 440 | LLDLCGGKAL | 0.713 | 22 | SB | Large T | A0211 |
| 578 | LLLIWFRPVA | 0.712 | 22 | SB | Large T | A0211 |
| 563 | FLLEKRILQS | 0.708 | 23 | SB | Large T | A0211 |
| 9 | SMELMDLLGL | 0.706 | 24 | SB | Large T | A0211 |
| 439 | GLLDLCGGKA | 0.690 | 28 | SB | Large T | A0211 |
| 520 | QIFPPGLVTM | 0.684 | 30 | SB | Large T | A0211 |
| 25 | NLPLMRKAYL | 0.682 | 31 | SB | Large T | A0211 |
| 457 | RLTFELGVAI | 0.675 | 33 | SB | Large T | A0211 |
| 156 | TLACFAVYTT | 0.669 | 35 | SB | Large T | A0211 |
| 435 | TLAAGLLDLC | 0.649 | 44 | SB | Large T | A0211 |
| 397 | CLLPKMDSVI | 0.648 | 44 | SB | Large T | A0211 |
| 197 | FFLTPHRHRV | 0.635 | 51 | WB | Large T | A0211 |
| 537 | TLQARFVRQI | 0.630 | 55 | WB | Large T | A0211 |
| 609 | SMYTFSRMKY | 0.624 | 58 | WB | Large T | A0211 |
| 176 | LMEKYSVTFI | 0.612 | 66 | WB | Large T | A0211 |
| 175 | KLMEKYSVTF | 0.575 | 98 | WB | Large T | A0211 |
| 103 | DLFCHEDMFA | 0.573 | 101 | WB | Large T | A0211 |
| 289 | LLGMYLEFQY | 0.539 | 146 | WB | Large T | A0211 |
| 428 | PIDSGKTTLA | 0.534 | 155 | WB | Large T | A0211 |
| 272 | KLITEYAVET | 0.531 | 160 | WB | Large T | A0211 |
| 545 | QIDFRPKIYL | 0.527 | 166 | WB | Large T | A0211 |
| 575 | TLLLLIWFR | 0.518 | 183 | WB | Large T | A0211 |
| 198 | FLTPHRHRVS | 0.517 | 185 | WB | Large T | A0211 |
| 528 | TMNEYPVPKT | 0.509 | 203 | WB | Large T | A0211 |
| 17 | GLERAAWGNL | 0.502 | 219 | WB | Large T | A0211 |
| 384 | VLEQYMAGVA | 0.492 | 244 | WB | Large T | A0211 |
| 277 | YAVETKCEDV | 0.480 | 278 | WB | Large T | A0211 |
| 124 | STPPKKKRKV | 0.477 | 287 | WB | Large T | A0211 |
| 360 | EMLTERFNHI | 0.458 | 351 | WB | Large T | A0211 |
| 171 | ILYKKLMEKY | 0.456 | 358 | WB | Large T | A0211 |
| 369 | ILDKMDLIFG | 0.442 | 418 | WB | Large T | A0211 |
| 215 | KLCTFSFLIC | 0.432 | 464 | WB | Large T | A0211 |
| 461 | ELGVAIDQYM | 0.429 | 479 | WB | Large T | A0211 |
| 501 | YLDGSVKVNL | 0.900 | 2 | SB | Large T | A0212 |
| 405 | VIFDFLHCVV | 0.897 | 3 | SB | Large T | A0212 |
| 56 | TLYKKMEQDV | 0.893 | 3 | SB | Large T | A0212 |
| 291 | GMYLEFQYNV | 0.886 | 3 | SB | Large T | A0212 |
| 497 | SLRDYLDGSV | 0.867 | 4 | SB | Large T | A0212 |
| 383 | AVLEQYMAGV | 0.855 | 4 | SB | Large T | A0212 |
| 525 | GLVTMNEYPV | 0.825 | 6 | SB | Large T | A0212 |
| 361 | MLTERFNHIL | 0.824 | 6 | SB | Large T | A0212 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 375 | LIFGAHGNAV | 0.806 | 8 | SB | Large T | A0212 |
| 142 | DLHQFLSQAV | 0.795 | 9 | SB | Large T | A0212 |
| 3 | VLNREESMEL | 0.788 | 9 | SB | Large T | A0212 |
| 401 | KMDSVIFDFL | 0.784 | 10 | SB | Large T | A0212 |
| 569 | ILQSGMTLLL | 0.783 | 10 | SB | Large T | A0212 |
| 577 | LLLLIWFRPV | 0.783 | 10 | SB | Large T | A0212 |
| 388 | YMAGVAWLHC | 0.765 | 12 | SB | Large T | A0212 |
| 345 | VLAKKRVDTL | 0.754 | 14 | SB | Large T | A0212 |
| 288 | LLLGMYLEFQ | 0.715 | 21 | SB | Large T | A0212 |
| 287 | FLLLGMYLEF | 0.683 | 30 | SB | Large T | A0212 |
| 563 | FLLEKRILQS | 0.666 | 37 | SB | Large T | A0212 |
| 442 | DLCGGKALNV | 0.657 | 40 | SB | Large T | A0212 |
| 397 | CLLPKMDSVI | 0.632 | 53 | WB | Large T | A0212 |
| 12 | LMDLLGLERA | 0.604 | 72 | WB | Large T | A0212 |
| 404 | SVIFDFLHCV | 0.604 | 72 | WB | Large T | A0212 |
| 9 | SMELMDLLGL | 0.579 | 95 | WB | Large T | A0212 |
| 603 | RLDSEISMYT | 0.573 | 101 | WB | Large T | A0212 |
| 236 | ALTRDPYHII | 0.570 | 104 | WB | Large T | A0212 |
| 277 | YAVETKCEDV | 0.569 | 106 | WB | Large T | A0212 |
| 578 | LLLIWFRPVA | 0.558 | 119 | WB | Large T | A0212 |
| 353 | TLHMTREEML | 0.552 | 126 | WB | Large T | A0212 |
| 197 | FFLTPHRHRV | 0.549 | 131 | WB | Large T | A0212 |
| 520 | QIFPPGLVTM | 0.543 | 139 | WB | Large T | A0212 |
| 176 | LMEKYSVTFI | 0.536 | 150 | WB | Large T | A0212 |
| 175 | KLMEKYSVTF | 0.528 | 165 | WB | Large T | A0212 |
| 463 | GVAIDQYMVV | 0.500 | 222 | WB | Large T | A0212 |
| 336 | SICQQAVDTV | 0.495 | 235 | WB | Large T | A0212 |
| 457 | RLTFELGVAI | 0.489 | 252 | WB | Large T | A0212 |
| 198 | FLTPHRHRVS | 0.484 | 266 | WB | Large T | A0212 |
| 609 | SMYTFSRMKY | 0.480 | 276 | WB | Large T | A0212 |
| 171 | ILYKKLMEKY | 0.477 | 285 | WB | Large T | A0212 |
| 25 | NLPLMRKAYL | 0.477 | 287 | WB | Large T | A0212 |
| 439 | GLLDLCGGKA | 0.476 | 288 | WB | Large T | A0212 |
| 611 | YTFSRMKYNI | 0.472 | 304 | WB | Large T | A0212 |
| 435 | TLAAGLLDLC | 0.461 | 342 | WB | Large T | A0212 |
| 440 | LLDLCGGKAL | 0.459 | 349 | WB | Large T | A0212 |
| 568 | RILQSGMTLL | 0.458 | 352 | WB | Large T | A0212 |
| 360 | EMLTERFNHI | 0.457 | 354 | WB | Large T | A0212 |
| 537 | TLQARFVRQI | 0.452 | 375 | WB | Large T | A0212 |
| 17 | GLERAAWGNL | 0.430 | 474 | WB | Large T | A0212 |
| 528 | TMNEYPVPKT | 0.428 | 488 | WB | Large T | A0212 |
| 525 | GLVTMNEYPV | 0.882 | 3 | SB | Large T | A0216 |
| 405 | VIFDFLHCVV | 0.863 | 4 | SB | Large T | A0216 |
| 497 | SLRDYLDGSV | 0.861 | 4 | SB | Large T | A0216 |
| 56 | TLYKKMEQDV | 0.842 | 5 | SB | Large T | A0216 |
| 291 | GMYLEFQYNV | 0.841 | 5 | SB | Large T | A0216 |
| 569 | ILQSGMTLLL | 0.838 | 5 | SB | Large T | A0216 |
| 501 | YLDGSVKVNL | 0.833 | 6 | SB | Large T | A0216 |
| 361 | MLTERFNHIL | 0.812 | 7 | SB | Large T | A0216 |
| 142 | DLHQFLSQAV | 0.809 | 7 | SB | Large T | A0216 |
| 401 | KMDSVIFDFL | 0.806 | 8 | SB | Large T | A0216 |
| 442 | DLCGGKALNV | 0.802 | 8 | SB | Large T | A0216 |
| 375 | LIFGAHGNAV | 0.773 | 11 | SB | Large T | A0216 |
| 3 | VLNREESMEL | 0.768 | 12 | SB | Large T | A0216 |
| 345 | VLAKKRVDTL | 0.765 | 12 | SB | Large T | A0216 |
| 577 | LLLLIWFRPV | 0.743 | 16 | SB | Large T | A0216 |
| 383 | AVLEQYMAGV | 0.739 | 16 | SB | Large T | A0216 |
| 336 | SICQQAVDTV | 0.721 | 20 | SB | Large T | A0216 |
| 25 | NLPLMRKAYL | 0.703 | 24 | SB | Large T | A0216 |
| 288 | LLLGMYLEFQ | 0.679 | 32 | SB | Large T | A0216 |
| 176 | LMEKYSVTFI | 0.675 | 33 | SB | Large T | A0216 |
| 236 | ALTRDPYHII | 0.671 | 35 | SB | Large T | A0216 |
| 353 | TLHMTREEML | 0.668 | 36 | SB | Large T | A0216 |
| 404 | SVIFDFLHCV | 0.647 | 45 | SB | Large T | A0216 |
| 603 | RLDSEISMYT | 0.630 | 54 | WB | Large T | A0216 |
| 197 | FFLTPHRHRV | 0.615 | 64 | WB | Large T | A0216 |
| 388 | YMAGVAWLHC | 0.602 | 73 | WB | Large T | A0216 |
| 568 | RILQSGMTLL | 0.598 | 77 | WB | Large T | A0216 |
| 156 | TLACFAVYTT | 0.567 | 108 | WB | Large T | A0216 |
| 397 | CLLPKMDSVI | 0.562 | 114 | WB | Large T | A0216 |
| 461 | ELGVAIDQYM | 0.550 | 130 | WB | Large T | A0216 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 17 | GLERAAWGNL | 0.545 | 137 | WB | Large T | A0216 |
| 103 | DLFCHEDMFA | 0.537 | 149 | WB | Large T | A0216 |
| 463 | GVAIDQYMVV | 0.534 | 155 | WB | Large T | A0216 |
| 537 | TLQARFVRQI | 0.528 | 165 | WB | Large T | A0216 |
| 563 | FLLEKRILQS | 0.511 | 198 | WB | Large T | A0216 |
| 545 | QIDFRPKIYL | 0.493 | 240 | WB | Large T | A0216 |
| 12 | LMDLLGLERA | 0.484 | 265 | WB | Large T | A0216 |
| 287 | FLLLGMYLEF | 0.483 | 270 | WB | Large T | A0216 |
| 289 | LLGMYLEFQY | 0.482 | 270 | WB | Large T | A0216 |
| 439 | GLLDLCGGKA | 0.477 | 287 | WB | Large T | A0216 |
| 9 | SMELMDLLGL | 0.468 | 316 | WB | Large T | A0216 |
| 673 | HLCKGFQCFK | 0.468 | 317 | WB | Large T | A0216 |
| 520 | QIFPPGLVTM | 0.463 | 334 | WB | Large T | A0216 |
| 190 | CAGHNIIFFL | 0.447 | 397 | WB | Large T | A0216 |
| 440 | LLDLCGGKAL | 0.445 | 406 | WB | Large T | A0216 |
| 124 | STPPKKKRKV | 0.438 | 439 | WB | Large T | A0216 |
| 578 | LLLIWFRPVA | 0.428 | 485 | WB | Large T | A0216 |
| 501 | YLDGSVKVNL | 0.885 | 3 | SB | Large T | A0219 |
| 569 | ILQSGMTLLL | 0.833 | 6 | SB | Large T | A0219 |
| 401 | KMDSVIFDPL | 0.761 | 13 | SB | Large T | A0219 |
| 361 | MLTERFNHIL | 0.747 | 15 | SB | Large T | A0219 |
| 405 | VIFDFLHCVV | 0.704 | 24 | SB | Large T | A0219 |
| 291 | GMYLEFQYNV | 0.679 | 32 | SB | Large T | A0219 |
| 142 | DLHQFLSQAV | 0.676 | 33 | SB | Large T | A0219 |
| 577 | LLLLIWFRPV | 0.646 | 45 | SB | Large T | A0219 |
| 525 | GLVTMNEYPV | 0.631 | 54 | WB | Large T | A0219 |
| 497 | SLRDYLDGSV | 0.622 | 59 | WB | Large T | A0219 |
| 388 | YMAGVAWLHC | 0.582 | 91 | WB | Large T | A0219 |
| 3 | VLNREESMEL | 0.573 | 101 | WB | Large T | A0219 |
| 288 | LLLGMYLEFQ | 0.572 | 102 | WB | Large T | A0219 |
| 56 | TLYKKMEQDV | 0.570 | 104 | WB | Large T | A0219 |
| 375 | LIFGAHGNAV | 0.565 | 110 | WB | Large T | A0219 |
| 442 | DLCGGKALNV | 0.557 | 120 | WB | Large T | A0219 |
| 383 | AVLEQYMAGV | 0.556 | 122 | WB | Large T | A0219 |
| 236 | ALTRDPYHII | 0.545 | 137 | WB | Large T | A0219 |
| 345 | VLAKKRVDTL | 0.515 | 189 | WB | Large T | A0219 |
| 603 | RLDSEISMYT | 0.498 | 227 | WB | Large T | A0219 |
| 12 | LMDLLGLERA | 0.486 | 260 | WB | Large T | A0219 |
| 397 | CLLPKMDSVI | 0.475 | 293 | WB | Large T | A0219 |
| 404 | SVIFDFLHCV | 0.474 | 294 | WB | Large T | A0219 |
| 435 | TLAAGLLDLC | 0.459 | 347 | WB | Large T | A0219 |
| 197 | FFLTPHRHRV | 0.449 | 389 | WB | Large T | A0219 |
| 353 | TLHMTREEML | 0.433 | 463 | WB | Large T | A0219 |
| 537 | TLQARFVRQI | 0.427 | 492 | WB | Large T | A0219 |
| 170 | QILYKKLMEK | 0.764 | 12 | SB | Large T | A0301 |
| 50 | KMKRMNTLYK | 0.754 | 14 | SB | Large T | A0301 |
| 615 | RMKYNICMGK | 0.751 | 14 | SB | Large T | A0301 |
| 608 | ISMYTFSRMK | 0.734 | 17 | SB | Large T | A0301 |
| 609 | SMYTFSRMKY | 0.707 | 23 | SB | Large T | A0301 |
| 527 | VTMNEYPVPK | 0.691 | 28 | SB | Large T | A0301 |
| 673 | HLCKGFQCFK | 0.668 | 36 | SB | Large T | A0301 |
| 27 | PLMRKAYLKK | 0.663 | 38 | SB | Large T | A0301 |
| 157 | LACFAVYTTK | 0.654 | 42 | SB | Large T | A0301 |
| 392 | VAWLHCLLPK | 0.582 | 92 | WB | Large T | A0301 |
| 575 | TLLLLIWFR | 0.574 | 100 | WB | Large T | A0301 |
| 220 | SFLICKGVNK | 0.554 | 124 | WB | Large T | A0301 |
| 22 | AWGNLPLMRK | 0.533 | 156 | WB | Large T | A0301 |
| 326 | IIFAESKNQK | 0.519 | 181 | WB | Large T | A0301 |
| 26 | LPLMRKAYLK | 0.500 | 222 | WB | Large T | A0301 |
| 558 | LQNSEFLLEK | 0.484 | 265 | WB | Large T | A0301 |
| 311 | QPYHFKYHEK | 0.465 | 326 | WB | Large T | A0301 |
| 417 | VPKRRYWLFK | 0.462 | 338 | WB | Large T | A0301 |
| 206 | VSAINNFCQK | 0.448 | 391 | WB | Large T | A0301 |
| 448 | ALNVNLPMER | 0.447 | 396 | WB | Large T | A0301 |
| 273 | LITEYAVETK | 0.446 | 399 | WB | Large T | A0301 |
| 171 | ILYKKLMEKY | 0.433 | 462 | WB | Large T | A0301 |
| 527 | VTMNEYPVPK | 0.811 | 7 | SB | Large T | A1101 |
| 608 | ISMYTFSRMK | 0.760 | 13 | SB | Large T | A1101 |
| 392 | VAWLHCLLPK | 0.708 | 23 | SB | Large T | A1101 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 558 | LQNSEFLLEK | 0.705 | 24 | SB | Large T | A1101 |
| 50 | KMKRMNTLYK | 0.700 | 25 | SB | Large T | A1101 |
| 326 | IIFAESKNQK | 0.695 | 27 | SB | Large T | A1101 |
| 206 | VSAINNFCQK | 0.692 | 28 | SB | Large T | A1101 |
| 609 | SMYTFSRMKY | 0.665 | 37 | SB | Large T | A1101 |
| 575 | TLLLLLIWFR | 0.648 | 45 | SB | Large T | A1101 |
| 170 | QILYKKLMEK | 0.643 | 47 | SB | Large T | A1101 |
| 157 | LACFAVYTTK | 0.635 | 51 | WB | Large T | A1101 |
| 673 | HLCKGFQCFK | 0.622 | 59 | WB | Large T | A1101 |
| 90 | ESWWSSFNEK | 0.565 | 110 | WB | Large T | A1101 |
| 615 | RMKYNICMGK | 0.556 | 121 | WB | Large T | A1101 |
| 121 | SQHSTPPKKK | 0.552 | 127 | WB | Large T | A1101 |
| 504 | GSVKVNLEKK | 0.541 | 143 | WB | Large T | A1101 |
| 339 | QQAVDTVLAK | 0.540 | 145 | WB | Large T | A1101 |
| 340 | QAVDTVLAKK | 0.534 | 154 | WB | Large T | A1101 |
| 448 | ALNVNLPMER | 0.528 | 165 | WB | Large T | A1101 |
| 194 | NIIFFLTPHR | 0.516 | 188 | WB | Large T | A1101 |
| 27 | PLMRKAYLKK | 0.478 | 284 | WB | Large T | A1101 |
| 21 | AAWGNLPLMR | 0.475 | 293 | WB | Large T | A1101 |
| 273 | LITEYAVETK | 0.470 | 310 | WB | Large T | A1101 |
| 120 | DSQHSTPPKK | 0.450 | 383 | WB | Large T | A1101 |
| 22 | AWGNLPLMRK | 0.449 | 387 | WB | Large T | A1101 |
| 220 | SFLICKGVNK | 0.445 | 404 | WB | Large T | A1101 |
| 468 | QYMVVFEDVK | 0.626 | 57 | WB | Large T | A2301 |
| 151 | VFSNRTLACF | 0.608 | 69 | WB | Large T | A2301 |
| 287 | FLLLGMYLEF | 0.575 | 99 | WB | Large T | A2301 |
| 582 | WFRPVADFSK | 0.548 | 133 | WB | Large T | A2301 |
| 57 | LYKKMEQDVK | 0.531 | 160 | WB | Large T | A2301 |
| 574 | MTLLLLLIWF | 0.524 | 171 | WB | Large T | A2301 |
| 83 | TYGTEEWESW | 0.500 | 224 | WB | Large T | A2301 |
| 406 | IFDFLHCVVF | 0.486 | 260 | WB | Large T | A2301 |
| 416 | NVPKRRYWLF | 0.477 | 288 | WB | Large T | A2301 |
| 220 | SFLICKGVNK | 0.469 | 311 | WB | Large T | A2301 |
| 159 | CFAVYTTKEK | 0.465 | 326 | WB | Large T | A2301 |
| 203 | RHRVSAINNF | 0.458 | 351 | WB | Large T | A2301 |
| 295 | EFQYNVEECK | 0.447 | 396 | WB | Large T | A2301 |
| 175 | KLMEKYSVTF | 0.446 | 401 | WB | Large T | A2301 |
| 91 | SWWSSFNEKW | 0.436 | 447 | WB | Large T | A2301 |
| 464 | SVAIDQYMVVF | 0.430 | 478 | WB | Large T | A2301 |
| 212 | FCQKLCTFSF | 0.426 | 499 | WB | Large T | A2301 |
| 151 | VFSNRTLACF | 0.606 | 71 | WB | Large T | A2402 |
| 162 | VYTTKEKAQI | 0.518 | 183 | WB | Large T | A2402 |
| 617 | KYNICMGKCI | 0.510 | 200 | WB | Large T | A2402 |
| 416 | NVPKRRYWLF | 0.506 | 209 | WB | Large T | A2402 |
| 406 | IFDFLHCVVF | 0.483 | 269 | WB | Large T | A2402 |
| 83 | TYGTEEWESW | 0.472 | 301 | WB | Large T | A2402 |
| 138 | DFPSDLHQFL | 0.430 | 477 | WB | Large T | A2402 |
| 83 | TYGTEEWESW | 0.622 | 59 | WB | Large T | A2403 |
| 513 | KHLNKRTQIF | 0.548 | 132 | WB | Large T | A2403 |
| 287 | FLLLGMYLEF | 0.533 | 155 | WB | Large T | A2403 |
| 212 | FCQKLCTFSF | 0.510 | 201 | WB | Large T | A2403 |
| 162 | VYTTKEKAQI | 0.492 | 243 | WB | Large T | A2403 |
| 175 | KLMEKYSVTF | 0.491 | 245 | WB | Large T | A2403 |
| 151 | VFSNRTLACF | 0.479 | 280 | WB | Large T | A2403 |
| 313 | YHFKYHEKHF | 0.456 | 358 | WB | Large T | A2403 |
| 406 | IFDFLHCVVF | 0.453 | 370 | WB | Large T | A2403 |
| 416 | NVPKRRYWLF | 0.449 | 389 | WB | Large T | A2403 |
| 203 | RHRVSAINNF | 0.444 | 408 | WB | Large T | A2403 |
| 574 | MTLLLLLIWF | 0.429 | 480 | WB | Large T | A2403 |
| 164 | TTKEKAQILY | 0.552 | 127 | WB | Large T | A2601 |
| 607 | EISMYTFSRM | 0.466 | 322 | WB | Large T | A2601 |
| 607 | EISMYTFSRM | 0.857 | 4 | SB | Large T | A2602 |
| 520 | QIFPPGLVTM | 0.811 | 7 | SB | Large T | A2602 |
| 268 | QVSWKLITEY | 0.726 | 19 | SB | Large T | A2602 |
| 164 | TTKEKAQILY | 0.721 | 20 | SB | Large T | A2602 |
| 416 | NVPKRRYWLF | 0.714 | 22 | SB | Large T | A2602 |
| 533 | PVPKTLQARF | 0.685 | 30 | SB | Large T | A2602 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 64 | DVKVAHQPDF | 0.665 | 37 | SB | Large T | A2602 |
| 280 | ETKCEDVFLL | 0.646 | 46 | SB | Large T | A2602 |
| 285 | DVFLLLGMYL | 0.612 | 66 | WB | Large T | A2602 |
| 368 | HILDKMDLIF | 0.589 | 85 | WB | Large T | A2602 |
| 80 | EVPTYGTEEW | 0.587 | 86 | WB | Large T | A2602 |
| 184 | FISRHMCAGH | 0.532 | 158 | WB | Large T | A2602 |
| 163 | YTTKEKAQIL | 0.514 | 192 | WB | Large T | A2602 |
| 284 | EDVFLLLGMY | 0.470 | 308 | WB | Large T | A2602 |
| 138 | DFPSDLHQFL | 0.465 | 326 | WB | Large T | A2602 |
| 611 | YTFSRMKYNI | 0.465 | 327 | WB | Large T | A2602 |
| 574 | MTLLLLLIWF | 0.463 | 333 | WB | Large T | A2602 |
| 464 | VAIDQYMVVF | 0.457 | 354 | WB | Large T | A2602 |
| 404 | SVIFDFLHCV | 0.451 | 380 | WB | Large T | A2602 |
| 609 | SMYTFSRMKY | 0.700 | 25 | SB | Large T | A2902 |
| 413 | VVFNVPKRRY | 0.524 | 172 | WB | Large T | A2902 |
| 171 | ILYKKLMEKY | 0.501 | 221 | WB | Large T | A2902 |
| 289 | LLGMYLEFQY | 0.496 | 232 | WB | Large T | A2902 |
| 75 | TWNSSEVPTY | 0.466 | 321 | WB | Large T | A2902 |
| 268 | QVSWKLITEY | 0.455 | 364 | WB | Large T | A2902 |
| 50 | KMKRMNTLYK | 0.848 | 5 | SB | Large T | A3001 |
| 676 | KGFQCFKRPK | 0.733 | 17 | SB | Large T | A3001 |
| 681 | FKRPKTPPPK | 0.723 | 20 | SB | Large T | A3001 |
| 51 | MKRMNTLYKK | 0.685 | 30 | SB | Large T | A3001 |
| 615 | RMKYNICMGK | 0.677 | 33 | SB | Large T | A3001 |
| 527 | VTMNEYPVPK | 0.661 | 39 | SB | Large T | A3001 |
| 417 | VPKRRYWLFK | 0.637 | 50 | WB | Large T | A3001 |
| 121 | SQHSTPPKKK | 0.623 | 59 | WB | Large T | A3001 |
| 582 | WFRPVADFSK | 0.622 | 59 | WB | Large T | A3001 |
| 542 | FVRQIDFRPK | 0.556 | 121 | WB | Large T | A3001 |
| 608 | ISMYTFSRMK | 0.552 | 126 | WB | Large T | A3001 |
| 128 | KKKRKVEDPK | 0.548 | 132 | WB | Large T | A3001 |
| 547 | DFRPKIYLRK | 0.507 | 207 | WB | Large T | A3001 |
| 307 | QKKDQPYHFK | 0.501 | 220 | WB | Large T | A3001 |
| 27 | PLMRKAYLKK | 0.500 | 224 | WB | Large T | A3001 |
| 356 | MTREEMLTER | 0.494 | 238 | WB | Large T | A3001 |
| 29 | MRKAYLKKCK | 0.488 | 255 | WB | Large T | A3001 |
| 119 | ADSQHSTPPK | 0.460 | 344 | WB | Large T | A3001 |
| 363 | TERFNHILDK | 0.445 | 405 | WB | Large T | A3001 |
| 166 | KEKAQILYKK | 0.442 | 418 | WB | Large T | A3001 |
| 164 | TTKEKAQILY | 0.439 | 432 | WB | Large T | A3001 |
| 120 | DSQHSTPPKK | 0.428 | 485 | WB | Large T | A3001 |
| 233 | LYSALTRDPY | 0.534 | 155 | WB | Large T | A3002 |
| 609 | SMYTFSRMKY | 0.528 | 165 | WB | Large T | A3002 |
| 268 | QVSWKLITEY | 0.485 | 262 | WB | Large T | A3002 |
| 75 | TWNSSEVPTY | 0.446 | 400 | WB | Large T | A3002 |
| 575 | TLLLLLIWFR | 0.750 | 14 | SB | Large T | A3101 |
| 230 | EYLLYSALTR | 0.642 | 48 | SB | Large T | A3101 |
| 50 | KMKRMNTLYK | 0.640 | 49 | SB | Large T | A3101 |
| 674 | LCKGFQCFKR | 0.638 | 50 | WB | Large T | A3101 |
| 609 | SMYTFSRMKY | 0.623 | 58 | WB | Large T | A3101 |
| 615 | RMKYNICMGK | 0.604 | 72 | WB | Large T | A3101 |
| 194 | NIIFFLTPHR | 0.586 | 88 | WB | Large T | A3101 |
| 448 | ALNVNLPMER | 0.583 | 90 | WB | Large T | A3101 |
| 673 | HLCKGFQCFK | 0.573 | 101 | WB | Large T | A3101 |
| 146 | FLSQAVFSNR | 0.570 | 104 | WB | Large T | A3101 |
| 412 | CVVFNVPKRR | 0.565 | 110 | WB | Large T | A3101 |
| 196 | IFFLTPHRHR | 0.550 | 130 | WB | Large T | A3101 |
| 356 | MTREEMLTER | 0.548 | 132 | WB | Large T | A3101 |
| 349 | KRVDTLHMTR | 0.530 | 161 | WB | Large T | A3101 |
| 220 | SFLICKGVNK | 0.524 | 172 | WB | Large T | A3101 |
| 51 | MKRMNTLYKK | 0.468 | 316 | WB | Large T | A3101 |
| 157 | LACFAVYTTK | 0.456 | 358 | WB | Large T | A3101 |
| 535 | PKTLQARFVR | 0.445 | 403 | WB | Large T | A3101 |
| 606 | SEISMYTFSR | 0.445 | 404 | WB | Large T | A3101 |
| 594 | QSRIVEWKER | 0.442 | 417 | WB | Large T | A3101 |
| 205 | RVSAINNFCQ | 0.434 | 458 | WB | Large T | A3101 |

TABLE M-continued

Prediction of BK virus Large T protein specific MHC class1,
8-, 9-, 10-, 11-mer peptide binders for 42 MHC class 1 alleles
(see FIG. 11) using the www.cbs.dtu.dk/services/
NetMHC/ database. The MHC class 1 molecules for which
no binders were found are not listed.

| pos | peptide | logscore | affinity (nM) | Bind Level | Protein Name | Allele |
|---|---|---|---|---|---|---|
| 230 | EYLLYSALTR | 0.653 | 42 | SB | Large T | A3301 |
| 575 | TLLLLLIWFR | 0.600 | 76 | WB | Large T | A3301 |
| 674 | LCKGFQCFKR | 0.537 | 150 | WB | Large T | A3301 |
| 196 | IFFLTPHRHR | 0.529 | 162 | WB | Large T | A3301 |
| 194 | NIIFFLTPHR | 0.529 | 163 | WB | Large T | A3301 |
| 11 | ELMDLLGLER | 0.512 | 196 | WB | Large T | A3301 |
| 146 | FLSQAVFSNR | 0.482 | 271 | WB | Large T | A3301 |
| 178 | EKYSVTFISR | 0.464 | 330 | WB | Large T | A3301 |
| 547 | DFRPKIYLRK | 0.429 | 482 | WB | Large T | A3301 |
| | | | | | Large T | A3301 |
| 194 | NIIFFLTPHR | 0.866 | 4 | SB | Large T | A6801 |
| 412 | CVVFNVPKRR | 0.785 | 10 | SB | Large T | A6801 |
| 356 | MTREEMLTER | 0.784 | 10 | SB | Large T | A6801 |
| 90 | ESWWSSFNEK | 0.756 | 13 | SB | Large T | A6801 |
| 146 | FLSQAVFSNR | 0.739 | 16 | SB | Large T | A6801 |
| 11 | ELMDLLGLER | 0.720 | 20 | SB | Large T | A6801 |
| 178 | EKYSVTFISR | 0.713 | 22 | SB | Large T | A6801 |
| 157 | LACFAVYTTK | 0.693 | 27 | SB | Large T | A6801 |
| 608 | ISMYTFSRMK | 0.660 | 39 | SB | Large T | A6801 |
| 673 | HLCKGFQCFK | 0.645 | 46 | SB | Large T | A6801 |
| 230 | EYLLYSALTR | 0.644 | 47 | SB | Large T | A6801 |
| 575 | TLLLLLIWFR | 0.643 | 47 | SB | Large T | A6801 |
| 326 | IIFAESKNQK | 0.639 | 49 | SB | Large T | A6801 |
| 273 | LITEYAVETK | 0.632 | 53 | WB | Large T | A6801 |
| 206 | VSAINNFCQK | 0.629 | 55 | WB | Large T | A6801 |
| 340 | QAVDTVLAKK | 0.623 | 59 | WB | Large T | A6801 |
| 490 | HGINNLDSLR | 0.593 | 81 | WB | Large T | A6801 |
| 475 | DVKGTGAESK | 0.581 | 93 | WB | Large T | A6801 |
| 606 | SEISMYTFSR | 0.572 | 102 | WB | Large T | A6801 |
| 592 | DIQSRIVEWK | 0.563 | 113 | WB | Large T | A6801 |
| 311 | QPYHFKYHEK | 0.556 | 122 | WB | Large T | A6801 |
| 527 | VTMNEYPVPK | 0.541 | 143 | WB | Large T | A6801 |
| 295 | EFQYNVEECK | 0.539 | 146 | WB | Large T | A6801 |
| 299 | NVEECKKCQK | 0.534 | 155 | WB | Large T | A6801 |
| 159 | CFAVYTTKEK | 0.524 | 171 | WB | Large T | A6801 |
| 296 | FQYNVEECKK | 0.510 | 200 | WB | Large T | A6801 |
| 196 | IFFLTPHRHR | 0.505 | 212 | WB | Large T | A6801 |
| 622 | MGKCILDITR | 0.480 | 277 | WB | Large T | A6801 |
| 542 | FVRQIDFRPK | 0.478 | 282 | WB | Large T | A6801 |
| 411 | HCVVFNVPKR | 0.476 | 290 | WB | Large T | A6801 |
| 120 | DSQHSTPPKK | 0.461 | 341 | WB | Large T | A6801 |
| 546 | IDFRPKIYLR | 0.437 | 443 | WB | Large T | A6801 |
| 164 | TTKEKAQILY | 0.433 | 460 | WB | Large T | A6801 |
| 404 | SVIFDFLHCV | 0.762 | 13 | SB | Large T | A6802 |
| 611 | YTFSRMKYNI | 0.677 | 32 | SB | Large T | A6802 |
| 285 | DVFLLLGMYL | 0.632 | 53 | WB | Large T | A6802 |
| 322 | FANAIIFAES | 0.613 | 66 | WB | Large T | A6802 |
| 280 | ETKCEDVFLL | 0.609 | 69 | WB | Large T | A6802 |
| 462 | LGVAIDQYMV | 0.574 | 100 | WB | Large T | A6802 |
| 607 | EISMYTFSRM | 0.562 | 114 | WB | Large T | A6802 |
| 375 | LIFGAHGNAV | 0.557 | 120 | WB | Large T | A6802 |
| 405 | VIFDFLHCVV | 0.536 | 151 | WB | Large T | A6802 |
| 647 | ESQSQCSSQV | 0.517 | 185 | WB | Large T | A6802 |
| 190 | CAGHNIIFFL | 0.488 | 253 | WB | Large T | A6802 |
| 383 | AVLEQYMAGV | 0.479 | 281 | WB | Large T | A6802 |
| 77 | NSSEVPTYGT | 0.467 | 320 | WB | Large T | A6802 |
| 19 | ERAAWGNLPL | 0.452 | 375 | WB | Large T | A6802 |
| 108 | EDMFASDEEA | 0.451 | 379 | WB | Large T | A6802 |
| 265 | ETKQVSWKLI | 0.451 | 380 | WB | Large T | A6802 |
| 207 | SAINNFCQKL | 0.440 | 428 | WB | Large T | A6802 |
| 463 | GVAIDQYMVV | 0.433 | 459 | WB | Large T | A6802 |
| 156 | TLACFAVYTT | 0.432 | 465 | WB | Large T | A6802 |
| 383 | AVLEQYMAGV | 0.745 | 15 | SB | Large T | A6901 |
| 404 | SVIFDFLHCV | 0.639 | 49 | SB | Large T | A6901 |
| 611 | YTFSRMKYNI | 0.596 | 79 | WB | Large T | A6901 |
| 375 | LIFGAHGNAV | 0.575 | 99 | WB | Large T | A6901 |
| 405 | VIFDFLHCVV | 0.552 | 127 | WB | Large T | A6901 |
| 360 | EMLTERFNHI | 0.545 | 137 | WB | Large T | A6901 |
| 520 | QIFPPPGLVTM | 0.541 | 143 | WB | Large T | A6901 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pospeptide | logscore | affinity (nM) | Bind Level | Protein Name | Allele |
|---|---|---|---|---|---|
| 453 LPMERLTFEL | 0.477 | 287 | WB | Large T | A6901 |
| 434 TTLAAGLLDL | 0.466 | 324 | WB | Large T | A6901 |
| 277 YAVETKCEDV | 0.458 | 352 | WB | Large T | A6901 |
| 197 FFLTPHRHRV | 0.452 | 374 | WB | Large T | A6901 |
| 577 LLLLIWFRPV | 0.435 | 451 | WB | Large T | A6901 |
| 285 DVFLLLGMYL | 0.431 | 470 | WB | Large T | A6901 |
| 549 RPKIYLRKSL | 0.785 | 10 | SB | Large T | B0702 |
| 200 TPHRHRVSAI | 0.752 | 14 | SB | Large T | B0702 |
| 453 LPMERLTFEL | 0.722 | 20 | SB | Large T | B0702 |
| 427 GPIDSGKTTL | 0.704 | 24 | SB | Large T | B0702 |
| 486 LPSGHGINNL | 0.573 | 101 | WB | Large T | B0702 |
| 584 RPVADFSKDI | 0.560 | 117 | WB | Large T | B0702 |
| 549 RPKIYLRKSL | 0.479 | 280 | WB | Large T | B0801 |
| 200 TPHRHRVSAI | 0.453 | 373 | WB | Large T | B0801 |
| 544 RQIDFRPKIY | 0.584 | 89 | WB | Large T | B1501 |
| 188 HMCAGHNIIF | 0.577 | 97 | WB | Large T | B1501 |
| 175 KLMEKYSVTF | 0.568 | 107 | WB | Large T | B1501 |
| 609 SMYTFSRMKY | 0.536 | 150 | WB | Large T | B1501 |
| 148 SQAVFSNRTL | 0.502 | 218 | WB | Large T | B1501 |
| 268 QVSWKLITEY | 0.478 | 284 | WB | Large T | B1501 |
| 287 FLLLGMYLEF | 0.475 | 292 | WB | Large T | B1501 |
| 249 IQGGLKEHDF | 0.467 | 318 | WB | Large T | B1501 |
| 464 VAIDQYMVVF | 0.445 | 406 | WB | Large T | B1501 |
| 570 LQSGMTLLLL | 0.439 | 434 | WB | Large T | B1501 |
| 460 FELGVAIDQY | 0.795 | 9 | SB | Large T | B1801 |
| 87 EEWESWWSSF | 0.653 | 42 | SB | Large T | B1801 |
| 455 MERLTFELGV | 0.576 | 98 | WB | Large T | B1801 |
| 574 MTLLLLLIWF | 0.498 | 227 | WB | Large T | B1801 |
| 420 RRYWLFKGPI | 0.605 | 71 | WB | Large T | B2705 |
| 52 KRMNTLYKKM | 0.591 | 83 | WB | Large T | B2705 |
| 567 KRILQSGMTL | 0.564 | 111 | WB | Large T | B2705 |
| 349 KRVDTLHMTR | 0.487 | 258 | WB | Large T | B2705 |
| 517 KRTQIFPPGL | 0.471 | 305 | WB | Large T | B2705 |
| 464 VAIDQYMVVF | 0.679 | 32 | SB | Large T | B3501 |
| 453 LPMERLTFEL | 0.600 | 75 | WB | Large T | B3501 |
| 20 RAAWGNLPLM | 0.595 | 80 | WB | Large T | B3501 |
| 268 QVSWKLITEY | 0.558 | 119 | WB | Large T | B3501 |
| 486 LPSGHGINNL | 0.549 | 131 | WB | Large T | B3501 |
| 287 FLLLGMYLEF | 0.479 | 279 | WB | Large T | B3501 |
| 523 PPGLVTMNEY | 0.479 | 281 | WB | Large T | B3501 |
| 532 YPVPKTLQAR | 0.470 | 310 | WB | Large T | B3501 |
| 139 FPSDLHQFLS | 0.459 | 347 | WB | Large T | B3501 |
| 189 MCAGHNIIFF | 0.451 | 379 | WB | Large T | B3501 |
| 389 MAGVAWLHCL | 0.449 | 390 | WB | Large T | B3501 |
| 262 EPEETKQVSW | 0.433 | 460 | WB | Large T | B3501 |
| 317 YHEKHFANAI | 0.608 | 69 | WB | Large T | B3901 |
| 148 SQAVFSNRTL | 0.545 | 137 | WB | Large T | B3901 |
| 19 ERAAWGNLPL | 0.539 | 147 | WB | Large T | B3901 |
| 501 YLDGSVKVNL | 0.498 | 228 | WB | Large T | B3901 |
| 6 REESMELMDL | 0.707 | 23 | SB | Large T | B4001 |
| 561 SEFLLEKRIL | 0.683 | 30 | SB | Large T | B4001 |
| 279 VETKCEDVFL | 0.502 | 218 | WB | Large T | B4001 |
| 264 EETKQVSWKL | 0.500 | 224 | WB | Large T | B4001 |
| 7 EESMELMDLL | 0.488 | 253 | WB | Large T | B4001 |
| 455 MERLTFELGV | 0.485 | 263 | WB | Large T | B4001 |
| 561 SEFLLEKRIL | 0.595 | 80 | WB | Large T | B4002 |
| 7 EESMELMDLL | 0.482 | 271 | WB | Large T | B4002 |
| 229 KEYLLYSALT | 0.482 | 272 | WB | Large T | B4002 |
| 279 VETKCEDVFL | 0.472 | 303 | WB | Large T | B4002 |
| 87 EEWESWWSSF | 0.458 | 353 | WB | Large T | B4002 |
| 561 SEFLLEKRIL | 0.496 | 233 | WB | Large T | B4403 |
| 606 SEISMYTFSR | 0.427 | 493 | WB | Large T | B4403 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos peptide | logscore | affinity (nM) | Bind Level | Protein Name | Allele |
|---|---|---|---|---|---|
| 453 LPMERLTFEL | 0.695 | 27 | SB | Large T | B5101 |
| 240 DPYHIIEESI | 0.492 | 244 | WB | Large T | B5101 |
| 486 LPSGHGINNL | 0.447 | 397 | WB | Large T | B5101 |
| 453 LPMERLTFEL | 0.721 | 20 | SB | Large T | B5301 |
| 262 EPEETKQVSW | 0.716 | 21 | SB | Large T | B5301 |
| 486 LPSGHGINNL | 0.585 | 89 | WB | Large T | B5301 |
| 427 GPIDSGKTTL | 0.470 | 308 | WB | Large T | B5301 |
| 200 TPHRHRVSAI | 0.457 | 356 | WB | Large T | B5301 |
| 139 FPSDLHQFLS | 0.584 | 89 | WB | Large T | B5401 |
| 26 LPLMRKAYLK | 0.511 | 197 | WB | Large T | B5401 |
| 160 FAVYTTKEKA | 0.489 | 252 | WB | Large T | B5401 |
| 453 LPMERLTFEL | 0.483 | 267 | WB | Large T | B5401 |
| 67 VAHQPDFGTW | 0.448 | 393 | WB | Large T | B5701 |
| 67 VAHQPDFGTW | 0.537 | 149 | WB | Large T | B5801 |
| 464 VAIDQYMVVF | 0.503 | 216 | WB | Large T | B5801 |
| 20 RAAWGNLPLM | 0.485 | 263 | WB | Large T | B5801 |
| 556 KSLQNSEFLL | 0.475 | 293 | WB | Large T | B5801 |
| 175 KLMEKYSVTF | 0.437 | 440 | WB | Large T | B5801 |
| 31 KAYLKKCKEF | 0.431 | 473 | WB | Large T | B5801 |
| 591 KDIQSRIVEW | 0.430 | 474 | WB | Large T | B5801 |
| 11-mers | | | | | |
| 163 YTTKEKAQILY | 0.682 | 31 | SB | Large T | A0101 |
| 388 YMAGVAWLHCL | 0.862 | 4 | SB | Large T | A0201 |
| 175 KLMEKYSVTFI | 0.854 | 4 | SB | Large T | A0201 |
| 576 LLLLLIWFRPV | 0.708 | 23 | SB | Large T | A0201 |
| 369 ILDKMDLIFGA | 0.641 | 48 | SB | Large T | A0201 |
| 569 ILQSGMTLLLL | 0.609 | 68 | WB | Large T | A0201 |
| 146 FLSQAVFSNRT | 0.563 | 113 | WB | Large T | A0201 |
| 198 FLTPHRHRVSA | 0.558 | 119 | WB | Large T | A0201 |
| 287 FLLLGMYLEFQ | 0.530 | 162 | WB | Large T | A0201 |
| 568 RILQSGMTLLL | 0.506 | 209 | WB | Large T | A0201 |
| 528 TMNEYPVPKTL | 0.501 | 222 | WB | Large T | A0201 |
| 439 GLLDLCGGKAL | 0.469 | 312 | WB | Large T | A0201 |
| 448 ALNVNLPMERL | 0.469 | 313 | WB | Large T | A0201 |
| 577 LLLLIWFRPVA | 0.462 | 336 | WB | Large T | A0201 |
| 11 ELMDLLGLERA | 0.458 | 351 | WB | Large T | A0201 |
| 217 CTFSFLICKGV | 0.447 | 398 | WB | Large T | A0201 |
| 152 FSNRTLACFAV | 0.439 | 431 | WB | Large T | A0201 |
| 269 VSWKLITEYAV | 0.439 | 432 | WB | Large T | A0201 |
| 570 LQSGMTLLLLL | 0.434 | 457 | WB | Large T | A0201 |
| 2 KVLNREESMEL | 0.432 | 467 | WB | Large T | A0201 |
| 388 YMAGVAWLHCL | 0.869 | 4 | SB | Large T | A0202 |
| 175 KLMEKYSVTFI | 0.858 | 4 | SB | Large T | A0202 |
| 189 MCAGHNIIFFL | 0.726 | 19 | SB | Large T | A0202 |
| 198 FLTPHRHRVSA | 0.718 | 21 | SB | Large T | A0202 |
| 146 FLSQAVFSNRT | 0.718 | 21 | SB | Large T | A0202 |
| 570 LQSGMTLLLLL | 0.667 | 36 | SB | Large T | A0202 |
| 569 ILQSGMTLLLL | 0.666 | 36 | SB | Large T | A0202 |
| 448 ALNVNLPMERL | 0.624 | 58 | WB | Large T | A0202 |
| 576 LLLLLIWFRPV | 0.621 | 60 | WB | Large T | A0202 |
| 152 FSNRTLACFAV | 0.601 | 74 | WB | Large T | A0202 |
| 287 FLLLGMYLEFQ | 0.593 | 82 | WB | Large T | A0202 |
| 528 TMNEYPVPKTL | 0.587 | 87 | WB | Large T | A0202 |
| 11 ELMDLLGLERA | 0.582 | 92 | WB | Large T | A0202 |
| 243 HIIEESIQGGL | 0.571 | 103 | WB | Large T | A0202 |
| 369 ILDKMDLIFGA | 0.561 | 115 | WB | Large T | A0202 |
| 212 FCQKLCTFSFL | 0.560 | 116 | WB | Large T | A0202 |
| 375 LIFGAHGNAVL | 0.541 | 142 | WB | Large T | A0202 |
| 461 ELGVAIDQYMV | 0.541 | 143 | WB | Large T | A0202 |
| 409 FLHCVVFNVPK | 0.524 | 171 | WB | Large T | A0202 |
| 439 GLLDLCGGKAL | 0.519 | 181 | WB | Large T | A0202 |
| 452 NLPMERLTFEL | 0.515 | 189 | WB | Large T | A0202 |
| 407 FDFLHCVVFNV | 0.493 | 239 | WB | Large T | A0202 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 3 | VLNREESMELM | 0.491 | 245 | WB | Large T | A0202 |
| 268 | QVSWKLITEYA | 0.488 | 255 | WB | Large T | A0202 |
| 290 | LGMYLEFQYNV | 0.481 | 273 | WB | Large T | A0202 |
| 217 | CTFSFLICKGV | 0.464 | 330 | WB | Large T | A0202 |
| 564 | LLEKRILQSGM | 0.447 | 398 | WB | Large T | A0202 |
| 222 | LICKGVNKEYL | 0.436 | 448 | WB | Large T | A0202 |
| 226 | GVNKEYLLYSA | 0.428 | 485 | WB | Large T | A0202 |
| 388 | YMAGVAWLHCL | 0.868 | 4 | SB | Large T | A0203 |
| 175 | KLMEKYSVTFI | 0.862 | 4 | SB | Large T | A0203 |
| 198 | FLTPHRHRVSA | 0.779 | 10 | SB | Large T | A0203 |
| 528 | TMNEYPVPKTL | 0.766 | 12 | SB | Large T | A0203 |
| 576 | LLLLLIWFRPV | 0.728 | 19 | SB | Large T | A0203 |
| 569 | ILQSGMTLLLL | 0.703 | 24 | SB | Large T | A0203 |
| 146 | FLSQAVFSNRT | 0.702 | 25 | SB | Large T | A0203 |
| 448 | ALNVNLPMERL | 0.668 | 36 | SB | Large T | A0203 |
| 11 | ELMDLLGLERA | 0.652 | 42 | SB | Large T | A0203 |
| 439 | GLLDLCGGKAL | 0.593 | 81 | WB | Large T | A0203 |
| 268 | QVSWKLITEYA | 0.577 | 97 | WB | Large T | A0203 |
| 570 | LQSGMTLLLLL | 0.548 | 132 | WB | Large T | A0203 |
| 226 | GVNKEYLLYSA | 0.540 | 144 | WB | Large T | A0203 |
| 243 | HIIEESIQGGL | 0.523 | 174 | WB | Large T | A0203 |
| 375 | LIFGAHGNAVL | 0.522 | 176 | WB | Large T | A0203 |
| 382 | NAVLEQYMAGV | 0.516 | 188 | WB | Large T | A0203 |
| 217 | CTFSFLICKGV | 0.515 | 190 | WB | Large T | A0203 |
| 374 | DLIFGAHGNAV | 0.511 | 197 | WB | Large T | A0203 |
| 404 | SVIFDFLHCVV | 0.498 | 229 | WB | Large T | A0203 |
| 152 | FSNRTLACFAV | 0.491 | 245 | WB | Large T | A0203 |
| 3 | VLNREESMELM | 0.473 | 298 | WB | Large T | A0203 |
| 287 | FLLLGMYLEFQ | 0.469 | 312 | WB | Large T | A0203 |
| 452 | NLPMERLTFEL | 0.465 | 327 | WB | Large T | A0203 |
| 369 | ILDKMDLIFGA | 0.464 | 328 | WB | Large T | A0203 |
| 568 | RILQSGMTLLL | 0.457 | 356 | WB | Large T | A0203 |
| 199 | LTPHRHRVSAI | 0.453 | 373 | WB | Large T | A0203 |
| 471 | VVFEDVKGTGA | 0.450 | 383 | WB | Large T | A0203 |
| 469 | YMVVFEDVKGT | 0.450 | 385 | WB | Large T | A0203 |
| 388 | YMAGVAWLHCL | 0.691 | 28 | SB | Large T | A0204 |
| 528 | TMNEYPVPKTL | 0.687 | 29 | SB | Large T | A0204 |
| 175 | KLMEKYSVTFI | 0.670 | 35 | SB | Large T | A0204 |
| 576 | LLLLLIWFRPV | 0.616 | 63 | WB | Large T | A0204 |
| 198 | FLTPHRHRVSA | 0.583 | 91 | WB | Large T | A0204 |
| 2 | KVLNREESMEL | 0.525 | 170 | WB | Large T | A0204 |
| 569 | ILQSGMTLLLL | 0.449 | 386 | WB | Large T | A0204 |
| 336 | SICQQAVDTVL | 0.431 | 472 | WB | Large T | A0204 |
| 544 | RQIDFRPKIYL | 0.801 | 8 | SB | Large T | A0206 |
| 388 | YMAGVAWLHCL | 0.796 | 9 | SB | Large T | A0206 |
| 175 | KLMEKYSVTFI | 0.743 | 16 | SB | Large T | A0206 |
| 576 | LLLLLIWFRPV | 0.738 | 16 | SB | Large T | A0206 |
| 570 | LQSGMTLLLLL | 0.711 | 22 | SB | Large T | A0206 |
| 198 | FLTPHRHRVSA | 0.706 | 24 | SB | Large T | A0206 |
| 404 | SVIFDFLHCVV | 0.688 | 29 | SB | Large T | A0206 |
| 152 | FSNRTLACFAV | 0.646 | 46 | SB | Large T | A0206 |
| 568 | RILQSGMTLLL | 0.644 | 47 | SB | Large T | A0206 |
| 369 | ILDKMDLIFGA | 0.622 | 59 | WB | Large T | A0206 |
| 2 | KVLNREESMEL | 0.620 | 61 | WB | Large T | A0206 |
| 148 | SQAVFSNRTLA | 0.618 | 62 | WB | Large T | A0206 |
| 335 | KSICQQAVDTV | 0.568 | 106 | WB | Large T | A0206 |
| 382 | NAVLEQYMAGV | 0.548 | 133 | WB | Large T | A0206 |
| 519 | TQIFPPGLVTM | 0.539 | 146 | WB | Large T | A0206 |
| 243 | HIIEESIQGGL | 0.519 | 182 | WB | Large T | A0206 |
| 287 | FLLLGMYLEFQ | 0.515 | 191 | WB | Large T | A0206 |
| 146 | FLSQAVFSNRT | 0.506 | 210 | WB | Large T | A0206 |
| 569 | ILQSGMTLLLL | 0.487 | 256 | WB | Large T | A0206 |
| 439 | GLLDLCGGKAL | 0.478 | 284 | WB | Large T | A0206 |
| 213 | CQKLCTFSFLI | 0.469 | 312 | WB | Large T | A0206 |
| 542 | FVRQIDFRPKI | 0.464 | 330 | WB | Large T | A0206 |
| 267 | KQVSWKLITEY | 0.462 | 336 | WB | Large T | A0206 |
| 471 | VVFEDVKGTGA | 0.460 | 343 | WB | Large T | A0206 |
| 383 | AVLEQYMAGVA | 0.445 | 407 | WB | Large T | A0206 |
| 577 | LLLLIWFRPVA | 0.444 | 408 | WB | Large T | A0206 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 155 | RTLACFAVYTT | 0.442 | 419 | WB | Large T | A0206 |
| 268 | QVSWKLITEYA | 0.438 | 437 | WB | Large T | A0206 |
| 375 | LIFGAHGNAVL | 0.437 | 441 | WB | Large T | A0206 |
| 452 | NLPMERLTFEL | 0.429 | 479 | WB | Large T | A0206 |
| 296 | FQYNVEECKKC | 0.427 | 490 | WB | Large T | A0206 |
| 388 | YMAGVAWLHCL | 0.966 | 1 | SB | Large T | A0211 |
| 198 | FLTPHRHRVSA | 0.943 | 1 | SB | Large T | A0211 |
| 576 | LLLLLIWFRPV | 0.898 | 3 | SB | Large T | A0211 |
| 569 | ILQSGMTLLLL | 0.893 | 3 | SB | Large T | A0211 |
| 439 | GLLDLCGGKAL | 0.887 | 3 | SB | Large T | A0211 |
| 452 | NLPMERLTFEL | 0.875 | 3 | SB | Large T | A0211 |
| 369 | ILDKMDLIFGA | 0.868 | 4 | SB | Large T | A0211 |
| 528 | TMNEYPVPKTL | 0.858 | 4 | SB | Large T | A0211 |
| 461 | ELGVAIDQYMV | 0.854 | 4 | SB | Large T | A0211 |
| 287 | FLLLGMYLEFQ | 0.832 | 6 | SB | Large T | A0211 |
| 454 | PMERLTFELGV | 0.823 | 6 | SB | Large T | A0211 |
| 11 | ELMDLLGLERA | 0.815 | 7 | SB | Large T | A0211 |
| 360 | EMLTERFNHIL | 0.779 | 10 | SB | Large T | A0211 |
| 374 | DLIFGAHGNAV | 0.775 | 11 | SB | Large T | A0211 |
| 175 | KLMEKYSVTFI | 0.773 | 11 | SB | Large T | A0211 |
| 577 | LLLLIWFRPVA | 0.765 | 12 | SB | Large T | A0211 |
| 568 | RILQSGMTLLL | 0.755 | 14 | SB | Large T | A0211 |
| 288 | LLLGMYLEFQY | 0.753 | 14 | SB | Large T | A0211 |
| 341 | AVDTVLAKKRV | 0.752 | 14 | SB | Large T | A0211 |
| 448 | ALNVNLPMERL | 0.747 | 15 | SB | Large T | A0211 |
| 375 | LIFGAHGNAVL | 0.691 | 28 | SB | Large T | A0211 |
| 603 | RLDSEISMYTF | 0.681 | 31 | SB | Large T | A0211 |
| 404 | SVIFDPLHCVV | 0.671 | 35 | SB | Large T | A0211 |
| 12 | LMDLLGLERAA | 0.669 | 35 | SB | Large T | A0211 |
| 146 | FLSQAVFSNRT | 0.648 | 45 | SB | Large T | A0211 |
| 485 | DLPSGHGINNL | 0.644 | 47 | SB | Large T | A0211 |
| 563 | FLLEKRILQSG | 0.601 | 74 | WB | Large T | A0211 |
| 2 | KVLNREESMEL | 0.597 | 77 | WB | Large T | A0211 |
| 501 | YLDGSVKVNLE | 0.596 | 78 | WB | Large T | A0211 |
| 189 | MCAGHNIIFFL | 0.591 | 83 | WB | Large T | A0211 |
| 428 | PIDSGKTTLAA | 0.577 | 97 | WB | Large T | A0211 |
| 405 | VIFDPLHCVVF | 0.563 | 112 | WB | Large T | A0211 |
| 196 | IFFLTPHRHRV | 0.551 | 128 | WB | Large T | A0211 |
| 217 | CTFSFLICKGV | 0.550 | 130 | WB | Large T | A0211 |
| 269 | VSWKLITEYAV | 0.549 | 132 | WB | Large T | A0211 |
| 109 | DMFASDEEATA | 0.544 | 138 | WB | Large T | A0211 |
| 544 | RQIDFRPKIYL | 0.542 | 141 | WB | Large T | A0211 |
| 3 | VLNREESMELM | 0.535 | 153 | WB | Large T | A0211 |
| 557 | SLQNSEFLLEK | 0.517 | 186 | WB | Large T | A0211 |
| 533 | PVPKTLQARFV | 0.511 | 198 | WB | Large T | A0211 |
| 243 | HIIEESIQGGL | 0.500 | 224 | WB | Large T | A0211 |
| 401 | KMDSVIFDFLH | 0.486 | 260 | WB | Large T | A0211 |
| 222 | LICKGVNKEYL | 0.462 | 338 | WB | Large T | A0211 |
| 353 | TLHMTREEMLT | 0.459 | 349 | WB | Large T | A0211 |
| 232 | LLYSALTRDPY | 0.435 | 449 | WB | Large T | A0211 |
| 215 | KLCTFSFLICK | 0.435 | 452 | WB | Large T | A0211 |
| 573 | GMTLLLLLIWF | 0.433 | 459 | WB | Large T | A0211 |
| 423 | WLFKGPIDSGK | 0.428 | 487 | WB | Large T | A0211 |
| 388 | YMAGVAWLHCL | 0.936 | 1 | SB | Large T | A0212 |
| 198 | FLTPHRHRVSA | 0.906 | 2 | SB | Large T | A0212 |
| 439 | GLLDLCGGKAL | 0.823 | 6 | SB | Large T | A0212 |
| 528 | TMNEYPVPKTL | 0.817 | 7 | SB | Large T | A0212 |
| 576 | LLLLLIWFRPV | 0.817 | 7 | SB | Large T | A0212 |
| 454 | PMERLTFELGV | 0.806 | 8 | SB | Large T | A0212 |
| 569 | ILQSGMTLLLL | 0.801 | 8 | SB | Large T | A0212 |
| 287 | FLLLGMYLEFQ | 0.777 | 11 | SB | Large T | A0212 |
| 369 | ILDKMDLIFGA | 0.756 | 13 | SB | Large T | A0212 |
| 374 | DLIFGAHGNAV | 0.706 | 24 | SB | Large T | A0212 |
| 360 | EMLTERFNHIL | 0.682 | 31 | SB | Large T | A0212 |
| 461 | ELGVAIDQYMV | 0.658 | 40 | SB | Large T | A0212 |
| 288 | LLLGMYLEFQY | 0.655 | 41 | SB | Large T | A0212 |
| 11 | ELMDLLGLERA | 0.654 | 42 | SB | Large T | A0212 |
| 452 | NLPMERLTFEL | 0.645 | 46 | SB | Large T | A0212 |
| 563 | FLLEKRILQSG | 0.643 | 47 | SB | Large T | A0212 |
| 375 | LIFGAHGNAVL | 0.631 | 54 | WB | Large T | A0212 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 175 | KLMEKYSVTFI | 0.620 | 60 | WB | Large T | A0212 |
| 577 | LLLLIWFRPVA | 0.601 | 74 | WB | Large T | A0212 |
| 269 | VSWKLITEYAV | 0.598 | 77 | WB | Large T | A0212 |
| 12 | LMDLLGLERAA | 0.577 | 96 | WB | Large T | A0212 |
| 146 | FLSQAVFSNRT | 0.577 | 97 | WB | Large T | A0212 |
| 448 | ALNVNLPMERL | 0.574 | 100 | WB | Large T | A0212 |
| 341 | AVDTVLAKKRV | 0.549 | 132 | WB | Large T | A0212 |
| 485 | DLPSGHGINNL | 0.537 | 149 | WB | Large T | A0212 |
| 405 | VIFDFLHCVVF | 0.536 | 151 | WB | Large T | A0212 |
| 3 | VLNREESMELM | 0.514 | 192 | WB | Large T | A0212 |
| 423 | WLFKGPIDSGK | 0.499 | 225 | WB | Large T | A0212 |
| 2 | KVLNREESMEL | 0.481 | 273 | WB | Large T | A0212 |
| 404 | SVIFDFLHCVV | 0.458 | 350 | WB | Large T | A0212 |
| 564 | LLEKRILQSGM | 0.452 | 374 | WB | Large T | A0212 |
| 469 | YMVVFEDVKGT | 0.452 | 377 | WB | Large T | A0212 |
| 243 | HIIEESIQGGL | 0.441 | 421 | WB | Large T | A0212 |
| 222 | LICKGVNKEYL | 0.440 | 428 | WB | Large T | A0212 |
| 217 | CTFSFLICKGV | 0.437 | 444 | WB | Large T | A0212 |
| 196 | IFFLTPHRHRV | 0.436 | 445 | WB | Large T | A0212 |
| 189 | MCAGHNIIFFL | 0.432 | 469 | WB | Large T | A0212 |
| 471 | VVFEDVKGTGA | 0.426 | 495 | WB | Large T | A0212 |
| 388 | YMAGVAWLHCL | 0.907 | 2 | SB | Large T | A0216 |
| 198 | FLTPHRHRVSA | 0.867 | 4 | SB | Large T | A0216 |
| 461 | ELGVAIDQYMV | 0.859 | 4 | SB | Large T | A0216 |
| 569 | ILQSGMTLLLL | 0.824 | 6 | SB | Large T | A0216 |
| 452 | NLPMERLTFEL | 0.778 | 11 | SB | Large T | A0216 |
| 454 | PMERLTFELGV | 0.771 | 11 | SB | Large T | A0216 |
| 576 | LLLLLIWFRPV | 0.754 | 14 | SB | Large T | A0216 |
| 528 | TMNEYPVPKTL | 0.752 | 14 | SB | Large T | A0216 |
| 374 | DLIFGAHGNAV | 0.737 | 17 | SB | Large T | A0216 |
| 287 | FLLLGMYLEFQ | 0.712 | 22 | SB | Large T | A0216 |
| 341 | AVDTVLAKKRV | 0.711 | 22 | SB | Large T | A0216 |
| 369 | ILDKMDLIFGA | 0.696 | 26 | SB | Large T | A0216 |
| 448 | ALNVNLPMERL | 0.693 | 27 | SB | Large T | A0216 |
| 175 | KLMEKYSVTFI | 0.691 | 28 | SB | Large T | A0216 |
| 439 | GLLDLCGGKAL | 0.678 | 32 | SB | Large T | A0216 |
| 146 | FLSQAVFSNRT | 0.661 | 39 | SB | Large T | A0216 |
| 11 | ELMDLLGLERA | 0.650 | 43 | SB | Large T | A0216 |
| 485 | DLPSGHGINNL | 0.642 | 48 | SB | Large T | A0216 |
| 375 | LIFGAHGNAVL | 0.639 | 49 | SB | Large T | A0216 |
| 360 | EMLTERFNHIL | 0.631 | 54 | WB | Large T | A0216 |
| 222 | LICKGVNKEYL | 0.620 | 60 | WB | Large T | A0216 |
| 568 | RILQSGMTLLL | 0.559 | 118 | WB | Large T | A0216 |
| 196 | IFFLTPHRHRV | 0.554 | 124 | WB | Large T | A0216 |
| 533 | PVPKTLQARFV | 0.551 | 128 | WB | Large T | A0216 |
| 404 | SVIFDFLHCVV | 0.528 | 165 | WB | Large T | A0216 |
| 189 | MCAGHNIIFFL | 0.523 | 173 | WB | Large T | A0216 |
| 288 | LLLGMYLEFQY | 0.517 | 186 | WB | Large T | A0216 |
| 2 | KVLNREESMEL | 0.514 | 191 | WB | Large T | A0216 |
| 577 | LLLLIWFRPVA | 0.493 | 240 | WB | Large T | A0216 |
| 544 | RQIDFRPKIYL | 0.485 | 264 | WB | Large T | A0216 |
| 269 | VSWKLITEYAV | 0.483 | 267 | WB | Large T | A0216 |
| 161 | AVYTTKEKAQI | 0.475 | 293 | WB | Large T | A0216 |
| 109 | DMFASDEEATA | 0.457 | 355 | WB | Large T | A0216 |
| 388 | YMAGVAWLHCL | 0.952 | 1 | SB | Large T | A0219 |
| 569 | ILQSGMTLLLL | 0.841 | 5 | SB | Large T | A0219 |
| 198 | FLTPHRHRVSA | 0.685 | 30 | SB | Large T | A0219 |
| 576 | LLLLLIWFRPV | 0.681 | 31 | SB | Large T | A0219 |
| 287 | FLLLGMYLEFQ | 0.664 | 37 | SB | Large T | A0219 |
| 461 | ELGVAIDQYMV | 0.655 | 41 | SB | Large T | A0219 |
| 369 | ILDKMDLIFGA | 0.647 | 45 | SB | Large T | A0219 |
| 11 | ELMDLLGLERA | 0.602 | 73 | WB | Large T | A0219 |
| 454 | PMERLTFELGV | 0.584 | 90 | WB | Large T | A0219 |
| 448 | ALNVNLPMERL | 0.562 | 114 | WB | Large T | A0219 |
| 146 | FLSQAVFSNRT | 0.559 | 118 | WB | Large T | A0219 |
| 374 | DLIFGAHGNAV | 0.556 | 121 | WB | Large T | A0219 |
| 360 | EMLTERFNHIL | 0.537 | 149 | WB | Large T | A0219 |
| 528 | TMNEYPVPKTL | 0.532 | 157 | WB | Large T | A0219 |
| 485 | DLPSGHGINNL | 0.524 | 172 | WB | Large T | A0219 |
| 452 | NLPMERLTFEL | 0.507 | 206 | WB | Large T | A0219 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 341 | AVDTVLAKKRV | 0.499 | 226 | WB | Large T | A0219 |
| 439 | GLLDLCGGKAL | 0.485 | 262 | WB | Large T | A0219 |
| 189 | MCAGHNIIFFL | 0.462 | 337 | WB | Large T | A0219 |
| 175 | KLMEKYSVTFI | 0.454 | 367 | WB | Large T | A0219 |
| 269 | VSWKLITEYAV | 0.448 | 394 | WB | Large T | A0219 |
| 156 | TLACFAVYTTK | 0.728 | 18 | SB | Large T | A0301 |
| 409 | FLHCVVFNVPK | 0.709 | 23 | SB | Large T | A0301 |
| 215 | KLCTFSFLICK | 0.671 | 35 | SB | Large T | A0301 |
| 50 | KMKRMNTLYKK | 0.667 | 36 | SB | Large T | A0301 |
| 391 | GVAWLHCLLPK | 0.656 | 41 | SB | Large T | A0301 |
| 205 | RVSAINNFCQK | 0.650 | 44 | SB | Large T | A0301 |
| 56 | TLYKKMEQDVK | 0.645 | 46 | SB | Large T | A0301 |
| 507 | KVNLEKKHLNK | 0.586 | 88 | WB | Large T | A0301 |
| 219 | FSFLICKGVNK | 0.581 | 92 | WB | Large T | A0301 |
| 195 | IIFFLTPHRHR | 0.575 | 99 | WB | Large T | A0301 |
| 164 | TTKEKAQILYK | 0.549 | 131 | WB | Large T | A0301 |
| 557 | SLQNSEFLLEK | 0.539 | 146 | WB | Large T | A0301 |
| 272 | KLITEYAVETK | 0.533 | 156 | WB | Large T | A0301 |
| 21 | AAWGNLPLMRK | 0.508 | 205 | WB | Large T | A0301 |
| 416 | NVPKRRYWLFK | 0.507 | 206 | WB | Large T | A0301 |
| 608 | ISMYTFSRMKY | 0.491 | 247 | WB | Large T | A0301 |
| 574 | MTLLLLLIWFR | 0.485 | 261 | WB | Large T | A0301 |
| 673 | HLCKGFQCFKR | 0.459 | 348 | WB | Large T | A0301 |
| 28 | LMRKAYLKKCK | 0.454 | 369 | WB | Large T | A0301 |
| 244 | IIEESIQGGLK | 0.448 | 393 | WB | Large T | A0301 |
| 497 | SLRDYLDGSVK | 0.443 | 416 | WB | Large T | A0301 |
| 423 | WLFKGPIDSGK | 0.432 | 464 | WB | Large T | A0301 |
| 401 | KMDSVIFDFLH | 0.427 | 490 | WB | Large T | A0301 |
| 391 | GVAWLHCLLPK | 0.825 | 6 | SB | Large T | A1101 |
| 215 | KLCTFSFLICK | 0.800 | 8 | SB | Large T | A1101 |
| 557 | SLQNSEFLLEK | 0.791 | 9 | SB | Large T | A1101 |
| 205 | RVSAINNFCQK | 0.784 | 10 | SB | Large T | A1101 |
| 574 | MTLLLLLIWFR | 0.768 | 12 | SB | Large T | A1101 |
| 21 | AAWGNLPLMRK | 0.742 | 16 | SB | Large T | A1101 |
| 164 | TTKEKAQILYK | 0.721 | 20 | SB | Large T | A1101 |
| 156 | TLACFAVYTTK | 0.719 | 20 | SB | Large T | A1101 |
| 526 | LVTMNEYPVPK | 0.716 | 21 | SB | Large T | A1101 |
| 507 | KVNLEKKHLNK | 0.706 | 24 | SB | Large T | A1101 |
| 325 | AIIFAESKNQK | 0.702 | 25 | SB | Large T | A1101 |
| 169 | AQILYKKLMEK | 0.699 | 25 | SB | Large T | A1101 |
| 118 | TADSQHSTPPK | 0.677 | 32 | SB | Large T | A1101 |
| 416 | NVPKRRYWLFK | 0.651 | 43 | SB | Large T | A1101 |
| 56 | TLYKKMEQDVK | 0.640 | 49 | SB | Large T | A1101 |
| 50 | KMKRMNTLYKK | 0.634 | 52 | WB | Large T | A1101 |
| 447 | KALNVNLPMER | 0.627 | 56 | WB | Large T | A1101 |
| 322 | FANAIIFAESK | 0.620 | 61 | WB | Large T | A1101 |
| 608 | ISMYTFSRMKY | 0.609 | 68 | WB | Large T | A1101 |
| 219 | FSFLICKGVNK | 0.594 | 80 | WB | Large T | A1101 |
| 338 | CQQAVDTVLAK | 0.593 | 81 | WB | Large T | A1101 |
| 362 | LTERFNHILDK | 0.588 | 86 | WB | Large T | A1101 |
| 409 | FLHCVVFNVPK | 0.555 | 122 | WB | Large T | A1101 |
| 195 | IIFFLTPHRHR | 0.547 | 134 | WB | Large T | A1101 |
| 437 | AAGLLDLCGGK | 0.547 | 134 | WB | Large T | A1101 |
| 20 | RAAWGNLPLMR | 0.531 | 160 | WB | Large T | A1101 |
| 272 | KLITEYAVETK | 0.526 | 169 | WB | Large T | A1101 |
| 607 | EISMYTFSRMK | 0.523 | 174 | WB | Large T | A1101 |
| 244 | IIEESIQGGLK | 0.506 | 209 | WB | Large T | A1101 |
| 339 | QQAVDTVLAKK | 0.471 | 307 | WB | Large T | A1101 |
| 467 | DQYMVVFEDVK | 0.445 | 404 | WB | Large T | A1101 |
| 497 | SLRDYLDGSVK | 0.436 | 448 | WB | Large T | A1101 |
| 581 | IWFRPVADFSK | 0.434 | 454 | WB | Large T | A1101 |
| 312 | PYHFKYHEKHF | 0.709 | 23 | SB | Large T | A2301 |
| 286 | VFLLLGMYLEF | 0.704 | 24 | SB | Large T | A2301 |
| 610 | MYTFSRMKYNI | 0.668 | 36 | SB | Large T | A2301 |
| 581 | IWFRPVADFSK | 0.626 | 57 | WB | Large T | A2301 |
| 500 | DYLDGSVKVNL | 0.598 | 77 | WB | Large T | A2301 |
| 211 | NFCQKLCTFSF | 0.575 | 99 | WB | Large T | A2301 |
| 83 | TYGTEEWESWW | 0.560 | 116 | WB | Large T | A2301 |
| 187 | RHMCAGHNIIF | 0.491 | 245 | WB | Large T | A2301 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 179 | KYSVTFISRHM | 0.485 | 263 | WB | Large T | A2301 |
| 316 | KYHEKHFANAI | 0.478 | 282 | WB | Large T | A2301 |
| 295 | EFQYNVEECKK | 0.478 | 283 | WB | Large T | A2301 |
| 617 | KYNICMGKCIL | 0.477 | 288 | WB | Large T | A2301 |
| 95 | SFNEKWDEDLF | 0.476 | 289 | WB | Large T | A2301 |
| 553 | YLRKSLQNSEF | 0.468 | 316 | WB | Large T | A2301 |
| 162 | VYTTKEKAQIL | 0.451 | 380 | WB | Large T | A2301 |
| 405 | VIFDFLHCVVF | 0.442 | 417 | WB | Large T | A2301 |
| 316 | KYHEKHFANAI | 0.677 | 33 | SB | Large T | A2402 |
| 286 | VFLLLGMYLEF | 0.676 | 33 | SB | Large T | A2402 |
| 312 | PYHFKYHEKHF | 0.617 | 62 | WB | Large T | A2402 |
| 610 | MYTFSRMKYNI | 0.570 | 105 | WB | Large T | A2402 |
| 83 | TYGTEEWESWW | 0.514 | 192 | WB | Large T | A2402 |
| 179 | KYSVTFISRHM | 0.513 | 193 | WB | Large T | A2402 |
| 162 | VYTTKEKAQIL | 0.482 | 272 | WB | Large T | A2402 |
| 211 | NFCQKLCTFSF | 0.461 | 341 | WB | Large T | A2402 |
| 286 | VFLLLGMYLEF | 0.742 | 16 | SB | Large T | A2403 |
| 316 | KYHEKHFANAI | 0.713 | 22 | SB | Large T | A2403 |
| 83 | TYGTEEWESWW | 0.653 | 42 | SB | Large T | A2403 |
| 312 | PYHFKYHEKHF | 0.613 | 66 | WB | Large T | A2403 |
| 397 | CLLPKMDSVIF | 0.571 | 103 | WB | Large T | A2403 |
| 162 | VYTTKEKAQIL | 0.563 | 112 | WB | Large T | A2403 |
| 365 | RFNHILDKMDL | 0.554 | 124 | WB | Large T | A2403 |
| 553 | YLRKSLQNSEF | 0.528 | 165 | WB | Large T | A2403 |
| 617 | KYNICMGKCIL | 0.509 | 202 | WB | Large T | A2403 |
| 211 | NFCQKLCTFSF | 0.504 | 213 | WB | Large T | A2403 |
| 95 | SFNEKWDEDLF | 0.478 | 285 | WB | Large T | A2403 |
| 187 | RHMCAGHNIIF | 0.466 | 321 | WB | Large T | A2403 |
| 163 | YTTKEKAQILY | 0.631 | 54 | WB | Large T | A2601 |
| 8 | ESMELMDLLGL | 0.474 | 297 | WB | Large T | A2601 |
| 163 | YTTKEKAQILY | 0.728 | 19 | SB | Large T | A2602 |
| 150 | AVFSNRTLACF | 0.703 | 24 | SB | Large T | A2602 |
| 170 | QILYKKLMEKY | 0.637 | 51 | WB | Large T | A2602 |
| 405 | VIFDFLHCVVF | 0.629 | 55 | WB | Large T | A2602 |
| 280 | ETKCEDVFLLL | 0.628 | 56 | WB | Large T | A2602 |
| 463 | GVAIDQYMVVF | 0.624 | 58 | WB | Large T | A2602 |
| 243 | HIIEESIQGGL | 0.535 | 153 | WB | Large T | A2602 |
| 356 | MTREEMLTERF | 0.491 | 247 | WB | Large T | A2602 |
| 142 | DLHQFLSQAVF | 0.472 | 304 | WB | Large T | A2602 |
| 450 | NVNLPMERLTF | 0.453 | 372 | WB | Large T | A2602 |
| 553 | YLRKSLQNSEF | 0.450 | 382 | WB | Large T | A2602 |
| 74 | GTWNSSEVPTY | 0.435 | 453 | WB | Large T | A2602 |
| 8 | ESMELMDLLGL | 0.433 | 462 | WB | Large T | A2602 |
| 221 | FLICKGVNKEY | 0.621 | 60 | WB | Large T | A2902 |
| 288 | LLLGMYLEFQY | 0.600 | 75 | WB | Large T | A2902 |
| 163 | YTTKEKAQILY | 0.475 | 293 | WB | Large T | A2902 |
| 286 | VFLLLGMYLEF | 0.470 | 307 | WB | Large T | A2902 |
| 170 | QILYKKLMEKY | 0.430 | 478 | WB | Large T | A2902 |
| 405 | VIFDFLHCVVF | 0.427 | 492 | WB | Large T | A2902 |
| 50 | KMKRMNTLYKK | 0.760 | 13 | SB | Large T | A3001 |
| 28 | LMRKAYLKKCK | 0.745 | 15 | SB | Large T | A3001 |
| 164 | TTKEKAQILYK | 0.727 | 19 | SB | Large T | A3001 |
| 507 | KVNLEKKHLNK | 0.707 | 23 | SB | Large T | A3001 |
| 680 | CFKRPKTPPPK | 0.688 | 29 | SB | Large T | A3001 |
| 409 | FLHCVVFNVPK | 0.668 | 36 | SB | Large T | A3001 |
| 497 | SLRDYLDGSVK | 0.662 | 38 | SB | Large T | A3001 |
| 158 | ACFAVYTTKEK | 0.661 | 39 | SB | Large T | A3001 |
| 416 | NVPKRRYWLFK | 0.594 | 80 | WB | Large T | A3001 |
| 541 | RFVRQIDFRPK | 0.587 | 87 | WB | Large T | A3001 |
| 215 | KLCTFSFLICK | 0.567 | 107 | WB | Large T | A3001 |
| 348 | KKRVDTLHMTR | 0.563 | 112 | WB | Large T | A3001 |
| 205 | RVSAINNFCQK | 0.546 | 136 | WB | Large T | A3001 |
| 526 | LVTMNEYPVPK | 0.536 | 151 | WB | Large T | A3001 |
| 306 | CQKKDQPYHFK | 0.508 | 204 | WB | Large T | A3001 |
| 118 | TADSQHSTPPK | 0.505 | 211 | WB | Large T | A3001 |
| 272 | KLITEYAVETK | 0.489 | 252 | WB | Large T | A3001 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 156 | TLACFAVYTTK | 0.486 | 259 | WB | Large T | A3001 |
| 557 | SLQNSEFLLEK | 0.482 | 271 | WB | Large T | A3001 |
| 169 | AQILYKKLMEK | 0.470 | 309 | WB | Large T | A3001 |
| 539 | QARFVRQIDFR | 0.458 | 353 | WB | Large T | A3001 |
| 581 | IWFRPVADFSK | 0.451 | 378 | WB | Large T | A3001 |
| 574 | MTLLLLLIWFR | 0.433 | 462 | WB | Large T | A3001 |
| 34 | LKKCKEFHPDK | 0.429 | 482 | WB | Large T | A3001 |
| 267 | KQVSWKLITEY | 0.523 | 175 | WB | Large T | A3002 |
| 170 | QILYKKLMEKY | 0.442 | 420 | WB | Large T | A3002 |
| 574 | MTLLLLLIWFR | 0.869 | 4 | SB | Large T | A3101 |
| 50 | KMKRMNTLYKK | 0.838 | 5 | SB | Large T | A3101 |
| 447 | KALNVNLPMER | 0.794 | 9 | SB | Large T | A3101 |
| 145 | QFLSQAVFSNR | 0.744 | 15 | SB | Large T | A3101 |
| 195 | IIFFLTPHRHR | 0.736 | 17 | SB | Large T | A3101 |
| 673 | HLCKGFQCFKR | 0.670 | 35 | SB | Large T | A3101 |
| 539 | QARFVRQIDFR | 0.653 | 42 | SB | Large T | A3101 |
| 355 | HMTREEMLTER | 0.647 | 45 | SB | Large T | A3101 |
| 205 | RVSAINNFCQK | 0.637 | 50 | WB | Large T | A3101 |
| 558 | LQNSEFLLEKR | 0.626 | 57 | WB | Large T | A3101 |
| 541 | RFVRQIDFRPK | 0.624 | 58 | WB | Large T | A3101 |
| 20 | RAAWGNLPLMR | 0.617 | 63 | WB | Large T | A3101 |
| 121 | SQHSTPPKKKR | 0.607 | 70 | WB | Large T | A3101 |
| 621 | CMGKCILDITR | 0.587 | 87 | WB | Large T | A3101 |
| 177 | MEKYSVTFISR | 0.582 | 91 | WB | Large T | A3101 |
| 215 | KLCTFSFLICK | 0.554 | 124 | WB | Large T | A3101 |
| 164 | TTKEKAQILYK | 0.536 | 151 | WB | Large T | A3101 |
| 680 | CFKRPKTPPPK | 0.526 | 169 | WB | Large T | A3101 |
| 534 | VPKTLQARFVR | 0.518 | 183 | WB | Large T | A3101 |
| 193 | HNIIFFLTPHR | 0.500 | 223 | WB | Large T | A3101 |
| 507 | KVNLEKKHLNK | 0.492 | 244 | WB | Large T | A3101 |
| 306 | CQKKDQPYHFK | 0.486 | 259 | WB | Large T | A3101 |
| 526 | LVTMNEYPVPK | 0.467 | 319 | WB | Large T | A3101 |
| 229 | KEYLLYSALTR | 0.466 | 321 | WB | Large T | A3101 |
| 593 | IQSRIVEWKER | 0.449 | 389 | WB | Large T | A3101 |
| 31 | KAYLKKCKEFH | 0.448 | 392 | WB | Large T | A3101 |
| 545 | QIDFRPKIYLR | 0.448 | 393 | WB | Large T | A3101 |
| 401 | KMDSVIFDFLH | 0.443 | 415 | WB | Large T | A3101 |
| 605 | DSEISMYTFSR | 0.438 | 435 | WB | Large T | A3101 |
| 28 | LMRKAYLKKCK | 0.433 | 461 | WB | Large T | A3101 |
| 574 | MTLLLLLIWFR | 0.838 | 5 | SB | Large T | A3301 |
| 195 | IIFFLTPHRHR | 0.685 | 30 | SB | Large T | A3301 |
| 605 | DSEISMYTFSR | 0.684 | 30 | SB | Large T | A3301 |
| 539 | QARFVRQIDFR | 0.650 | 44 | SB | Large T | A3301 |
| 145 | QFLSQAVFSNR | 0.639 | 49 | SB | Large T | A3301 |
| 355 | HMTREEMLTER | 0.625 | 57 | WB | Large T | A3301 |
| 673 | HLCKGFQCFKR | 0.606 | 70 | WB | Large T | A3301 |
| 531 | EYPVPKTLQAR | 0.582 | 92 | WB | Large T | A3301 |
| 545 | QIDFRPKIYLR | 0.484 | 264 | WB | Large T | A3301 |
| 285 | DVFLLLGMYLE | 0.462 | 337 | WB | Large T | A3301 |
| 416 | NVPKRRYWLFK | 0.441 | 424 | WB | Large T | A3301 |
| 177 | MEKYSVTFISR | 0.440 | 428 | WB | Large T | A3301 |
| 574 | MTLLLLLIWFR | 0.820 | 7 | SB | Large T | A6801 |
| 607 | EISMYTFSRMK | 0.808 | 7 | SB | Large T | A6801 |
| 322 | FANAIIFAESK | 0.780 | 10 | SB | Large T | A6801 |
| 605 | DSEISMYTFSR | 0.765 | 12 | SB | Large T | A6801 |
| 195 | IIFFLTPHRHR | 0.762 | 13 | SB | Large T | A6801 |
| 156 | TLACFAVYTTK | 0.756 | 14 | SB | Large T | A6801 |
| 205 | RVSAINNFCQK | 0.712 | 22 | SB | Large T | A6801 |
| 539 | QARFVRQIDFR | 0.695 | 27 | SB | Large T | A6801 |
| 219 | FSFLICKGVNK | 0.676 | 33 | SB | Large T | A6801 |
| 193 | HNIIFFLTPHR | 0.673 | 34 | SB | Large T | A6801 |
| 673 | HLCKGFQCFKR | 0.665 | 37 | SB | Large T | A6801 |
| 164 | TTKEKAQILYK | 0.656 | 41 | SB | Large T | A6801 |
| 355 | HMTREEMLTER | 0.654 | 42 | SB | Large T | A6801 |
| 526 | LVTMNEYPVPK | 0.641 | 48 | SB | Large T | A6801 |
| 416 | NVPKRRYWLFK | 0.635 | 51 | WB | Large T | A6801 |
| 340 | QAVDTVLAKKR | 0.620 | 61 | WB | Large T | A6801 |
| 409 | FLHCVVFNVPK | 0.589 | 85 | WB | Large T | A6801 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos peptide | logscore | affinity (nM) | Bind Level | Protein Name | Allele |
|---|---|---|---|---|---|
| 20 RAAWGNLPLMR | 0.562 | 114 | WB | Large T | A6801 |
| 325 AIIFAESKNQK | 0.554 | 124 | WB | Large T | A6801 |
| 56 TLYKKMEQDVK | 0.549 | 131 | WB | Large T | A6801 |
| 163 YTTKEKAQILY | 0.548 | 132 | WB | Large T | A6801 |
| 467 DQYMVVFEDVK | 0.534 | 155 | WB | Large T | A6801 |
| 391 GVAWLHCLLPK | 0.521 | 178 | WB | Large T | A6801 |
| 608 ISMYTFSRMKY | 0.493 | 240 | WB | Large T | A6801 |
| 295 EFQYNVEECKK | 0.489 | 251 | WB | Large T | A6801 |
| 25 NLPLMRKAYLK | 0.482 | 272 | WB | Large T | A6801 |
| 447 KALNVNLPMER | 0.477 | 288 | WB | Large T | A6801 |
| 545 QIDFRPKIYLR | 0.471 | 305 | WB | Large T | A6801 |
| 362 LTERFNHILDK | 0.463 | 332 | WB | Large T | A6801 |
| 177 MEKYSVTFISR | 0.463 | 335 | WB | Large T | A6801 |
| 145 QFLSQAVFSNR | 0.460 | 343 | WB | Large T | A6801 |
| 423 WLFKGPIDSGK | 0.456 | 361 | WB | Large T | A6801 |
| 118 TADSQHSTPPK | 0.435 | 450 | WB | Large T | A6801 |
| 557 SLQNSEFLLEK | 0.430 | 477 | WB | Large T | A6801 |
| 189 MCAGHNIIFFL | 0.792 | 9 | SB | Large T | A6802 |
| 217 CTFSFLICKGV | 0.752 | 14 | SB | Large T | A6802 |
| 404 SVIFDFLHCVV | 0.734 | 17 | SB | Large T | A6802 |
| 382 NAVLEQYMAGV | 0.680 | 31 | SB | Large T | A6802 |
| 403 DSVIFDFLHCV | 0.654 | 42 | SB | Large T | A6802 |
| 8 ESMELMDLLGL | 0.653 | 42 | SB | Large T | A6802 |
| 152 FSNRTLACFAV | 0.617 | 62 | WB | Large T | A6802 |
| 290 LGMYLEFQYNV | 0.606 | 70 | WB | Large T | A6802 |
| 462 LGVAIDQYMVV | 0.591 | 83 | WB | Large T | A6802 |
| 268 QVSWKLITEYA | 0.576 | 98 | WB | Large T | A6802 |
| 280 ETKCEDVFLLL | 0.573 | 101 | WB | Large T | A6802 |
| 11 ELMDLLGLERA | 0.570 | 105 | WB | Large T | A6802 |
| 234 YSALTRDPYHI | 0.549 | 132 | WB | Large T | A6802 |
| 388 YMAGVAWLHCL | 0.531 | 159 | WB | Large T | A6802 |
| 243 HIIEESIQGGL | 0.507 | 206 | WB | Large T | A6802 |
| 181 SVTFISRHMCA | 0.503 | 216 | WB | Large T | A6802 |
| 407 FDFLHCVVFNV | 0.489 | 251 | WB | Large T | A6802 |
| 374 DLIFGAHGNAV | 0.480 | 277 | WB | Large T | A6802 |
| 542 FVRQIDFRPKI | 0.446 | 400 | WB | Large T | A6802 |
| 212 FCQKLCTFSFL | 0.433 | 460 | WB | Large T | A6802 |
| 461 ELGVAIDQYMV | 0.429 | 484 | WB | Large T | A6802 |
| 388 YMAGVAWLHCL | 0.652 | 42 | SB | Large T | A6901 |
| 461 ELGVAIDQYMV | 0.575 | 99 | WB | Large T | A6901 |
| 374 DLIFGAHGNAV | 0.573 | 102 | WB | Large T | A6901 |
| 8 ESMELMDLLGL | 0.560 | 116 | WB | Large T | A6901 |
| 152 FSNRTLACFAV | 0.541 | 143 | WB | Large T | A6901 |
| 11 ELMDLLGLERA | 0.539 | 145 | WB | Large T | A6901 |
| 576 LLLLLIWFRPV | 0.519 | 182 | WB | Large T | A6901 |
| 404 SVIFDFLHCVV | 0.512 | 196 | WB | Large T | A6901 |
| 360 EMLTERFNHIL | 0.498 | 228 | WB | Large T | A6901 |
| 189 MCAGHNIIFFL | 0.474 | 297 | WB | Large T | A6901 |
| 243 HIIEESIQGGL | 0.472 | 303 | WB | Large T | A6901 |
| 382 NAVLEQYMAGV | 0.470 | 309 | WB | Large T | A6901 |
| 217 CTFSFLICKGV | 0.457 | 355 | WB | Large T | A6901 |
| 269 VSWKLITEYAV | 0.443 | 414 | WB | Large T | A6901 |
| 55 NTLYKKMEQDV | 0.432 | 464 | WB | Large T | A6901 |
| 532 YPVPKTLQARF | 0.646 | 46 | SB | Large T | B0702 |
| 553 YLRKSLQNSEF | 0.492 | 244 | WB | Large T | B0801 |
| 267 KQVSWKLITEY | 0.566 | 109 | WB | Large T | B1501 |
| 538 LQARFVRQIDF | 0.565 | 110 | WB | Large T | B1501 |
| 553 YLRKSLQNSEF | 0.561 | 116 | WB | Large T | B1501 |
| 188 HMCAGHNIIFF | 0.554 | 124 | WB | Large T | B1501 |
| 388 YMAGVAWLHCL | 0.542 | 141 | WB | Large T | B1501 |
| 221 FLICKGVNKEY | 0.541 | 142 | WB | Large T | B1501 |
| 544 RQIDFRPKIYL | 0.521 | 178 | WB | Large T | B1501 |
| 579 LLIWFRPVADF | 0.518 | 183 | WB | Large T | B1501 |
| 519 TQIFPPGLVTM | 0.480 | 276 | WB | Large T | B1501 |
| 232 LLYSALTRDPY | 0.478 | 283 | WB | Large T | B1501 |
| 405 VIFDFLHCVVF | 0.474 | 295 | WB | Large T | B1501 |
| 608 ISMYTFSRMKY | 0.450 | 384 | WB | Large T | B1501 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/ NetMHC/ database. The MHC class 1 molecules for which no binders were found are not listed.

| pos | peptide | logscore | affinity (nM) | Bind Level | Protein Name | Allele |
|---|---|---|---|---|---|---|
| 150 | AVFSNRTLACF | 0.434 | 457 | WB | Large T | B1501 |
| 570 | LQSGMTLLLLL | 0.429 | 483 | WB | Large T | B1501 |
| 668 | HSQELHLCKGF | 0.426 | 495 | WB | Large T | B1501 |
| 86 | TEEWESWWSSF | 0.650 | 44 | SB | Large T | B1801 |
| 460 | FELGVAIDQYM | 0.643 | 47 | SB | Large T | B1801 |
| 318 | HEKHFANAIIF | 0.625 | 57 | WB | Large T | B1801 |
| 18 | LERAAWGNLPL | 0.572 | 102 | WB | Large T | B1801 |
| 79 | SEVPTYGTEEW | 0.556 | 122 | WB | Large T | B1801 |
| 601 | KERLDSEISMY | 0.505 | 210 | WB | Large T | B1801 |
| 664 | SENPHSQELHL | 0.497 | 230 | WB | Large T | B1801 |
| 532 | YPVPKTLQARF | 0.461 | 341 | WB | Large T | B1801 |
| 614 | SRMKYNICMGK | 0.547 | 134 | WB | Large T | B2705 |
| 567 | KRILQSGMTLL | 0.507 | 207 | WB | Large T | B2705 |
| 544 | RQIDFRPKIYL | 0.450 | 382 | WB | Large T | B2705 |
| 548 | FRPKIYLRKSL | 0.450 | 385 | WB | Large T | B2705 |
| 522 | FPPGLVTMNEY | 0.812 | 7 | SB | Large T | B3501 |
| 532 | YPVPKTLQARF | 0.780 | 10 | SB | Large T | B3501 |
| 277 | YAVETKCEDVF | 0.742 | 16 | SB | Large T | B3501 |
| 399 | LPKMDSVIFDF | 0.560 | 116 | WB | Large T | B3501 |
| 41 | HPDKGGDEDKM | 0.545 | 136 | WB | Large T | B3501 |
| 392 | VAWLHCLLPKM | 0.532 | 158 | WB | Large T | B3501 |
| 139 | FPSDLHQFLSQ | 0.494 | 238 | WB | Large T | B3501 |
| 232 | LLYSALTRDPY | 0.453 | 371 | WB | Large T | B3501 |
| 459 | TFELGVAIDQY | 0.442 | 417 | WB | Large T | B3501 |
| 317 | YHEKHFANAII | 0.586 | 88 | WB | Large T | B3901 |
| 388 | YMAGVAWLHCL | 0.549 | 130 | WB | Large T | B3901 |
| 6 | REESMELMDLL | 0.673 | 34 | SB | Large T | B4001 |
| 664 | SENPHSQELHL | 0.668 | 36 | SB | Large T | B4001 |
| 18 | LERAAWGNLPL | 0.630 | 54 | WB | Large T | B4001 |
| 385 | LEQYMAGVAWL | 0.562 | 114 | WB | Large T | B4001 |
| 460 | FELGVAIDQYM | 0.552 | 126 | WB | Large T | B4001 |
| 279 | VETKCEDVFLL | 0.540 | 145 | WB | Large T | B4001 |
| 606 | SEISMYTFSRM | 0.498 | 228 | WB | Large T | B4001 |
| 133 | VEDPKDFPSDL | 0.446 | 399 | WB | Large T | B4001 |
| 166 | KEKAQILYKKL | 0.440 | 428 | WB | Large T | B4001 |
| 47 | DEDKMKRMNTL | 0.434 | 458 | WB | Large T | B4001 |
| 664 | SENPHSQELHL | 0.540 | 144 | WB | Large T | B4002 |
| 6 | REESMELMDLL | 0.511 | 198 | WB | Large T | B4002 |
| 264 | EETKQVSWKLI | 0.502 | 219 | WB | Large T | B4002 |
| 318 | HEKHFANAIIF | 0.459 | 347 | WB | Large T | B4002 |
| 359 | EEMLTERFNHI | 0.445 | 403 | WB | Large T | B4002 |
| 279 | VETKCEDVFLL | 0.432 | 464 | WB | Large T | B4002 |
| 79 | SEVPTYGTEEW | 0.512 | 196 | WB | Large T | B4402 |
| 261 | EEPEETKQVSW | 0.484 | 267 | WB | Large T | B4402 |
| 561 | SEFLLEKRILQ | 0.477 | 287 | WB | Large T | B4403 |
| 664 | SENPHSQELHL | 0.464 | 331 | WB | Large T | B4403 |
| 606 | SEISMYTFSRM | 0.457 | 356 | WB | Large T | B4403 |
| 79 | SEVPTYGTEEW | 0.452 | 375 | WB | Large T | B4403 |
| 261 | EEPEETKQVSW | 0.438 | 438 | WB | Large T | B4403 |
| 359 | EEMLTERFNHI | 0.482 | 271 | WB | Large T | B4501 |
| 115 | EEATADSQHST | 0.450 | 383 | WB | Large T | B4501 |
| 453 | LPMERLTFELG | 0.470 | 309 | WB | Large T | B5101 |
| 532 | YPVPKTLQARF | 0.433 | 463 | WB | Large T | B5101 |
| 522 | FPPGLVTMNEY | 0.689 | 28 | SB | Large T | B5301 |
| 532 | YPVPKTLQARF | 0.645 | 46 | SB | Large T | B5301 |
| 399 | LPKMDSVIFDF | 0.555 | 122 | WB | Large T | B5301 |
| 277 | YAVETKCEDVF | 0.474 | 296 | WB | Large T | B5301 |
| 453 | LPMERLTFELG | 0.580 | 93 | WB | Large T | B5401 |
| 522 | FPPGLVTMNEY | 0.544 | 138 | WB | Large T | B5401 |
| 427 | GPIDSGKTTLA | 0.508 | 204 | WB | Large T | B5401 |

TABLE M-continued

Prediction of BK virus Large T protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 82 | PTYGTEEWESW | 0.576 | 98 | WB | Large T | B5701 |
| 90 | ESWWSSFNEKW | 0.678 | 32 | SB | Large T | B5801 |
| 66 | KVAHQPDFGTW | 0.658 | 40 | SB | Large T | B5801 |
| 572 | SGMTLLLLLIW | 0.539 | 146 | WB | Large T | B5801 |
| 413 | VVFNVPKRRYW | 0.527 | 167 | WB | Large T | B5801 |
| 277 | YAVETKCEDVF | 0.495 | 235 | WB | Large T | B5801 |
| 608 | ISMYTFSRMKY | 0.487 | 258 | WB | Large T | B5801 |
| 82 | PTYGTEEWESW | 0.458 | 353 | WB | Large T | B5801 |

SEQ ID NOS.: 55454-58054

Preferred BK virus fragments of agnoprotein capable of interacting with one or more MHC class 1 molecules are listed in Table N.

TABLE N

Prediction of BK virus Agnoprotein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| | | 8-mers | | | | |
| 36 | FIFILELL | 0.641 | 48 | SB | Agno | A0201 |
| 59 | STTALPAV | 0.453 | 373 | WB | Agno | A0201 |
| 36 | FIFILELL | 0.785 | 10 | SB | Agno | A0202 |
| 12 | QLSRQASV | 0.702 | 25 | SB | Agno | A0202 |
| 12 | QLSRQASV | 0.712 | 22 | SB | Agno | A0203 |
| 59 | STTALPAV | 0.537 | 149 | WB | Agno | A0203 |
| 36 | FIFILELL | 0.524 | 171 | WB | Agno | A0203 |
| 32 | AQRIFIFI | 0.503 | 216 | WB | Agno | A0203 |
| 6 | NLVVLRQL | 0.431 | 473 | WB | Agno | A0203 |
| 12 | QLSRQASV | 0.508 | 206 | WB | Agno | A0204 |
| 59 | STTALPAV | 0.489 | 252 | WB | Agno | A0204 |
| 32 | AQRIFIFI | 0.646 | 46 | SB | Agno | A0206 |
| 36 | FIFILELL | 0.585 | 89 | WB | Agno | A0206 |
| 59 | STTALPAV | 0.582 | 92 | WB | Agno | A0206 |
| 12 | QLSRQASV | 0.479 | 281 | WB | Agno | A0206 |
| 38 | FILELLLE | 0.474 | 297 | WB | Agno | A0206 |
| 12 | QLSRQASV | 0.883 | 3 | SB | Agno | A0211 |
| 36 | FIFILELL | 0.782 | 10 | SB | Agno | A0211 |
| 59 | STTALPAV | 0.695 | 27 | SB | Agno | A0211 |
| 6 | NLVVLRQL | 0.688 | 29 | SB | Agno | A0211 |
| 12 | QLSRQASV | 0.825 | 6 | SB | Agno | A0212 |
| 36 | FIFILELL | 0.705 | 24 | SB | Agno | A0212 |
| 59 | STTALPAV | 0.504 | 214 | WB | Agno | A0212 |
| 46 | FCRGEDSV | 0.502 | 219 | WB | Agno | A0212 |
| 12 | QLSRQASV | 0.877 | 3 | SB | Agno | A0216 |
| 36 | FIFILELL | 0.643 | 47 | SB | Agno | A0216 |
| 6 | NLVVLRQL | 0.580 | 93 | WB | Agno | A0216 |
| 59 | STTALPAV | 0.474 | 294 | WB | Agno | A0216 |
| 1 | FCEPKNLV | 0.427 | 494 | WB | Agno | A0216 |
| 12 | QLSRQASV | 0.746 | 15 | SB | Agno | A0219 |
| 59 | STTALPAV | 0.455 | 364 | WB | Agno | A0219 |
| 23 | KTWTGTKK | 0.662 | 38 | SB | Agno | A0301 |
| 60 | TTALPAVK | 0.568 | 107 | WB | Agno | A0301 |
| 8 | VVLRQLSR | 0.444 | 408 | WB | Agno | A0301 |
| 13 | LSRQASVK | 0.436 | 444 | WB | Agno | A0301 |
| 60 | TTALPAVK | 0.785 | 10 | SB | Agno | A1101 |
| 23 | KTWTGTKK | 0.637 | 50 | WB | Agno | A1101 |
| 8 | VVLRQLSR | 0.554 | 124 | WB | Agno | A1101 |
| 16 | QASVKVGK | 0.458 | 351 | WB | Agno | A1101 |
| 35 | IFIFILEL | 0.573 | 101 | WB | Agno | A2301 |
| 31 | RAQRIFIF | 0.514 | 191 | WB | Agno | A2301 |
| 37 | IFILELLL | 0.454 | 367 | WB | Agno | A2301 |
| 37 | IFILELLL | 0.536 | 150 | WB | Agno | A2402 |
| 35 | IFIFILEL | 0.478 | 284 | WB | Agno | A2402 |
| 31 | RAQRIFIF | 0.431 | 472 | WB | Agno | A2402 |
| 31 | RAQRIFIF | 0.449 | 386 | WB | Agno | A2403 |
| 13 | LSRQASVK | 0.690 | 28 | SB | Agno | A3001 |
| 23 | KTWTGTKK | 0.659 | 40 | SB | Agno | A3001 |
| 27 | GTKKRAQR | 0.803 | 8 | SB | Agno | A3101 |
| 23 | KTWTGTKK | 0.648 | 45 | SB | Agno | A3101 |
| 8 | VVLRQLSR | 0.587 | 87 | WB | Agno | A3101 |
| 41 | ELLLEFCR | 0.701 | 25 | SB | Agno | A3301 |
| 27 | GTKKRAQR | 0.564 | 111 | WB | Agno | A3301 |
| 8 | VVLRQLSR | 0.466 | 323 | WB | Agno | A3301 |
| 60 | TTALPAVK | 0.774 | 11 | SB | Agno | A6801 |
| 41 | ELLLEFCR | 0.627 | 56 | WB | Agno | A6801 |
| 27 | GTKKRAQR | 0.537 | 150 | WB | Agno | A6801 |
| 16 | QASVKVGK | 0.459 | 349 | WB | Agno | A6801 |
| 51 | DSVDGKNK | 0.431 | 473 | WB | Agno | A6801 |
| 59 | STTALPAV | 0.655 | 42 | SB | Agno | A6802 |
| 33 | QRIFIFIL | 0.552 | 127 | WB | Agno | A6802 |
| 36 | FIFILELL | 0.512 | 195 | WB | Agno | A6802 |

TABLE N-continued

Prediction of BK virus Agnoprotein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 59 | STTALPAV | 0.674 | 34 | SB | Agno | A6901 |
| 36 | FIFILELL | 0.441 | 424 | WB | Agno | A6901 |
| 63 | LPAVKDSV | 0.582 | 91 | WB | Agno | B0702 |
| 3 | EPKNLVVL | 0.427 | 490 | WB | Agno | B0702 |
| 33 | QRIFIFIL | 0.431 | 472 | WB | Agno | B2705 |
| 3 | EPKNLVVL | 0.518 | 184 | WB | Agno | B3501 |
| 63 | LPAVKDSV | 0.585 | 88 | WB | Agno | B5101 |
| 3 | EPKNLVVL | 0.456 | 358 | WB | Agno | B5301 |
| 63 | LPAVKDSV | 0.745 | 15 | SB | Agno | B5401 |
| 31 | RAQRIFIF | 0.503 | 215 | WB | Agno | B5801 |

9-mers

| pos | peptide | logscore | affinity (nM) | Bind Level | Protein Name | Allele |
|---|---|---|---|---|---|---|
| 34 | RIFIFILEL | 0.674 | 34 | SB | Agno | A0201 |
| 36 | FIFILELLL | 0.613 | 66 | WB | Agno | A0201 |
| 11 | RQLSRQASV | 0.561 | 115 | WB | Agno | A0201 |
| 62 | ALPAVKDSV | 0.503 | 215 | WB | Agno | A0201 |
| 38 | FILELLLEF | 0.448 | 392 | WB | Agno | A0201 |
| 36 | FIFILELLL | 0.698 | 26 | SB | Agno | A0202 |
| 62 | ALPAVKDSV | 0.609 | 68 | WB | Agno | A0202 |
| 34 | RIFIFILEL | 0.540 | 144 | WB | Agno | A0202 |
| 11 | RQLSRQASV | 0.688 | 29 | SB | Agno | A0203 |
| 62 | ALPAVKDSV | 0.667 | 36 | SB | Agno | A0203 |
| 9 | VLRQLSRQA | 0.455 | 362 | WB | Agno | A0203 |
| 34 | RIFIFILEL | 0.439 | 433 | WB | Agno | A0203 |
| 62 | ALPAVKDSV | 0.515 | 190 | WB | Agno | A0204 |
| 11 | RQLSRQASV | 0.855 | 4 | SB | Agno | A0206 |
| 38 | FILELLLEF | 0.731 | 18 | SB | Agno | A0206 |
| 62 | ALPAVKDSV | 0.588 | 86 | WB | Agno | A0206 |
| 32 | AQRIFIFIL | 0.561 | 116 | WB | Agno | A0206 |
| 58 | KSTTALPAV | 0.559 | 118 | WB | Agno | A0206 |
| 34 | RIFIFILEL | 0.506 | 208 | WB | Agno | A0206 |
| 31 | RAQRIFIFI | 0.487 | 256 | WB | Agno | A0206 |
| 36 | FIFILELLL | 0.455 | 365 | WB | Agno | A0206 |
| 62 | ALPAVKDSV | 0.927 | 2 | SB | Agno | A0211 |
| 34 | RIFIFILEL | 0.836 | 5 | SB | Agno | A0211 |
| 36 | FIFILELLL | 0.796 | 9 | SB | Agno | A0211 |
| 38 | FILELLLEF | 0.621 | 60 | WB | Agno | A0211 |
| 9 | VLRQLSRQA | 0.546 | 135 | WB | Agno | A0211 |
| 11 | RQLSRQASV | 0.445 | 405 | WB | Agno | A0211 |
| 62 | ALPAVKDSV | 0.904 | 2 | SB | Agno | A0212 |
| 36 | FIFILELLL | 0.746 | 15 | SB | Agno | A0212 |
| 34 | RIFIFILEL | 0.679 | 32 | SB | Agno | A0212 |
| 38 | FILELLLEF | 0.614 | 65 | WB | Agno | A0212 |
| 11 | RQLSRQASV | 0.545 | 138 | WB | Agno | A0212 |
| 1 | FCEPKNLVV | 0.473 | 300 | WB | Agno | A0212 |
| 42 | LLLEFCRGE | 0.465 | 327 | WB | Agno | A0212 |
| 9 | VLRQLSRQA | 0.442 | 416 | WB | Agno | A0212 |
| 62 | ALPAVKDSV | 0.922 | 2 | SB | Agno | A0216 |
| 34 | RIFIFILEL | 0.732 | 18 | SB | Agno | A0216 |
| 36 | FIFILELLL | 0.654 | 42 | SB | Agno | A0216 |
| 11 | RQLSRQASV | 0.490 | 247 | WB | Agno | A0216 |
| 62 | ALPAVKDSV | 0.778 | 11 | SB | Agno | A0219 |
| 12 | QLSRQASVK | 0.643 | 47 | SB | Agno | A0301 |
| 15 | RQASVKVGK | 0.538 | 148 | WB | Agno | A0301 |
| 59 | STTALPAVK | 0.461 | 341 | WB | Agno | A0301 |
| 59 | STTALPAVK | 0.825 | 6 | SB | Agno | A1101 |
| 15 | RQASVKVGK | 0.624 | 58 | WB | Agno | A1101 |
| 7 | LVVLRQLSR | 0.460 | 345 | WB | Agno | A1101 |
| 35 | IFIFILELL | 0.514 | 192 | WB | Agno | A2301 |
| 38 | FILELLLEF | 0.473 | 300 | WB | Agno | A2301 |
| 35 | IFIFILELL | 0.610 | 67 | WB | Agno | A2402 |
| 38 | FILELLLEF | 0.532 | 157 | WB | Agno | A2403 |
| 38 | FILELLLEF | 0.598 | 77 | WB | Agno | A2602 |
| 38 | FILELLLEF | 0.463 | 334 | WB | Agno | A2902 |
| 21 | VGKTWTGTK | 0.528 | 165 | WB | Agno | A3001 |
| 59 | STTALPAVK | 0.477 | 285 | WB | Agno | A3001 |
| 29 | KKRAQRIFI | 0.452 | 377 | WB | Agno | A3001 |
| 23 | KTWTGTKKR | 0.727 | 19 | SB | Agno | A3101 |
| 15 | RQASVKVGK | 0.617 | 62 | WB | Agno | A3101 |
| 26 | TGTKKRAQR | 0.524 | 172 | WB | Agno | A3101 |
| 7 | LVVLRQLSR | 0.506 | 210 | WB | Agno | A3101 |
| 59 | STTALPAVK | 0.486 | 260 | WB | Agno | A3101 |
| 7 | LVVLRQLSR | 0.666 | 37 | SB | Agno | A3301 |
| 3 | EPKNLVVLR | 0.510 | 201 | WB | Agno | A3301 |
| 59 | STTALPAVK | 0.728 | 19 | SB | Agno | A6801 |
| 3 | EPKNLVVLR | 0.667 | 36 | SB | Agno | A6801 |
| 7 | LVVLRQLSR | 0.664 | 37 | SB | Agno | A6801 |
| 31 | RAQRIFIFI | 0.609 | 68 | WB | Agno | A6802 |
| 38 | FILELLLEF | 0.453 | 371 | WB | Agno | B1801 |
| 15 | RQASVKVGK | 0.566 | 109 | WB | Agno | B2705 |
| 30 | KRAQRIFIF | 0.523 | 174 | WB | Agno | B2705 |
| 11 | RQLSRQASV | 0.449 | 390 | WB | Agno | B2705 |
| 38 | FILELLLEF | 0.505 | 211 | WB | Agno | B3501 |
| 2 | CEPKNLVVL | 0.521 | 179 | WB | Agno | B4001 |
| 17 | ASVKVGKTW | 0.443 | 414 | WB | Agno | B5701 |
| 17 | ASVKVGKTW | 0.572 | 103 | WB | Agno | B5801 |

10-mers

| pos | peptide | logscore | affinity (nM) | Bind Level | Protein Name | Allele |
|---|---|---|---|---|---|---|
| 34 | RIFIFILELL | 0.605 | 71 | WB | Agno | A0201 |
| 38 | FILELLLEFC | 0.449 | 388 | WB | Agno | A0201 |
| 34 | RIFIFILELL | 0.719 | 20 | SB | Agno | A0202 |
| 38 | FILELLLEFC | 0.622 | 59 | WB | Agno | A0202 |
| 12 | QLSRQASVKV | 0.449 | 386 | WB | Agno | A0202 |
| 12 | QLSRQASVKV | 0.588 | 86 | WB | Agno | A0203 |
| 34 | RIFIFILELL | 0.456 | 359 | WB | Agno | A0203 |
| 12 | QLSRQASVKV | 0.503 | 215 | WB | Agno | A0204 |
| 38 | FILELLLEFC | 0.656 | 41 | SB | Agno | A0206 |
| 34 | RIFIFILELL | 0.549 | 131 | WB | Agno | A0206 |
| 61 | TALPAVKDSV | 0.450 | 382 | WB | Agno | A0206 |
| 12 | QLSRQASVKV | 0.859 | 4 | SB | Agno | A0211 |

TABLE N-continued

Prediction of BK virus Agnoprotein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| pos | peptide | logscore | affinity (nM) | Bind Level | Protein Name | Allele |
|---|---|---|---|---|---|---|
| 34 | RIFIFILELL | 0.772 | 11 | SB | Agno | A0211 |
| 38 | FILELLLEFC | 0.626 | 57 | WB | Agno | A0211 |
| 61 | TALPAVKDSV | 0.569 | 106 | WB | Agno | A0211 |
| 12 | QLSRQASVKV | 0.754 | 14 | SB | Agno | A0212 |
| 38 | FILELLLEFC | 0.627 | 56 | WB | Agno | A0212 |
| 34 | RIFIFILELL | 0.497 | 231 | WB | Agno | A0212 |
| 61 | TALPAVKDSV | 0.433 | 461 | WB | Agno | A0212 |
| 12 | QLSRQASVKV | 0.843 | 5 | SB | Agno | A0216 |
| 34 | RIFIFILELL | 0.581 | 92 | WB | Agno | A0216 |
| 61 | TALPAVKDSV | 0.550 | 130 | WB | Agno | A0216 |
| 12 | QLSRQASVKV | 0.632 | 53 | WB | Agno | A0219 |
| 61 | TALPAVKDSV | 0.549 | 131 | WB | Agno | A0219 |
| 11 | RQLSRQASVK | 0.636 | 51 | WB | Agno | A0301 |
| 58 | KSTTALPAVK | 0.532 | 158 | WB | Agno | A0301 |
| 20 | KVGKTWTGTK | 0.496 | 234 | WB | Agno | A0301 |
| 62 | ALPAVKDSVK | 0.452 | 375 | WB | Agno | A0301 |
| 58 | KSTTALPAVK | 0.688 | 29 | SB | Agno | A1101 |
| 20 | KVGKTWTGTK | 0.671 | 35 | SB | Agno | A1101 |
| 11 | RQLSRQASVK | 0.620 | 60 | WB | Agno | A1101 |
| 62 | ALPAVKDSVK | 0.445 | 404 | WB | Agno | A1101 |
| 37 | IFILELLLEF | 0.695 | 27 | SB | Agno | A2301 |
| 35 | IFIFILELLL | 0.487 | 256 | WB | Agno | A2301 |
| 37 | IFILELLLEF | 0.663 | 38 | SB | Agno | A2402 |
| 35 | IFIFILELLL | 0.622 | 59 | WB | Agno | A2402 |
| 37 | IFILELLLEF | 0.663 | 38 | SB | Agno | A2403 |
| 37 | IFILELLLEF | 0.470 | 309 | WB | Agno | A2902 |
| 20 | KVGKTWTGTK | 0.787 | 10 | SB | Agno | A3001 |
| 58 | KSTTALPAVK | 0.557 | 120 | WB | Agno | A3001 |
| 11 | RQLSRQASVK | 0.509 | 202 | WB | Agno | A3001 |
| 6 | NLVVLRQLSR | 0.567 | 108 | WB | Agno | A3101 |
| 39 | ILELLLEFCR | 0.521 | 177 | WB | Agno | A3101 |
| 25 | WTGTKKRAQR | 0.504 | 214 | WB | Agno | A3101 |
| 39 | ILELLLEFCR | 0.523 | 173 | WB | Agno | A3301 |
| 6 | NLVVLRQLSR | 0.485 | 262 | WB | Agno | A3301 |
| 6 | NLVVLRQLSR | 0.604 | 72 | WB | Agno | A6801 |
| 39 | ILELLLEFCR | 0.479 | 279 | WB | Agno | A6801 |
| 25 | WTGTKKRAQR | 0.465 | 326 | WB | Agno | A6801 |
| 33 | QRIFIFILEL | 0.528 | 164 | WB | Agno | A6802 |
| 61 | TALPAVKDSV | 0.473 | 301 | WB | Agno | A6802 |
| 34 | RIFIFILELL | 0.467 | 321 | WB | Agno | A6802 |
| 61 | TALPAVKDSV | 0.448 | 394 | WB | Agno | A6901 |
| 11 | RQLSRQASVK | 0.534 | 154 | WB | Agno | B2705 |
| 14 | SRQASVKVGK | 0.516 | 188 | WB | Agno | B2705 |
| 33 | QRIFIFILEL | 0.469 | 312 | WB | Agno | B2705 |
| 16 | QASVKVGKTW | 0.632

TABLE O

Predicted MHC class 2 BK virus peptide sequences. Prediction of 13-, 14-, 15-,16-mers from all 6 reading frames of the genome (access no #V01108) obtained using the program displayed in FIG. 2.

BK virus, reading frame 1

13 mers:

FCKNCKRIGISPN; CKNCKRIGISPNS; KNCKRIGISPNSF;
NCKRIGISPNSFA; CKRIGISPNSFAR; KRIGISPNSFARP;
RIGISPNSFARPQ; IGISPNSFARPQK; GISPNSFARPQKK;
ISPNSFARPQKKP; SPNSFARPQKKPP; PNSFARPQKKPPH;
NSFARPQKKPPHP; SFARPQKKPPHPY; FARPQKKPPHPYY;
ARPQKKPPHPYYL; RPQKKPPHPYYLR; PQKKPPHPYYLRE;
QKKPPHPYYLRER; KKPPHPYYLRERV; KPPHPYYLRERVE;
PPHPYYLRERVEA; PHPYYLRERVEAE; HPYYLRERVEAEA;
PYYLRERVEAEAA; YYLRERVEAEAAS; YLRERVEAEAASA;
LRERVEAEAASAS; RERVEAEAASASY; ERVEAEAASASYI;
RVEAEAASASYIL; KKRPQGGAAYPWN; KRPQGGAAYPWNA;
RPQGGAAYPWNAA; PQGGAAYPWNAAK; QGGAAYPWNAAKP;
PQEGKCMTHRGMQ; QEGKCMTHRGMQP; EGKCMTHRGMQPN;
GKCMTHRGMQPNH; KCMTHRGMQPNHD; CMTHRGMQPNHDL;
MTHRGMQPNHDLR; THRGMQPNHDLRK; HRGMQPNHDLRKE;
RGMQPNHDLRKES; GMQPNHDLRKESA; LTGRSCLPMECSQ;
TGRSCLPMECSQT; GRSCLPMECSQTM; RSCLPMECSQTMT;
SCLPMECSQTMTS; CLPMECSQTMTSG; LPMECSQTMTSGR;
PMECSQTMTSGRK; MECSQTMTSGRKV; ECSQTMTSGRKVH;
CSQTMTSGRKVHD; SQTMTSGRKVHDR; QTMTSGRKVHDRH;
TMTSGRKVHDRHV; MTSGRKVHDRHVL; TSGRKVHDRHVLR;
SGRKVHDRHVLRA; ESWPCPQLNWTKA; SWPCPQLNWTKAM;
WPCPQLNWTKAMV; PCPQLNWTKAMVL; CPQLNWTKAMVLR;
PQLNWTKAMVLRQ; QLNWTKAMVLRQL; LNWTKAMVLRQLS;
NWTKAMVLRQLSR; WTKAMVLRQLSRQ; TKAMVLRQLSRQA;
KAMVLRQLSRQAS; AMVLRQLSRQASV; MVLRQLSRQASVK;
VLRQLSRQASVKV; LRQLSRQASVKVG; RQLSRQASVKVGK;
QLSRQASVKVGKT; LSRQASVKVGKTW; SRQASVKVGKTWT;
RQASVKVGKTWTG; QASVKVGKTWTGT; ASVKVGKTWTGTK;
SVKVGKTWTGTKK; VKVGKTWTGTKKR; KVGKTWTGTKKRA;
VGKTWTGTKKRAQ; GKTWTGTKKRAQR; KTWTGTKKRAQRI;
TWTGTKKRAQRIF; WTGTKKRAQRIFI; TGTKKRAQRIFIF;
GTKKRAQRIFIFI; TKKRAQRIFIFIL; KKRAQRIFIFILE;
KRAQRIFIFILEL; RAQRIFIFILELL; AQRIFIFILELLL;
QRIFIFILELLLE; RIFIFILELLLEF; IFIFILELLLEFC;
FIFILELLLEFCR; IFILELLLEFCRG; FILELLLEFCRGE;
ILELLLEFCRGED; LELLLEFCRGEDS; ELLLEFCRGEDSV;
LLLEFCRGEDSVD; LLEFCRGEDSVDG; LEFCRGEDSVDGK;
EFCRGEDSVDGKN; FCRGEDSVDGKNK; CRGEDSVDGKNKS;
RGEDSVDGKNKST; GEDSVDGKNKSTT; EDSVDGKNKSTTA;
DSVDGKNKSTTAL; SVDGKNKSTTALP; VDGKNKSTTALPA;
DGKNKSTTALPAV; GKNKSTTALPAVK; KNKSTTALPAVKD;
NKSTTALPAVKDS; KSTTALPAVKDSV; STTALPAVKDSVK;
TTALPAVKDSVKD; TALPAVKDSVKDS; VSNPFFFVFPGSW;
SNPFFFVFPGSWV; NPFFFVFPGSWVL; PFFFVFPGSWVLL;
LPVYLRLLLPQDF; PVYLRLLLPQDFQ; VYLRLLLPQDFQW;
YLRLLLPQDFQWL; LRLLLPQDFQWLK; RLLLPQDFQWLKL;
LLLPQDFQWLKLL; LLPQDFQWLKLLL; LPQDFQWLKLLLG;
PQDFQWLKLLLGR; QDFQWLKLLLGRL; DFQWLKLLLGRLL;
FQWLKLLLGRLLL; QWLKLLLGRLLLL; LLVLLGLLLGLLL;
GISSLMIGITKFP; ISSLMIGITKFPL; ASISNQAWLWNCL;
SISNQAWLWNCLT; ISNQAWLWNCLTQ; SNQAWLWNCLTQM;
NQAWLWNCLTQMS; QAWLWNCLTQMST; AWLWNCLTQMSTM;
WLWNCLTQMSTMI; LWNCLTQMSTMIF; WNCLTQMSTMIFC;
NCLTQMSTMIFCF; CLTQMSTMIFCFL; LTQMSTMIFCFLV;
ILLLIIFNTLILG; LLLIIFNTLILGI; LLIIFNTLILGIG;
LIIFNTLILGIGV; IIFNTLILGIGVL; IFNTLILGIGVLL;
FNTLILGIGVLLC; NTLILGIGVLLCL; TLILGIGVLLCLL;
LILGIGVLLCLLL; ILGIGVLLCLLLF; LGIGVLLCLLLFP;
GIGVLLCLLLFPR; IGVLLCLLLFPRL; GVLLCLLLFPRLC;
VLLCLLLFPRLCG; LLCLLLFPRLCGM; LCLLLFPRLCGML;
CLLLFPRLCGMLL; LLLFPRLCGMLLG; LLFPRLCGMLLGM;
LFPRLCGMLLGMI; FPRLCGMLLGMIY; PRLCGMLLGMIYL;
RLCGMLLGMIYLL; PHRNCREEQKDFL; HRNCREEQKDFLE;
RNCREEQKDFLET; NCREEQKDFLETP; CREEQKDFLETPW;
REEQKDFLETPWL; EEQKDFLETPWLD; EQKDFLETPWLDF;
QKDFLETPWLDFW; KDFLETPWLDFWR; DFLETPWLDFWRK;
FLETPWLDFWRKL; LETPWLDFWRKLP; ETPWLDFWRKLPG;
TPWLDFWRKLPGQ; PWLDFWRKLPGQL; TFIIIFNNIILIF;
FIIIFNNIILIFP; IIIFNNIILIFPL; IIFNNIILIFPLL;

IFNNIILIFPLLG; FNNIILIFPLLGP; NNIILIFPLLGPQ;
NIILIFPLLGPQW; IILIFPLLGPQWL; ILIFPLLGPQWLD;
LIFPLLGPQWLDK; LKGKVPVYILAIL; KGKVPVYILAILI;
GKVPVYILAILIV; KKLLPQEVLIKEL; KLLPQEVLIKELL;
LLPQEVLIKELLL; LPQEVLIKELLLN; PQEVLIKELLLNG;
QEVLIKELLLNGC; EVLIKELLLNGCC; VLIKELLLNGCCL;
LIKELLLNGCCLY; IKELLLNGCCLYF; HLLLKHMKMAPTK;
LLLKHMKMAPTKR; LLKHMKMAPTKRK; LKHMKMAPTKRKG;
KHMKMAPTKRKGE; HMKMAPTKRKGEC; MKMAPTKRKGECP;
KMAPTKRKGECPG; MAPTKRKGECPGA; APTKRKGECPGAA;
PTKRKGECPGAAP; TKRKGECPGAAPK; KRKGECPGAAPKK;
RKGECPGAAPKKP; KGECPGAAPKKPK; GECPGAAPKKPKE;
ECPGAAPKKPKEP; CPGAAPKKPKEPV; PGAAPKKPKEPVQ;
GAAPKKPKEPVQV; AAPKKPKEPVQVP; APKKPKEPVQVPK;
PKKPKEPVQVPKL; KKPKEPVQVPKLL; KPKEPVQVPKLLI;
PKEPVQVPKLLIK; KEPVQVPKLLIKG; EPVQVPKLLIKGG;
PVQVPKLLIKGGV; VQVPKLLIKGGVE; QVPKLLIKGGVEV;
VPKLLIKGGVEVL; PKLLIKGGVEVLE; KLLIKGGVEVLEV;
LLIKGGVEVLEVK; LIKGGVEVLEVKT; IKGGVEVLEVKTG;
KGGVEVLEVKTGV; GGVEVLEVKTGVD; GVEVLEVKTGVDA;
VEVLEVKTGVDAI; EVLEVKTGVDAIT; VLEVKTGVDAITE;
LEVKTGVDAITEV; EVKTGVDAITEVE; VKTGVDAITEVEC;
KTGVDAITEVECF; TGVDAITEVECFL; GVDAITEVECFLN;
VDAITEVECFLNP; DAITEVECFLNPE; AITEVECFLNPEM;
ITEVECFLNPEMG; TEVECFLNPEMGD; EVECFLNPEMGDP;
VECFLNPEMGDPD; ECFLNPEMGDPDE; CFLNPEMGDPDEN;
FLNPEMGDPDENL; LNPEMGDPDENLR; NPEMGDPDENLRG;
PEMGDPDENLRGF; EMGDPDENLRGFS; MGDPDENLRGFSL;
GDPDENLRGFSLK; DPDENLRGFSLKL; PDENLRGFSLKLS;
DENLRGFSLKLSA; ENLRGFSLKLSAE; NLRGFSLKLSAEN;
LRGFSLKLSAEND; RGFSLKLSAENDF; GFSLKLSAENDFS;
FSLKLSAENDFSS; SLKLSAENDFSSD; LKLSAENDFSSDS;
KLSAENDFSSDSP; LSAENDFSSDSPE; SAENDFSSDSPER;
AENDFSSDSPERK; ENDFSSDSPERKM; NDFSSDSPERKML;
DFSSDSPERKMLP; FSSDSPERKMLPC; SSDSPERKMLPCY;
SDSPERKMLPCYS; DSPERKMLPCYST; SPERKMLPCYSTA;
PERKMLPCYSTAR; ERKMLPCYSTARI; RKMLPCYSTARIP;
KMLPCYSTARIPL; MLPCYSTARIPLP; LPCYSTARIPLPN;
PCYSTARIPLPNL; CYSTARIPLPNLN; YSTARIPLPNLNE;
STARIPLPNLNED; TARIPLPNLNEDL; ARIPLPNLNEDLT;
RIPLPNLNEDLTC; IPLPNLNEDLTCG; PLPNLNEDLTCGN;
LPNLNEDLTCGNL; PNLNEDLTCGNLL; NLNEDLTCGNLLM;
LNEDLTCGNLLMW; NEDLTCGNLLMWE; EDLTCGNLLMWEA;
DLTCGNLLMWEAV; LTCGNLLMWEAVT; TCGNLLMWEAVTV;
CGNLLMWEAVTVQ; GNLLMWEAVTVQT; NLLMWEAVTVQTE;
LLMWEAVTVQTEV; LMWEAVTVQTEVI; MWEAVTVQTEVIG;
WEAVTVQTEVIGI; EAVTVQTEVIGIT; AVTVQTEVIGITS;
VTVQTEVIGITSM; TVQTEVIGITSML; VQTEVIGITSMLN;
QTEVIGITSMLNL; TEVIGITSMLNLH; EVIGITSMLNLHA;
VIGITSMLNLHAG; IGITSMLNLHAGS; GITSMLNLHAGSQ;
ITSMLNLHAGSQK; TSMLNLHAGSQKV; SMLNLHAGSQKVH;
MLNLHAGSQKVHE; LNLHAGSQKVHEH; NLHAGSQKVHEHG;
LHAGSQKVHEHGG; HAGSQKVHEHGGG; AGSQKVHEHGGGK;
GSQKVHEHGGGKP; SQKVHEHGGGKPI; QKVHEHGGGKPIQ;
KVHEHGGGKPIQG; VHEHGGGKPIQGS; HEHGGGKPIQGSN;
EHGGGKPIQGSNF; HGGGKPIQGSNFH; GGGKPIQGSNFHF;
GGKPIQGSNFHFF; GKPIQGSNFHFFA; KPIQGSNFHFFAV;
PIQGSNFHFFAVG; IQGSNFHFFAVGG; QGSNFHFFAVGGE;
GSNFHFFAVGGEP; SNFHFFAVGGEPL; NFHFFAVGGEPLE;
FHFFAVGGEPLEM; HFFAVGGEPLEMQ; FFAVGGEPLEMQG;
FAVGGEPLEMQGV; AVGGEPLEMQGVL; VGGEPLEMQGVLM;
GGEPLEMQGVLMN; GEPLEMQGVLMNY; EPLEMQGVLMNYR;
PLEMQGVLMNYRS; LEMQGVLMNYRSK; EMQGVLMNYRSKY;
MQGVLMNYRSKYP; QGVLMNYRSKYPD; GVLMNYRSKYPDG;
VLMNYRSKYPDGT; LMNYRSKYPDGTI; MNYRSKYPDGTIT;
NYRSKYPDGTITP; YRSKYPDGTITPK; RSKYPDGTITPKN;
SKYPDGTITPKNP; KYPDGTITPKNPT; YPDGTITPKNPTA;
PDGTITPKNPTAQ; DGTITPKNPTAQS; GTITPKNPTAQSQ;
TITPKNPTAQSQV; ITPKNPTAQSQVM; TPKNPTAQSQVMN;
PKNPTAQSQVMNT; KNPTAQSQVMNTD; NPTAQSQVMNTDH;
PTAQSQVMNTDHK; TAQSQVMNTDHKA; AQSQVMNTDHKAY;
QSQVMNTDHKAYL; SQVMNTDHKAYLD; QVMNTDHKAYLDK;
VMNTDHKAYLDKN; MNTDHKAYLDKNN; NTDHKAYLDKNNA;
TDHKAYLDKNNAY; DHKAYLDKNNAYP; HKAYLDKNNAYPV;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

KAYLDKNNAYPVE; AYLDKNNAYPVEC; YLDKNNAYPVECW;
LDKNNAYPVECWV; DKNNAYPVECWVP; KNNAYPVECWVPD;
NNAYPVECWVPDP; NAYPVECWVPDPS; AYPVECWVPDPSR;
YPVECWVPDPSRN; PVECWVPDPSRNE; VECWVPDPSRNEN;
ECWVPDPSRNENA; CWVPDPSRNENAR; WVPDPSRNENARY;
VPDPSRNENARYF; PDPSRNENARYFG; DPSRNENARYFGT;
PSRNENARYFGTF; SRNENARYFGTFT; RNENARYFGTFTG;
NENARYFGTFTGG; ENARYFGTFTGGE; NARYFGTFTGGEN;
ARYFGTFTGGENV; RYFGTFTGGENVP; YFGTFTGGENVPP;
FGTFTGGENVPPV; GTFTGGENVPPVL; TFTGGENVPPVLH;
FTGGENVPPVLHV; TGGENVPPVLHVT; GGENVPPVLHVTN;
GENVPPVLHVTNT; ENVPPVLHVTNTA; NVPPVLHVTNTAT;
VPPVLHVTNTATT; PPVLHVTNTATTV; PVLHVTNTATTVL;
VLHVTNTATTVLL; LHVTNTATTVLLD; HVTNTATTVLLDE;
VTNTATTVLLDEQ; TNTATTVLLDEQG; NTATTVLLDEQGV;
TATTVLLDEQGVG; ATTVLLDEQGVGP; TTVLLDEQGVGPL;
TVLLDEQGVGPLC; VLLDEQGVGPLCK; LLDEQGVGPLCKA;
LDEQGVGPLCKAD; DEQGVGPLCKADS; EQGVGPLCKADSL;
QGVGPLCKADSLY; GVGPLCKADSLYV; VGPLCKADSLYVS;
GPLCKADSLYVSA; PLCKADSLYVSAA; LCKADSLYVSAAD;
CKADSLYVSAADI; KADSLYVSAADIC; ADSLYVSAADICG;
DSLYVSAADICGL; SLYVSAADICGLF; LYVSAADICGLFT;
YVSAADICGLFTN; VSAADICGLFTNS; SAADICGLFTNSS;
AADICGLFTNSSG; ADICGLFTNSSGT; DICGLFTNSSGTQ;
ICGLFTNSSGTQQ; CGLFTNSSGTQQW; GLFTNSSGTQQWR;
LFTNSSGTQQWRG; FTNSSGTQQWRGL; TNSSGTQQWRGLA;
NSSGTQQWRGLAR; SSGTQQWRGLARY; SGTQQWRGLARYF;
GTQQWRGLARYFK; TQQWRGLARYFKI; QQWRGLARYFKIR;
QWRGLARYFKIRL; WRGLARYFKIRLR; RGLARYFKIRLRK;
GLARYFKIRLRKR; LARYFKIRLRKRS; ARYFKIRLRKRSV;
RYFKIRLRKRSVK; YFKIRLRKRSVKN; FKIRLRKRSVKNP;
KIRLRKRSVKNPY; IRLRKRSVKNPYP; RLRKRSVKNPYPI;
LRKRSVKNPYPIS; RKRSVKNPYPISF; KRSVKNPYPISFL;
RSVKNPYPISFLL; SVKNPYPISFLLS; VKNPYPISFLLSD;
KNPYPISFLLSDL; NPYPISFLLSDLI; PYPISFLLSDLIN;
YPISFLLSDLINR; PISFLLSDLINRR; ISFLLSDLINRRT;
SFLLSDLINRRTQ; FLLSDLINRRTQR; LLSDLINRRTQRV;
LSDLINRRTQRVD; SDLINRRTQRVDG; DLINRRTQRVDGQ;
LINRRTQRVDGQP; INRRTQRVDGQPM; NRRTQRVDGQPMY;
RRTQRVDGQPMYG; RTQRVDGQPMYGM; TQRVDGQPMYGME;
QRVDGQPMYGMES; RVDGQPMYGMESQ; VDGQPMYGMESQV;
DGQPMYGMESQVE; GQPMYGMESQVEE; QPMYGMESQVEEV;
PMYGMESQVEEVR; MYGMESQVEEVRV; YGMESQVEEVRVF;
GMESQVEEVRVFD; MESQVEEVRVFDG; ESQVEEVRVFDGT;
SQVEEVRVFDGTE; QVEEVRVFDGTER; VEEVRVFDGTERL;
EEVRVFDGTERLP; EVRVFDGTERLPG; VRVFDGTERLPGD;
RVFDGTERLPGDP; VFDGTERLPGDPD; FDGTERLPGDPDM;
DGTERLPGDPDMI; GTERLPGDPDMIR; TERLPGDPDMIRY;
ERLPGDPDMIRYI; RLPGDPDMIRYID; LPGDPDMIRYIDK;
PGDPDMIRYIDKQ; GDPDMIRYIDKQG; DPDMIRYIDKQGQ;
PDMIRYIDKQGQL; DMIRYIDKQGQLQ; MIRYIDKQGQLQT;
IRYIDKQGQLQTK; RYIDKQGQLQTKM; YIDKQGQLQTKML;
TGAFIVHIHLINA; GAFIVHIHLINAA; AFIVHIHLINAAF;
FIVHIHLINAAFV; ATFKLVLFWGWCF; TFKLVLFWGWCFR;
FKLVLFWGWCFRP; KLVLFWGWCFRPF; LVLFWGWCFRPFK;
VLFWGWCFRPFKT; LFWGWCFRPFKTL; FWGWCFRPFKTLK;
WGWCFRPFKTLKA; GWCFRPFKTLKAF; WCFRPFKTLKAFT;
CFRPFKTLKAFTQ; FRPFKTLKAFTQM; RPFKTLKAFTQMQ;
PFKTLKAFTQMQL; FKTLKAFTQMQLL; KTLKAFTQMQLLT;
TLKAFTQMQLLTM; LKAFTQMQLLTMG; KAFTQMQLLTMGV;
ILFSCNIKNTFPH; LFSCNIKNTFPHA; FSCNIKNTFPHAY;
SCNIKNTFPHAYI; CNIKNTFPHAYII; NIKNTFPHAYIIF;
IKNTFPHAYIIFH; KNTFPHAYIIFHP; KSIHTYLRIQPFL;
SIHTYLRIQPFLP; IHTYLRIQPFLPF; HTYLRIQPFLPFN;
TYLRIQPFLPFNN; YLRIQPFLPFNNS; LRIQPFLPFNNSR;
RIQPFLPFNNSRL; IQPFLPFNNSRLY; QPFLPFNNSRLYI;
PFLPFNNSRLYIS; FLPFNNSRLYISC; LPFNNSRLYISCK;
PFNNSRLYISCKI; FNNSRLYISCKIS; NNSRLYISCKISY;
NSRLYISCKISYR; SRLYISCKISYRP; RLYISCKISYRPK;
LYISCKISYRPKP; YISCKISYRPKPN; ISCKISYRPKPNI;
YFGPKIYLSYKSS; FGPKIYLSYKSSL; GPKIYLSYKSSLQ;
PKIYLSYKSSLQG; KIYLSYKSSLQGF; IYLSYKSSLQGFR;
YLSYKSSLQGFRD; LSYKSSLQGFRDR; SYKSSLQGFRDRI;
YKSSLQGFRDRIL; KSSLQGFRDRILI; SSLQGFRDRILIH;

SLQGFRDRILIHC; LQGFRDRILIHCN; QGFRDRILIHCNQ;
GFRDRILIHCNQA; FRDRILIHCNQAW; RDRILIHCNQAWW;
DRILIHCNQAWWK; RILIHCNQAWWKY; ILIHCNQAWWKYL;
LIHCNQAWWKYLG; IHCNQAWWKYLGS; HCNQAWWKYLGSF;
CNQAWWKYLGSFV; FSSCPFYIFKNNH; SSCPFYIFKNNHV;
SCPFYIFKNNHVL; CPFYIFKNNHVLI; PFYIFKNNHVLIY;
FYIFKNNHVLIYS; YIFKNNHVLIYSY; IFKNNHVLIYSYT;
PVSSFRYIENNTV; VSSFRYIENNTVQ; SSFRYIENNTVQK;
SFRYIENNTVQKI; FRYIENNTVQKIK; RYIENNTVQKIKY;
YIENNTVQKIKYY; IENNTVQKIKYYR; ENNTVQKIKYYRI;
NNTVQKIKYYRIH; NTVQKIKYYRIHF; TVQKIKYYRIHFR;
QTVQPSNTCHILF; HFFPGHMKGIYSF; FFPGHMKGIYSFF;
FPGHMKGIYSFFS; NCIYCLLTNTFLI; CIYCLLTNTFLIF;
IYCLLTNTFLIFT; YCLLTNTFLIFTF; CLLTNTFLIFTFC;
LLTNTFLIFTFCK; LTNTFLIFTFCKN; TNTFLIFTFCKNN;
NTFLIFTFCKNNS; TFLIFTFCKNNSI; FLIFTFCKNNSIC;
LIFTFCKNNSICK; IFTFCKNNSICKV; FTFCKNNSICKVL;
TFCKNNSICKVLF; FCKNNSICKVLFM; CKNNSICKVLFMI;
KNNSICKVLFMIL; NNSICKVLFMILK; NSICKVLFMILKV;
SICKVLFMILKVI; ICKVLFMILKVIR; CKVLFMILKVIRL;
KVLFMILKVIRLV; VLFMILKVIRLVF; LFMILKVIRLVFF;
FMILKVIRLVFFL; MILKVIRLVFFLT; ILKVIRLVFFLTL;
LKVIRLVFFLTLF; KVIRLVFFLTLFT; VIRLVFFLTLFTL;
IRLVFFLTLFTLL; RLVFFLTLFTLLY; LVFFLTLFTLLYI;
VFFLTLFTLLYIV; FFLTLFTLLYIVL; FLTLFTLLYIVLK;
LTLFTLLYIVLKF; KHILTLCLYCILS; HILTLCLYCILSN;
FPRHLLCFFRLFW; PRHLLCFFRLFWA; RHLLCFFRLFWAK;
HLLCFFRLFWAKI; LLCFFRLFWAKIM; LCFFRLFWAKIML;
CFFRLFWAKIMLL; APLNAFFYSMVWI; PLNAFFYSMVWIS;
LNAFFYSMVWISS; KTKGTQLLTEIIN; TKGTQLLTEIINC;
KGTQLLTEIINCR; GTQLLTEIINCRN; TQLLTEIINCRNS;
QLLTEIINCRNSM; LLTEIINCRNSMS; LTEIINCRNSMSM;
TEIINCRNSMSMW; EIINCRNSMSMWS; KEYNIMPSTHVST;
EYNIMPSTHVSTN; YNIMPSTHVSTNK; NIMPSTHVSTNKS;
IMPSTHVSTNKSY; MPSTHVSTNKSYR; PSTHVSTNKSYRI;
STHVSTNKSYRIF; THVSTNKSYRIFF; HVSTNKSYRIFFH;
VSTNKSYRIFFHK; STNKSYRIFFHKF; TNKSYRIFFHKFF;
NKSYRIFFHKFFI; KSYRIFFHKFFIQ; SYRIFFHKFFIQN;
YRIFFHKFFIQNL; RIFFHKFFIQNLS; IFFHKFFIQNLSF;
FFHKFFIQNLSFF; FHKFFIQNLSFFF; HKFFIQNLSFFFS;
KFFIQNLSFFFSS; FFIQNLSFFFSSI; FIQNLSFFFSSIH;
IQNLSFFFSSIHS; QNLSFFFSSIHSK; NLSFFFSSIHSKA;
LSFFFSSIHSKAG; SFFFSSIHSKAGK; FFFSSIHSKAGKG;
FFSSIHSKAGKGS; FSSIHSKAGKGSI; SSIHSKAGKGSIT;
SIHSKAGKGSITK; IHSKAGKGSITKY; HSKAGKGSITKYS;
SKAGKGSITKYSL; KAGKGSITKYSLT; AGKGSITKYSLTK;
GKGSITKYSLTKK; KGSITKYSLTKKL; GSITKYSLTKKLV;
IRGKVFRVFYLSF; RGKVFRVFYLSFF; GKVFRVFYLSFFF;
KVFRVFYLSFFFG; VFRVFYLSFFFGW; FRVFYLSFFFGWC;
VLRICCCFFITGK; LRICCCFFITGKH; RICCCFFITGKHI;
ICCCFFITGKHIF; CCCFFITGKHIFM; CCFFITGKHIFMA;
CFFITGKHIFMAK; IFIPPFIKGTPPG; FIPPFIKGTPPGL;
IPPFIKGTPPGLP; PFFIKGTPPGLPL; FFIKGTPPGLPLF;
FIKGTPPGLPLFC; IKGTPPGLPLFCS; KGTPPGLPLFCSI;
GTPPGLPLFCSIG; TPPGLPLFCSIGW; PPGLPLFCSIGWH;
PGLPLFCSIGWHL; SFRSLKGVSPIIW; FRSLKGVSPIIWT;
RSLKGVSPIIWTH; SLKGVSPIIWTHH; LKGVSPIIWTHHC;
KGVSPIIWTHHCR; GVSPIIWTHHCRV; VSPIIWTHHCRVS;
SPIIWTHHCRVSS; PIIWTHHCRVSSV; IIWTHHCRVSSVR;
IWTHHCRVSSVRS; WTHHCRVSSVRSK; THHCRVSSVRSKP;
HHCRVSSVRSKPN; HCRVSSVRSKPNH; CRVSSVRSKPNHC;
RVSSVRSKPNHCV; VSSVRSKPNHCVK; SSVRSKPNHCVKQ;
SVRSKPNHCVKQS; VRSKPNHCVKQSM; RSKPNHCVKQSMQ;
QSIQTKGSFLKNF; SIQTKGSFLKNFL; IQTKGSFLKNFLF;
QTKGSFLKNFLFK; TKGSFLKNFLFKC; KGSFLKNFLFKCL;
GSFLKNFLFKCLN; SFLKNFLFKCLNL; FLKNFLFKCLNLS;
HSMQGQCTEGFLE; SMQGQCTEGFLEQ; MQGQCTEGFLEQI;
QGQCTEGFLEQIG; GQCTEGFLEQIGH; QCTEGFLEQIGHS;
CTEGFLEQIGHSL; TEGFLEQIGHSLQ; EGFLEQIGHSLQY;
GFLEQIGHSLQYR; FLEQIGHSLQYRV; LEQIGHSLQYRVS;
EQIGHSLQYRVSG; QIGHSLQYRVSGQ; IGHSLQYRVSGQR;
GHSLQYRVSGQRG; HSLQYRVSGQRGK; SLQYRVSGQRGKS;
LQYRVSGQRGKSA; QYRVSGQRGKSAQ; YRVSGQRGKSAQT;
RVSGQRGKSAQTS; VSGQRGKSAQTSE; SGQRGKSAQTSEL;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GQRGKSAQTSELL; QRGKSAQTSELLQ; RGKSAQTSELLQV;
GKSAQTSELLQVP; KSAQTSELLQVPK; SAQTSELLQVPKS;
AQTSELLQVPKSG; ATFTSCSIFLYKV; TFTSCSIFLYKVF;
FTSCSIFLYKVFI; TSCSIFLYKVFIL; SCSIFLYKVFILF;
CSIFLYKVFILFI; SIFLYKVFILFIL; IFLYKVFILFILS;
FLYKVFILFILSS; LYKVFILFILSSS; YKVFILFILSSSP;
KVFILFILSSSPP; VFILFILSSSPPL; FILFILSSSPPLS;
ILFILSSSPPLSG; AFLIKGRFPQAAL; FLIKGRFPQAALS;
LIKGRFPQAALSR; IKGRFPQAALSRP; KGRFPQAALSRPK;
GRFPQAALSRPKR; RFPQAALSRPKRS; FPQAALSRPKRSM;
PQAALSRPKRSMS; QAALSRPKRSMSS; AALSRPKRSMSSM;
ALSRPKRSMSSMD; LSRPKRSMSSMDS; SRPKRSMSSMDSS;
RPKRSMSSMDSSL; PKRSMSSMDSSLL; KRSMSSMDSSLLR;
RSMSSMDSSLLRT; SMSSMDSSLLRTL; MSSMDSSLLRTLS 14 mers:

FCKNCKRIGISPNS; CKNCKRIGISPNSF; KNCKRIGISPNSFA;
NCKRIGISPNSFAR; CKRIGISPNSFARP; KRIGISPNSFARPQ;
RIGISPNSFARPQK; IGISPNSFARPQKK; GISPNSFARPQKKP;
ISPNSFARPQKKPP; SPNSFARPQKKPPH; PNSFARPQKKPPHP;
NSFARPQKKPPHPY; SFARPQKKPPHPYY; FARPQKKPPHPYYL;
ARPQKKPPHPYYLR; RPQKKPPHPYYLRE; PQKKPPHPYYLRER;
QKKPPHPYYLRERV; KKPPHPYYLRERVE; KPPHPYYLRERVEA;
PPHPYYLRERVEAE; PHPYYLRERVEAEA; HPYYLRERVEAEAA;
PYYLRERVEAEAAS; YYLRERVEAEAASA; YLRERVEAEAASAS;
LRERVEAEAASASY; RERVEAEAASASYI; ERVEAEAASASYIL;
KKRPQGGAAYPWNA; KRPQGGAAYPWNAA; RPQGGAAYPWNAAK;
PQGGAAYPWNAAKP; PQEGKCMTHRGMQP; QEGKCMTHRGMQPN;
EGKCMTHRGMQPNH; GKCMTHRGMQPNHD; KCMTHRGMQPNHDL;
CMTHRGMQPNHDLR; MTHRGMQPNHDLRK; THRGMQPNHDLRKE;
HRGMQPNHDLRKES; RGMQPNHDLRKESA; LTGRSCLPMECSQT;
TGRSCLPMECSQTM; GRSCLPMECSQTMT; RSCLPMECSQTMTS;
SCLPMECSQTMTSG; CLPMECSQTMTSGR; LPMECSQTMTSGRK;
PMECSQTMTSGRKV; MECSQTMTSGRKVH; ECSQTMTSGRKVHD;
CSQTMTSGRKVHDR; SQTMTSGRKVHDRH; QTMTSGRKVHDRHV;
TMTSGRKVHDRHVL; MTSGRKVHDRHVLR; TSGRKVHDRHVLRA;
ESWPCPQLNWTKAM; SWPCPQLNWTKAMV; WPCPQLNWTKAMVL;
PCPQLNWTKAMVLR; CPQLNWTKAMVLRQ; PQLNWTKAMVLRQL;
QLNWTKAMVLRQLS; LNWTKAMVLRQLSR; NWTKAMVLRQLSRQ;
WTKAMVLRQLSRQA; TKAMVLRQLSRQAS; KAMVLRQLSRQASV;
AMVLRQLSRQASVK; MVLRQLSRQASVKV; VLRQLSRQASVKVG;
LRQLSRQASVKVGK; RQLSRQASVKVGKT; QLSRQASVKVGKTW;
LSRQASVKVGKTWT; SRQASVKVGKTWTG; RQASVKVGKTWTGT;
QASVKVGKTWTGTK; ASVKVGKTWTGTKK; SVKVGKTWTGTKKR;
VKVGKTWTGTKKRA; KVGKTWTGTKKRAQ; VGKTWTGTKKRAQR;
GKTWTGTKKRAQRI; KTWTGTKKRAQRIF; TWTGTKKRAQRIFI;
WTGTKKRAQRIFIF; TGTKKRAQRIFIFI; GTKKRAQRIFIFIL;
TKKRAQRIFIFILE; KKRAQRIFIFILEL; KRAQRIFIFILELL;
RAQRIFIFILELLL; AQRIFIFILELLLE; QRIFIFILELLLEF;
RIFIFILELLLEFC; IFIFILELLLEFCR; FIFILELLLEFCRG;
IFILELLLEFCRGE; FILELLLEFCRGED; ILELLLEFCRGEDS;
LELLLEFCRGEDSV; ELLLEFCRGEDSVD; LLLEFCRGEDSVDG;
LLEFCRGEDSVDGK; LEFCRGEDSVDGKN; EFCRGEDSVDGKNK;
FCRGEDSVDGKNKS; CRGEDSVDGKNKST; RGEDSVDGKNKSTT;
GEDSVDGKNKSTTA; EDSVDGKNKSTTAL; DSVDGKNKSTTALP;
SVDGKNKSTTALPA; VDGKNKSTTALPAV; DGKNKSTTALPAVK;
GKNKSTTALPAVKD; KNKSTTALPAVKDS; NKSTTALPAVKDSV;
KSTTALPAVKDSVK; STTALPAVKDSVKD; TTALPAVKDSVKDS;
VSNPFFFVFPGSWV; SNPFFFVFPGSWVL; NPFFFVFPGSWVLL;
LPVYLRLLLPQDFQ; PVYLRLLLPQDFQW; VYLRLLLPQDFQWL;
YLRLLLPQDFQWLK; LRLLLPQDFQWLKL; RLLLPQDFQWLKLL;
LLLPQDFQWLKLLL; LLPQDFQWLKLLLG; LPQDFQWLKLLLGR;
PQDFQWLKLLLGRL; QDFQWLKLLLGRLL; DFQWLKLLLGRLLL;
FQWLKLLLGRLLLL; GISSLMIGITKFPL; ASISNQAWLWNCLT;
SISNQAWLWNCLTQ; ISNQAWLWNCLTQM; SNQAWLWNCLTQMS;
NQAWLWNCLTQMST; QAWLWNCLTQMSTM; AWLWNCLTQMSTMI;
WLWNCLTQMSTMIF; LWNCLTQMSTMIFC; WNCLTQMSTMIFCF;
NCLTQMSTMIFCFL; CLTQMSTMIFCFLV; LTQMSTMIFCFLVI;
LLLIIFNTLILGIG; LLIIFNTLILGIGV; LIIFNTLILGIGVL;
IIFNTLILGIGVLL; IFNTLILGIGVLLC; FNTLILGIGVLLCL;
NTLILGIGVLLCLL; TLILGIGVLLCLLL; LILGIGVLLCLLLF;
ILGIGVLLCLLLFP; LGIGVLLCLLLFPR; GIGVLLCLLLFPRL;
IGVLLCLLLFPRLC; GVLLCLLLFPRLCG; VLLCLLLFPRLCGM;

LLCLLLFPRLCGML; LCLLLFPRLCGMLL; CLLLFPRLCGMLLG;
LLLFPRLCGMLLGM; LLFPRLCGMLLGMI; LFPRLCGMLLGMIY;
FPRLCGMLLGMIYL; PRLCGMLLGMIYLL; PHRNCREEQKDFLE;
HRNCREEQKDFLET; RNCREEQKDFLETP; NCREEQKDFLETPW;
CREEQKDFLETPWL; REEQKDFLETPWLD; EEQKDFLETPWLDF;
EQKDFLETPWLDFW; QKDFLETPWLDFWR; KDFLETPWLDFWRK;
DFLETPWLDFWRKL; FLETPWLDFWRKLP; LETPWLDFWRKLPG;
ETPWLDFWRKLPGQ; TPWLDFWRKLPGQL; TFIIIFNNIILIFP;
FIIIFNNIILIFPL; IIIFNNIILIFPLL; IIFNNIILIFPLLG;
IFNNIILIFPLLGP; FNNIILIFPLLGPQ; NNIILIFPLLGPQW;
NIILIFPLLGPQWL; IILIFPLLGPQWLD; ILIFPLLGPQWLDK;
LKGKVPVYILAILI; KGKVPVYILAILIV; KKLLPQEVLIKELL;
KLLPQEVLIKELLL; LLPQEVLIKELLLN; LPQEVLIKELLLNG;
PQEVLIKELLLNGC; QEVLIKELLLNGCC; EVLIKELLLNGCCL;
VLIKELLLNGCCLY; LIKELLLNGCCLYF; HLLLKHMKMAPTKR;
LLLKHMKMAPTKRK; LLKHMKMAPTKRKG; LKHMKMAPTKRKGE;
KHMKMAPTKRKGEC; HMKMAPTKRKGECP; MKMAPTKRKGECPG;
KMAPTKRKGECPGA; MAPTKRKGECPGAA; APTKRKGECPGAAP;
PTKRKGECPGAAPK; TKRKGECPGAAPKK; KRKGECPGAAPKKP;
RKGECPGAAPKKPK; KGECPGAAPKKPKE; GECPGAAPKKPKEP;
ECPGAAPKKPKEPV; CPGAAPKKPKEPVQ; PGAAPKKPKEPVQV;
GAAPKKPKEPVQVP; AAPKKPKEPVQVPK; APKKPKEPVQVPKL;
PKKPKEPVQVPKLL; KKPKEPVQVPKLLI; KPKEPVQVPKLLIK;
PKEPVQVPKLLIKG; KEPVQVPKLLIKGG; EPVQVPKLLIKGGV;
PVQVPKLLIKGGVE; VQVPKLLIKGGVEV; QVPKLLIKGGVEVL;
VPKLLIKGGVEVLE; PKLLIKGGVEVLEV; KLLIKGGVEVLEVK;
LLIKGGVEVLEVKT; LIKGGVEVLEVKTG; IKGGVEVLEVKTGV;
KGGVEVLEVKTGVD; GGVEVLEVKTGVDA; GVEVLEVKTGVDAI;
VEVLEVKTGVDAIT; EVLEVKTGVDAITE; VLEVKTGVDAITEV;
LEVKTGVDAITEVE; EVKTGVDAITEVEC; VKTGVDAITEVECF;
KTGVDAITEVECFL; TGVDAITEVECFLN; GVDAITEVECFLNP;
VDAITEVECFLNPE; DAITEVECFLNPEM; AITEVECFLNPEMG;
ITEVECFLNPEMGD; TEVECFLNPEMGDP; EVECFLNPEMGDPD;
VECFLNPEMGDPDE; ECFLNPEMGDPDEN; CFLNPEMGDPDENL;
FLNPEMGDPDENLR; LNPEMGDPDENLRG; NPEMGDPDENLRGF;
PEMGDPDENLRGFS; EMGDPDENLRGFSL; MGDPDENLRGFSLK;
GDPDENLRGFSLKL; DPDENLRGFSLKLS; PDENLRGFSLKLSA;
DENLRGFSLKLSAE; ENLRGFSLKLSAEN; NLRGFSLKLSAEND;
LRGFSLKLSAENDF; RGFSLKLSAENDFS; GFSLKLSAENDFSS;
FSLKLSAENDFSSD; SLKLSAENDFSSDS; LKLSAENDFSSDSP;
KLSAENDFSSDSPE; LSAENDFSSDSPER; SAENDFSSDSPERK;
AENDFSSDSPERKM; ENDFSSDSPERKML; NDFSSDSPERKMLP;
DFSSDSPERKMLPC; FSSDSPERKMLPCY; SSDSPERKMLPCYS;
SDSPERKMLPCYST; DSPERKMLPCYSTA; SPERKMLPCYSTAR;
PERKMLPCYSTARI; ERKMLPCYSTARIP; RKMLPCYSTARIPL;
KMLPCYSTARIPLP; MLPCYSTARIPLPN; LPCYSTARIPLPNL;
PCYSTARIPLPNLN; CYSTARIPLPNLNE; YSTARIPLPNLNED;
STARIPLPNLNEDL; TARIPLPNLNEDLT; ARIPLPNLNEDLTC;
RIPLPNLNEDLTCG; IPLPNLNEDLTCGN; PLPNLNEDLTCGNL;
LPNLNEDLTCGNLL; PNLNEDLTCGNLLM; NLNEDLTCGNLLMW;
LNEDLTCGNLLMWE; NEDLTCGNLLMWEA; EDLTCGNLLMWEAV;
DLTCGNLLMWEAVT; LTCGNLLMWEAVTV; TCGNLLMWEAVTVQ;
CGNLLMWEAVTVQT; GNLLMWEAVTVQTE; NLLMWEAVTVQTEV;
LLMWEAVTVQTEVI; LMWEAVTVQTEVIG; MWEAVTVQTEVIGI;
WEAVTVQTEVIGIT; EAVTVQTEVIGITS; AVTVQTEVIGITSM;
VTVQTEVIGITSML; TVQTEVIGITSMLN; VQTEVIGITSMLNL;
QTEVIGITSMLNLH; TEVIGITSMLNLHA; EVIGITSMLNLHAG;
VIGITSMLNLHAGS; IGITSMLNLHAGSQ; GITSMLNLHAGSQK;
ITSMLNLHAGSQKV; TSMLNLHAGSQKVH; SMLNLHAGSQKVHE;
MLNLHAGSQKVHEH; LNLHAGSQKVHEHG; NLHAGSQKVHEHGG;
LHAGSQKVHEHGGG; HAGSQKVHEHGGGK; AGSQKVHEHGGGKP;
GSQKVHEHGGGKPI; SQKVHEHGGGKPIQ; QKVHEHGGGKPIQG;
KVHEHGGGKPIQGS; VHEHGGGKPIQGSN; HEHGGGKPIQGSNF;
EHGGGKPIQGSNFH; HGGGKPIQGSNFHF; GGGKPIQGSNFHFF;
GGKPIQGSNFHFFA; GKPIQGSNFHFFAV; KPIQGSNFHFFAVG;
PIQGSNFHFFAVGG; IQGSNFHFFAVGGE; QGSNFHFFAVGGEP;
GSNFHFFAVGGEPL; SNFHFFAVGGEPLE; NFHFFAVGGEPLEM;
FHFFAVGGEPLEMQ; HFFAVGGEPLEMQG; FFAVGGEPLEMQGV;
FAVGGEPLEMQGVL; AVGGEPLEMQGVLM; VGGEPLEMQGVLMN;
GGEPLEMQGVLMNY; GEPLEMQGVLMNYR; EPLEMQGVLMNYRS;
PLEMQGVLMNYRSK; LEMQGVLMNYRSKY; EMQGVLMNYRSKYP;
MQGVLMNYRSKYPD; QGVLMNYRSKYPDG; GVLMNYRSKYPDGT;
VLMNYRSKYPDGTI; LMNYRSKYPDGTIT; MNYRSKYPDGTITP;
NYRSKYPDGTITPK; YRSKYPDGTITPKN; RSKYPDGTITPKNP;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

SKYPDGTITPKNPT; KYPDGTITPKNPTA; YPDGTITPKNPTAQ;
PDGTITPKNPTAQS; DGTITPKNPTAQSQ; GTITPKNPTAQSQV;
TITPKNPTAQSQVM; ITPKNPTAQSQVMN; TPKNPTAQSQVMNT;
PKNPTAQSQVMNTD; KNPTAQSQVMNTDH; NPTAQSQVMNTDHK;
PTAQSQVMNTDHKA; TAQSQVMNTDHKAY; AQSQVMNTDHKAYL;
QSQVMNTDHKAYLD; SQVMNTDHKAYLDK; QVMNTDHKAYLDKN;
VMNTDHKAYLDKNN; MNTDHKAYLDKNNA; NTDHKAYLDKNNAY;
TDHKAYLDKNNAYP; DHKAYLDKNNAYPV; HKAYLDKNNAYPVE;
KAYLDKNNAYPVEC; AYLDKNNAYPVECW; YLDKNNAYPVECWV;
LDKNNAYPVECWVP; DKNNAYPVECWVPD; KNNAYPVECWVPDP;
NNAYPVECWVPDPS; NAYPVECWVPDPSR; AYPVECWVPDPSRN;
YPVECWVPDPSRNE; PVECWVPDPSRNEN; VECWVPDPSRNENA;
ECWVPDPSRNENAR; CWVPDPSRNENARY; WVPDPSRNENARYF;
VPDPSRNENARYFG; PDPSRNENARYFGT; DPSRNENARYFGTF;
PSRNENARYFGTFT; SRNENARYFGTFTG; RNENARYFGTFTGG;
NENARYFGTFTGGE; ENARYFGTFTGGEN; NARYFGTFTGGENV;
ARYFGTFTGGENVP; RYFGTFTGGENVPP; YFGTFTGGENVPPV;
FGTFTGGENVPPVL; GTFTGGENVPPVLH; TFTGGENVPPVLHV;
FTGGENVPPVLHVT; TGGENVPPVLHVTN; GGENVPPVLHVTNT;
GENVPPVLHVTNTA; ENVPPVLHVTNTAT; NVPPVLHVTNTATT;
VPPVLHVTNTATTV; PPVLHVTNTATTVL; PVLHVTNTATTVLL;
VLHVTNTATTVLLD; LHVTNTATTVLLDE; HVTNTATTVLLDEQ;
VTNTATTVLLDEQG; TNTATTVLLDEQGV; NTATTVLLDEQGVG;
TATTVLLDEQGVGP; ATTVLLDEQGVGPL; TTVLLDEQGVGPLC;
TVLLDEQGVGPLCK; VLLDEQGVGPLCKA; LLDEQGVGPLCKAD;
LDEQGVGPLCKADS; DEQGVGPLCKADSL; EQGVGPLCKADSLY;
QGVGPLCKADSLYV; GVGPLCKADSLYVS; VGPLCKADSLYVSA;
GPLCKADSLYVSAA; PLCKADSLYVSAAD; LCKADSLYVSAADI;
CKADSLYVSAADIC; KADSLYVSAADICG; ADSLYVSAADICGL;
DSLYVSAADICGLF; SLYVSAADICGLFT; LYVSAADICGLFTN;
YVSAADICGLFTNS; VSAADICGLFTNSS; SAADICGLFTNSSG;
AADICGLFTNSSGT; ADICGLFTNSSGTQ; DICGLFTNSSGTQQ;
ICGLFTNSSGTQQW; CGLFTNSSGTQQWR; GLFTNSSGTQQWRG;
LFTNSSGTQQWRGL; FTNSSGTQQWRGLA; TNSSGTQQWRGLAR;
NSSGTQQWRGLARY; SSGTQQWRGLARYF; SGTQQWRGLARYFK;
GTQQWRGLARYFKI; TQQWRGLARYFKIR; QQWRGLARYFKIRL;
QWRGLARYFKIRLR; WRGLARYFKIRLRK; RGLARYFKIRLRKR;
GLARYFKIRLRKRS; LARYFKIRLRKRSV; ARYFKIRLRKRSVK;
RYFKIRLRKRSVKN; YFKIRLRKRSVKNP; FKIRLRKRSVKNPY;
KIRLRKRSVKNPYP; IRLRKRSVKNPYPI; RLRKRSVKNPYPIS;
LRKRSVKNPYPISF; RKRSVKNPYPISFL; KRSVKNPYPISFLL;
RSVKNPYPISFLLS; SVKNPYPISFLLSD; VKNPYPISFLLSDL;
KNPYPISFLLSDLI; NPYPISFLLSDLIN; PYPISFLLSDLINR;
YPISFLLSDLINRR; PISFLLSDLINRRT; ISFLLSDLINRRTQ;
SFLLSDLINRRTQR; FLLSDLINRRTQRV; LLSDLINRRTQRVD;
LSDLINRRTQRVDG; SDLINRRTQRVDGQ; DLINRRTQRVDGQP;
LINRRTQRVDGQPM; INRRTQRVDGQPMY; NRRTQRVDGQPMYG;
RRTQRVDGQPMYGM; RTQRVDGQPMYGME; TQRVDGQPMYGMES;
QRVDGQPMYGMESQ; RVDGQPMYGMESQV; VDGQPMYGMESQVE;
DGQPMYGMESQVEE; GQPMYGMESQVEEV; QPMYGMESQVEEVR;
PMYGMESQVEEVRV; MYGMESQVEEVRVF; YGMESQVEEVRVFD;
GMESQVEEVRVFDG; MESQVEEVRVFDGT; ESQVEEVRVFDGTE;
SQVEEVRVFDGTER; QVEEVRVFDGTERL; VEEVRVFDGTERLP;
EEVRVFDGTERLPG; EVRVFDGTERLPGD; VRVFDGTERLPGDP;
RVFDGTERLPGDPD; VFDGTERLPGDPDM; FDGTERLPGDPDMI;
DGTERLPGDPDMIR; GTERLPGDPDMIRY; TERLPGDPDMIRYI;
ERLPGDPDMIRYID; RLPGDPDMIRYIDK; LPGDPDMIRYIDKQ;
PGDPDMIRYIDKQG; GDPDMIRYIDKQGQ; DPDMIRYIDKQGQL;
PDMIRYIDKQGQLQ; DMIRYIDKQGQLQT; MIRYIDKQGQLQTK;
IRYIDKQGQLQTKM; RYIDKQGQLQTKML; TGAFIVHIHLINAA;
GAFIVHIHLINAAF; AFIVHIHLINAAFV; FIVHIHLINAAFVT;
TFKLVLFWGWCFRP; FKLVLFWGWCFRPF; KLVLFWGWCFRPFK;
LVLFWGWCFRPFKT; VLFWGWCFRPFKTL; LFWGWCFRPFKTLK;
FWGWCFRPFKTLKA; WGWCFRPFKTLKAF; GWCFRPFKTLKAFT;
WCFRPFKTLKAFTQ; CFRPFKTLKAFTQM; FRPFKTLKAFTQMQ;
RPFKTLKAFTQMQL; PFKTLKAFTQMQLL; FKTLKAFTQMQLLT;
KTLKAFTQMQLLTM; TLKAFTQMQLLTMG; LKAFTQMQLLTMGV;
ILFSCNIKNTFPHA; LFSCNIKNTFPHAY; FSCNIKNTFPHAYI;
SCNIKNTFPHAYII; CNIKNTFPHAYIIH; NIKNTFPHAYIIHP;
IKNTFPHAYIIHPF; KSIHTYLRIQPFLP; SIHTYLRIQPFLPF;
IHTYLRIQPFLPFN; HTYLRIQPFLPFNN; TYLRIQPFLPFNNS;
YLRIQPFLPFNNSR; LRIQPFLPFNNSRL; RIQPFLPFNNSRLY;
IQPFLPFNNSRLYI; QPFLPFNNSRLYIS; PFLPFNNSRLYISC;
FLPFNNSRLYISCK; LPFNNSRLYISCKI; PFNNSRLYISCKIS;
FNNSRLYISCKISY; NNSRLYISCKISYR; NSRLYISCKISYRP;
SRLYISCKISYRPK; RLYISCKISYRPKP; LYISCKISYRPKPN;
IYFGPKIYLSYKSS; YFGPKIYLSYKSSL; FGPKIYLSYKSSLQ;
GPKIYLSYKSSLQG; PKIYLSYKSSLQGF; KIYLSYKSSLQGFR;
IYLSYKSSLQGFRD; YLSYKSSLQGFRDR; LSYKSSLQGFRDRI;
SYKSSLQGFRDRIL; YKSSLQGFRDRILI; KSSLQGFRDRILIH;
SSLQGFRDRILIHC; SLQGFRDRILIHCN; LQGFRDRILIHCNQ;
QGFRDRILIHCNQA; GFRDRILIHCNQAW; FRDRILIHCNQAWW;
RDRILIHCNQAWWK; DRILIHCNQAWWKY; RILIHCNQAWWKYL;
ILIHCNQAWWKYLG; LIHCNQAWWKYLGS; IHCNQAWWKYLGSF;
HCNQAWWKYLGSFV; FSSCPFYIFKNNHV; SSCPFYIFKNNHVL;
SCPFYIFKNNHVLI; CPFYIFKNNHVLIY; PFYIFKNNHVLIYS;
FYIFKNNHVLIYSY; YIFKNNHVLIYSYT; PVSSFRYIENNTVQ;
VSSFRYIENNTVQK; SSFRYIENNTVQKI; SFRYIENNTVQKIK;
FRYIENNTVQKIKY; RYIENNTVQKIKYY; YIENNTVQKIKYYR;
IENNTVQKIKYYRI; ENNTVQKIKYYRIH; NNTVQKIKYYRIHF;
NTVQKIKYYRIHFR; HFPPGHMKGIYSFF; FPPGHMKGIYSFFS;
NCIYCLLTNTFLIF; CIYCLLTNTFLIFT; IYCLLTNTFLIFTF;
YCLLTNTFLIFTFC; CLLTNTFLIFTFCK; LLTNTFLIFTFCKN;
LTNTFLIFTFCKNN; TNTFLIFTFCKNNS; NTFLIFTFCKNNSI;
TFLIFTFCKNNSIC; FLIFTFCKNNSICK; LIFTFCKNNSICKV;
IFTFCKNNSICKVL; FTFCKNNSICKVLF; TFCKNNSICKVLFM;
FCKNNSICKVLFMI; CKNNSICKVLFMIL; KNNSICKVLFMILK;
NNSICKVLFMILKV; NSICKVLFMILKVI; SICKVLFMILKVIR;
ICKVLFMILKVIRL; CKVLFMILKVIRLV; KVLFMILKVIRLVF;
VLFMILKVIRLVFF; LFMILKVIRLVFFL; FMILKVIRLVFFLT;
MILKVIRLVFFLTL; ILKVIRLVFFLTLF; LKVIRLVFFLTLFT;
KVIRLVFFLTLFTL; VIRLVFFLTLFTLL; IRLVFFLTLFTLLY;
RLVFFLTLFTLLYI; LVFFLTLFTLLYIV; VFFLTLFTLLYIVL;
FFLTLFTLLYIVLK; FLTLFTLLYIVLKF; KHILTLCLYCILSN;
FPRHLLCFFRLFWA; PRHLLCFFRLFWAK; RHLLCFFRLFWAKI;
HLLCFFRLFWAKIM; LLCFFRLFWAKIML; LCFFRLFWAKIMLL;
APLNAFFYSMVWIS; PLNAFFYSMVWISS; KTKGTQLLTEIINC;
TKGTQLLTEIINCR; KGTQLLTEIINCRN; GTQLLTEIINCRNS;
TQLLTEIINCRNSM; QLLTEIINCRNSMS; LLTEIINCRNSMSM;
LTEIINCRNSMSMW; TEIINCRNSMSMWS; KEYNIMPSTHVSTN;
EYNIMPSTHVSTNK; YNIMPSTHVSTNKS; NIMPSTHVSTNKSY;
IMPSTHVSTNKSYR; MPSTHVSTNKSYRI; PSTHVSTNKSYRIF;
STHVSTNKSYRIFF; THVSTNKSYRIFFH; HVSTNKSYRIFFHK;
VSTNKSYRIFFHKF; STNKSYRIFFHKFF; TNKSYRIFFHKFFI;
NKSYRIFFHKFFIQ; KSYRIFFHKFFIQN; SYRIFFHKFFIQNL;
YRIFFHKFFIQNLS; RIFFHKFFIQNLSF; IFFHKFFIQNLSFF;
FFHKFFIQNLSFFF; FHKFFIQNLSFFFS; HKFFIQNLSFFFSS;
KFFIQNLSFFFSSI; FFIQNLSFFFSSIH; FIQNLSFFFSSIHS;
IQNLSFFFSSIHSK; QNLSFFFSSIHSKA; NLSFFFSSIHSKAG;
LSFFFSSIHSKAGK; SFFFSSIHSKAGKG; FFFSSIHSKAGKGS;
FFSSIHSKAGKGSI; FSSIHSKAGKGSIT; SSIHSKAGKGSITK;
SIHSKAGKGSITKY; IHSKAGKGSITKYS; HSKAGKGSITKYSL;
SKAGKGSITKYSLT; KAGKGSITKYSLTK; AGKGSITKYSLTKK;
GKGSITKYSLTKKL; KGSITKYSLTKKLV; IRGKVFRVFYLSFF;
RGKVFRVFYLSFFF; GKVFRVFYLSFFFG; KVFRVFYLSFFFGW;
VFRVFYLSFFFGWC; VLRICCCFFITGKH; LRICCCFFITGKHI;
RICCCFFITGKHIF; ICCCFFITGKHIFM; CCCFFITGKHIFMA;
CCFFITGKHIFMAK; IFIPFFIKGTPPGL; FIPFFIKGTPPGLP;
IPFFIKGTPPGLPL; PFFIKGTPPGLPLF; FFIKGTPPGLPLFC;
FIKGTPPGLPLFCS; IKGTPPGLPLFCSI; KGTPPGLPLFCSIG;
GTPPGLPLFCSIGW; TPPGLPLFCSIGWH; PPGLPLFCSIGWHL;
SFRSLKGVSPIIWT; FRSLKGVSPIIWTH; RSLKGVSPIIWTHH;
SLKGVSPIIWTHHC; LKGVSPIIWTHHCR; KGVSPIIWTHHCRV;
GVSPIIWTHHCRVS; VSPIIWTHHCRVSS; SPIIWTHHCRVSSV;
PIIWTHHCRVSSVR; IIWTHHCRVSSVRS; IWTHHCRVSSVRSK;
WTHHCRVSSVRSKP; THHCRVSSVRSKPN; HHCRVSSVRSKPNH;
HCRVSSVRSKPNHC; CRVSSVRSKPNHCV; RVSSVRSKPNHCVK;
VSSVRSKPNHCVKQ; SSVRSKPNHCVKQS; SVRSKPNHCVKQSM;
VRSKPNHCVKQSMQ; QSIQTKGSFLKNFL; SIQTKGSFLKNFLF;
IQTKGSFLKNFLFK; QTKGSFLKNFLFKC; TKGSFLKNFLFKCL;
KGSFLKNFLFKCLN; GSFLKNFLFKCLNL; SFLKNFLFKCLNLS;
HSMQGQCTEGFLEQ; SMQGQCTEGFLEQI; MQGQCTEGFLEQIG;
QGQCTEGFLEQIGS; GQCTEGFLEQIGSL; QCTEGFLEQIGSLQ;
CTEGFLEQIGSLQY; TEGFLEQIGSLQYR; EGFLEQIGSLQYRV;
GFLEQIGSLQYRVS; FLEQIGSLQYRVSG; LEQIGSLQYRVSGQ;
EQIGSLQYRVSGQR; QIGSLQYRVSGQRG; IGSLQYRVSGQRGK;
GHSLQYRVSGQRGK; HSLQYRVSGQRGKS; SLQYRVSGQRGKSA;
LQYRVSGQRGKSAQ; QYRVSGQRGKSAQT; YRVSGQRGKSAQTS;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

RVSGQRGKSAQTSE; VSGQRGKSAQTSEL; SGQRGKSAQTSELL;
GQRGKSAQTSELLQ; QRGKSAQTSELLQV; RGKSAQTSELLQVP;
GKSAQTSELLQVPK; KSAQTSELLQVPKS; SAQTSELLQVPKSG;
ATFTSCSIFLYKVF; TFTSCSIFLYKVFI; FTSCSIFLYKVFIL;
TSCSIFLYKVFILF; SCSIFLYKVFILFI; CSIFLYKVFILFIL;
SIFLYKVFILFILS; IFLYKVFILFILSS; FLYKVFILFILSSS;
LYKVFILFILSSSP; YKVFILFILSSSPP; KVFILFILSSSPPL;
VFILFILSSSPPLS; FILFILSSSPPLSG; AFLIKGRFPQAALS;
FLIKGRFPQAALSR; LIKGRFPQAALSRP; IKGRFPQAALSRPK;
KGRFPQAALSRPKR; GRFPQAALSRPKRS; RFPQAALSRPKRSM;
FPQAALSRPKRSMS; PQAALSRPKRSMSS; QAALSRPKRSMSSM;
AALSRPKRSMSSMD; ALSRPKRSMSSMDS; LSRPKRSMSSMDSS;
SRPKRSMSSMDSSL; RPKRSMSSMDSSLL; PKRSMSSMDSSLLR;
KRSMSSMDSSLLRT; RSMSSMDSSLLRTL; SMSSMDSSLLRTLS 15 mers:

FCKNCKRIGISPNSF; CKNCKRIGISPNSFA; KNCKRIGISPNSFAR;
NCKRIGISPNSFARP; CKRIGISPNSFARPQ; KRIGISPNSFARPQK;
RIGISPNSFARPQKK; IGISPNSFARPQKKP; GISPNSFARPQKKPP;
ISPNSFARPQKKPPH; SPNSFARPQKKPPHP; PNSFARPQKKPPHPY;
NSFARPQKKPPHPYY; SFARPQKKPPHPYYL; FARPQKKPPHPYYLR;
ARPQKKPPHPYYLRE; RPQKKPPHPYYLRER; PQKKPPHPYYLRERV;
QKKPPHPYYLRERVE; KKPPHPYYLRERVEA; KPPHPYYLRERVEAE;
PPHPYYLRERVEAEA; PHPYYLRERVEAEAA; HPYYLRERVEAEAAS;
PYYLRERVEAEAASA; YYLRERVEAEAASAS; YLRERVEAEAASASY;
LRERVEAEAASASYI; RERVEAEAASASYIL; KKRPQGGAAYPWNAA;
KRPQGGAAYPWNAAK; RPQGGAAYPWNAAKP; PQEGKCMTHRGMQPN;
QEGKCMTHRGMQPNH; EGKCMTHRGMQPNHD; GKCMTHRGMQPNHDL;
KCMTHRGMQPNHDLR; CMTHRGMQPNHDLRK; MTHRGMQPNHDLRKE;
THRGMQPNHDLRKES; HRGMQPNHDLRKESA; LTGRSCLPMECSQTM;
TGRSCLPMECSQTMT; GRSCLPMECSQTMTS; RSCLPMECSQTMTSG;
SCLPMECSQTMTSGR; CLPMECSQTMTSGRK; LPMECSQTMTSGRKV;
PMECSQTMTSGRKVH; MECSQTMTSGRKVHD; ECSQTMTSGRKVHDR;
CSQTMTSGRKVHDRH; SQTMTSGRKVHDRHV; QTMTSGRKVHDRHVL;
TMTSGRKVHDRHVLR; MTSGRKVHDRHVLRA; ESWPCPQLNWTKAMV;
SWPCPQLNWTKAMVL; WPCPQLNWTKAMVLR; PCPQLNWTKAMVLRQ;
CPQLNWTKAMVLRQL; PQLNWTKAMVLRQLS; QLNWTKAMVLRQLSR;
LNWTKAMVLRQLSRQ; NWTKAMVLRQLSRQA; WTKAMVLRQLSRQAS;
TKAMVLRQLSRQASV; KAMVLRQLSRQASVK; AMVLRQLSRQASVKV;
MVLRQLSRQASVKVG; VLRQLSRQASVKVGK; LRQLSRQASVKVGKT;
RQLSRQASVKVGKTW; QLSRQASVKVGKTWT; LSRQASVKVGKTWTG;
SRQASVKVGKTWTGT; RQASVKVGKTWTGTK; QASVKVGKTWTGTKK;
ASVKVGKTWTGTKKR; SVKVGKTWTGTKKRA; VKVGKTWTGTKKRAQ;
KVGKTWTGTKKRAQR; VGKTWTGTKKRAQRI; GKTWTGTKKRAQRIF;
KTWTGTKKRAQRIFI; TWTGTKKRAQRIFIF; WTGTKKRAQRIFIFI;
TGTKKRAQRIFIFIL; GTKKRAQRIFIFILE; TKKRAQRIFIFILEL;
KKRAQRIFIFILELL; KRAQRIFIFILELLE; RAQRIFIFILELLLE;
AQRIFIFILELLLEF; QRIFIFILELLLEFC; RIFIFILELLLEFCR;
IFIFILELLLEFCRG; FIFILELLLEFCRGE; IFILELLLEFCRGED;
FILELLLEFCRGEDS; ILELLLEFCRGEDSV; LELLLEFCRGEDSVD;
ELLLEFCRGEDSVDG; LLLEFCRGEDSVDGK; LLEFCRGEDSVDGKN;
LEFCRGEDSVDGKNK; EFCRGEDSVDGKNKS; FCRGEDSVDGKNKST;
CRGEDSVDGKNKSTT; RGEDSVDGKNKSTTA; GEDSVDGKNKSTTAL;
EDSVDGKNKSTTALP; DSVDGKNKSTTALPA; SVDGKNKSTTALPAV;
VDGKNKSTTALPAVK; DGKNKSTTALPAVKD; GKNKSTTALPAVKDS;
KNKSTTALPAVKDSV; NKSTTALPAVKDSVK; KSTTALPAVKDSVKD;
STTALPAVKDSVKDS; VSNPFFFVFPGSWVL; SNPFFFVFPGSWVLL;
LPVYLRLLLPQDFQW; PVYLRLLLPQDFQWL; VYLRLLLPQDFQWLK;
YLRLLLPQDFQWLKL; LRLLLPQDFQWLKLL; RLLLPQDFQWLKLLL;
LLLPQDFQWLKLLLG; LLPQDFQWLKLLLGR; LPQDFQWLKLLLGRL;
PQDFQWLKLLLGRLL; QDFQWLKLLLGRLLL; DFQWLKLLLGRLLLL;
ASISNQAWLWNCLTQ; SISNQAWLWNCLTQM; ISNQAWLWNCLTQMS;
SNQAWLWNCLTQMST; NQAWLWNCLTQMSTM; QAWLWNCLTQMSTMI;
AWLWNCLTQMSTMIF; WLWNCLTQMSTMIFC; LWNCLTQMSTMIFCF;
WNCLTQMSTMIFCFL; NCLTQMSTMIFCFLV; ILLLIIFNTLILGIG;
LLLIIFNTLILGIGV; LLIIFNTLILGIGVL; LIIFNTLILGIGVLL;
IIFNTLILGIGVLLC; IFNTLILGIGVLLCL; FNTLILGIGVLLCLL;
NTLILGIGVLLCLLL; TLILGIGVLLCLLLF; LILGIGVLLCLLLFP;
ILGIGVLLCLLLFPR; LGIGVLLCLLLFPRL; GIGVLLCLLLFPRLC;
IGVLLCLLLFPRLCG; GVLLCLLLFPRLCGM; VLLCLLLFPRLCGML;
LLCLLLFPRLCGMLL; LCLLLFPRLCGMLLG; CLLLFPRLCGMLLGM;
LLLFPRLCGMLLGMI; LLFPRLCGMLLGMIY; LFPRLCGMLLGMIYL;
FPRLCGMLLGMIYLL; PHRNCREEQKDFLET; HRNCREEQKDFLETP;
RNCREEQKDFLETPW; NCREEQKDFLETPWL; CREEQKDFLETPWLD;
REEQKDFLETPWLDF; EEQKDFLETPWLDFW; EQKDFLETPWLDFWR;
QKDFLETPWLDFWRK; KDFLETPWLDFWRKL; DFLETPWLDFWRKLP;
FLETPWLDFWRKLPG; LETPWLDFWRKLPGQ; ETPWLDFWRKLPGQL;
TFIIIFNNIILIFPL; FIIIFNNIILIFPLL; IIIFNNIILIFPLLG;
IIFNNIILIFPLLGP; IFNNIILIFPLLGPQ; FNNIILIFPLLGPQW;
NNIILIFPLLGPQWL; NIILIFPLLGPQWLD; IILIFPLLGPQWLDK;
LKGKVPVYILAILIV; KKLLPQEVLIKELLL; KLLPQEVLIKELLLN;
LLPQEVLIKELLLNG; LPQEVLIKELLLNGC; PQEVLIKELLLNGCC;
QEVLIKELLLNGCCL; EVLIKELLLNGCCLY; VLIKELLLNGCCLYF;
HLLLKHMKMAPTKRK; LLLKHMKMAPTKRKG; LLKHMKMAPTKRKGE;
LKHMKMAPTKRKGEC; KHMKMAPTKRKGECP; HMKMAPTKRKGECPG;
MKMAPTKRKGECPGA; KMAPTKRKGECPGAA; MAPTKRKGECPGAAP;
APTKRKGECPGAAPK; PTKRKGECPGAAPKK; TKRKGECPGAAPKKP;
KRKGECPGAAPKKPK; RKGECPGAAPKKPKE; KGECPGAAPKKPKEP;
GECPGAAPKKPKEPV; ECPGAAPKKPKEPVQ; CPGAAPKKPKEPVQV;
PGAAPKKPKEPVQVP; GAAPKKPKEPVQVPK; AAPKKPKEPVQVPKL;
APKKPKEPVQVPKLL; PKKPKEPVQVPKLLI; KKPKEPVQVPKLLIK;
KPKEPVQVPKLLIKG; PKEPVQVPKLLIKGG; KEPVQVPKLLIKGGV;
EPVQVPKLLIKGGVE; PVQVPKLLIKGGVEV; VQVPKLLIKGGVEVL;
QVPKLLIKGGVEVLE; VPKLLIKGGVEVLEV; PKLLIKGGVEVLEVK;
KLLIKGGVEVLEVKT; LLIKGGVEVLEVKTG; LIKGGVEVLEVKTGV;
IKGGVEVLEVKTGVD; KGGVEVLEVKTGVDA; GGVEVLEVKTGVDAI;
GVEVLEVKTGVDAIT; VEVLEVKTGVDAITE; EVLEVKTGVDAITEV;
VLEVKTGVDAITEVE; LEVKTGVDAITEVEC; EVKTGVDAITEVECF;
VKTGVDAITEVECFL; KTGVDAITEVECFLN; TGVDAITEVECFLNP;
GVDAITEVECFLNPE; VDAITEVECFLNPEM; DAITEVECFLNPEMG;
AITEVECFLNPEMGD; ITEVECFLNPEMGDP; TEVECFLNPEMGDPD;
EVECFLNPEMGDPDE; VECFLNPEMGDPDEN; ECFLNPEMGDPDENL;
CFLNPEMGDPDENLR; FLNPEMGDPDENLRG; LNPEMGDPDENLRGF;
NPEMGDPDENLRGFS; PEMGDPDENLRGFSL; EMGDPDENLRGFSLK;
MGDPDENLRGFSLKL; GDPDENLRGFSLKLS; DPDENLRGFSLKLSA;
PDENLRGFSLKLSAE; DENLRGFSLKLSAEN; ENLRGFSLKLSAEND;
NLRGFSLKLSAENDF; LRGFSLKLSAENDFS; RGFSLKLSAENDFSS;
GFSLKLSAENDFSSD; FSLKLSAENDFSSDS; SLKLSAENDFSSDSP;
LKLSAENDFSSDSPE; KLSAENDFSSDSPER; LSAENDFSSDSPERK;
SAENDFSSDSPERKM; AENDFSSDSPERKML; ENDFSSDSPERKMLP;
NDFSSDSPERKMLPC; DFSSDSPERKMLPCY; FSSDSPERKMLPCYS;
SSDSPERKMLPCYST; SDSPERKMLPCYSTA; DSPERKMLPCYSTAR;
SPERKMLPCYSTARI; PERKMLPCYSTARIP; ERKMLPCYSTARIPL;
RKMLPCYSTARIPLP; KMLPCYSTARIPLPN; MLPCYSTARIPLPNL;
LPCYSTARIPLPNLN; PCYSTARIPLPNLNE; CYSTARIPLPNLNED;
YSTARIPLPNLNEDL; STARIPLPNLNEDLT; TARIPLPNLNEDLTC;
ARIPLPNLNEDLTCG; RIPLPNLNEDLTCGN; IPLPNLNEDLTCGNL;
PLPNLNEDLTCGNLL; LPNLNEDLTCGNLLM; PNLNEDLTCGNLLMW;
NLNEDLTCGNLLMWE; LNEDLTCGNLLMWEA; NEDLTCGNLLMWEAV;
EDLTCGNLLMWEAVT; DLTCGNLLMWEAVTV; LTCGNLLMWEAVTVQ;
TCGNLLMWEAVTVQT; CGNLLMWEAVTVQTE; GNLLMWEAVTVQTEV;
NLLMWEAVTVQTEVI; LLMWEAVTVQTEVIG; LMWEAVTVQTEVIGI;
MWEAVTVQTEVIGIT; WEAVTVQTEVIGITS; EAVTVQTEVIGITSM;
AVTVQTEVIGITSML; VTVQTEVIGITSMLN; TVQTEVIGITSMLNL;
VQTEVIGITSMLNLH; QTEVIGITSMLNLHA; TEVIGITSMLNLHAG;
EVIGITSMLNLHAGS; VIGITSMLNLHAGSQ; IGITSMLNLHAGSQK;
GITSMLNLHAGSQKV; ITSMLNLHAGSQKVH; TSMLNLHAGSQKVHE;
SMLNLHAGSQKVHEH; MLNLHAGSQKVHEHG; LNLHAGSQKVHEHGG;
NLHAGSQKVHEHGGG; LHAGSQKVHEHGGGK; HAGSQKVHEHGGGKP;
AGSQKVHEHGGGKPI; GSQKVHEHGGGKPIQ; SQKVHEHGGGKPIQG;
QKVHEHGGGKPIQGS; KVHEHGGGKPIQGSN; VHEHGGGKPIQGSNF;
HEHGGGKPIQGSNFH; EHGGGKPIQGSNFHF; HGGGKPIQGSNFHFF;
GGGKPIQGSNFHFFA; GGKPIQGSNFHFFAV; GKPIQGSNFHFFAVG;
KPIQGSNFHFFAVGG; PIQGSNFHFFAVGGE; IQGSNFHFFAVGGEP;
QGSNFHFFAVGGEPL; GSNFHFFAVGGEPLE; SNFHFFAVGGEPLEM;
NFHFFAVGGEPLEMQ; FHFFAVGGEPLEMQG; HFFAVGGEPLEMQGV;
FFAVGGEPLEMQGVL; FAVGGEPLEMQGVLM; AVGGEPLEMQGVLMN;
VGGEPLEMQGVLMNY; GGEPLEMQGVLMNYR; GEPLEMQGVLMNYRS;
EPLEMQGVLMNYRSK; PLEMQGVLMNYRSKY; LEMQGVLMNYRSKYP;
EMQGVLMNYRSKYPD; MQGVLMNYRSKYPDG; QGVLMNYRSKYPDGT;
GVLMNYRSKYPDGTI; VLMNYRSKYPDGTIT; LMNYRSKYPDGTITP;
MNYRSKYPDGTITPK; NYRSKYPDGTITPKN; YRSKYPDGTITPKNP;
RSKYPDGTITPKNPT; SKYPDGTITPKNPTA; KYPDGTITPKNPTAQ;
YPDGTITPKNPTAQS; PDGTITPKNPTAQSQ; DGTITPKNPTAQSQV;
GTITPKNPTAQSQVM; TITPKNPTAQSQVMN; ITPKNPTAQSQVMNT;
TPKNPTAQSQVMNTD; PKNPTAQSQVMNTDH; KNPTAQSQVMNTDHK;
NPTAQSQVMNTDHKA; PTAQSQVMNTDHKAY; TAQSQVMNTDHKAYL;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

AQSQVMNTDHKAYLD; QSQVMNTDHKAYLDK; SQVMNTDHKAYLDKN;
QVMNTDHKAYLDKNN; VMNTDHKAYLDKNNA; MNTDHKAYLDKNNAY;
NTDHKAYLDKNNAYP; TDHKAYLDKNNAYPV; DHKAYLDKNNAYPVE;
HKAYLDKNNAYPVEC; KAYLDKNNAYPVECW; AYLDKNNAYPVECWV;
YLDKNNAYPVECWVP; LDKNNAYPVECWVPD; DKNNAYPVECWVPDP;
KNNAYPVECWVPDPS; NNAYPVECWVPDPSR; NAYPVECWVPDPSRN;
AYPVECWVPDPSRNE; YPVECWVPDPSRNEN; PVECWVPDPSRNENA;
VECWVPDPSRNENAR; ECWVPDPSRNENARY; CWVPDPSRNENARYF;
WVPDPSRNENARYFG; VPDPSRNENARYFGT; PDPSRNENARYFGTF;
DPSRNENARYFGTFT; PSRNENARYFGTFTG; SRNENARYFGTFTGG;
RNENARYFGTFTGGE; NENARYFGTFTGGEN; ENARYFGTFTGGENV;
NARYFGTFTGGENVP; ARYFGTFTGGENVPP; RYFGTFTGGENVPPV;
YFGTFTGGENVPPVL; FGTFTGGENVPPVLH; GTFTGGENVPPVLHV;
TFTGGENVPPVLHVT; FTGGENVPPVLHVTN; TGGENVPPVLHVTNT;
GGENVPPVLHVTNTA; GENVPPVLHVTNTAT; ENVPPVLHVTNTATT;
NVPPVLHVTNTATTV; VPPVLHVTNTATTVL; PPVLHVTNTATTVLL;
PVLHVTNTATTVLLD; VLHVTNTATTVLLDE; LHVTNTATTVLLDEQ;
HVTNTATTVLLDEQG; VTNTATTVLLDEQGV; TNTATTVLLDEQGVG;
NTATTVLLDEQGVGP; TATTVLLDEQGVGPL; ATTVLLDEQGVGPLC;
TTVLLDEQGVGPLCK; TVLLDEQGVGPLCKA; VLLDEQGVGPLCKAD;
LLDEQGVGPLCKADS; LDEQGVGPLCKADSL; DEQGVGPLCKADSLY;
EQGVGPLCKADSLYV; QGVGPLCKADSLYVS; GVGPLCKADSLYVSA;
VGPLCKADSLYVSAA; GPLCKADSLYVSAAD; PLCKADSLYVSAADI;
LCKADSLYVSAADIC; CKADSLYVSAADICG; KADSLYVSAADICGL;
ADSLYVSAADICGLF; DSLYVSAADICGLFT; SLYVSAADICGLFTN;
LYVSAADICGLFTNS; YVSAADICGLFTNSS; VSAADICGLFTNSSG;
SAADICGLFTNSSGT; AADICGLFTNSSGTQ; ADICGLFTNSSGTQQ;
DICGLFTNSSGTQQW; ICGLFTNSSGTQQWR; CGLFTNSSGTQQWRG;
GLFTNSSGTQQWRGL; LFTNSSGTQQWRGLA; FTNSSGTQQWRGLAR;
TNSSGTQQWRGLARY; NSSGTQQWRGLARYF; SSGTQQWRGLARYFK;
SGTQQWRGLARYFKI; GTQQWRGLARYFKIR; TQQWRGLARYFKIRL;
QQWRGLARYFKIRLR; QWRGLARYFKIRLRK; WRGLARYFKIRLRKR;
RGLARYFKIRLRKRS; GLARYFKIRLRKRSV; LARYFKIRLRKRSVK;
ARYFKIRLRKRSVKN; RYFKIRLRKRSVKNP; YFKIRLRKRSVKNPY;
FKIRLRKRSVKNPYP; KIRLRKRSVKNPYPI; IRLRKRSVKNPYPIS;
RLRKRSVKNPYPISF; LRKRSVKNPYPISFL; RKRSVKNPYPISFLL;
KRSVKNPYPISFLLS; RSVKNPYPISFLLSD; SVKNPYPISFLLSDL;
VKNPYPISFLLSDLI; KNPYPISFLLSDLIN; NPYPISFLLSDLINR;
PYPISFLLSDLINRR; YPISFLLSDLINRRT; PISFLLSDLINRRTQ;
ISFLLSDLINRRTQR; SFLLSDLINRRTQRV; FLLSDLINRRTQRVD;
LLSDLINRRTQRVDG; LSDLINRRTQRVDGQ; SDLINRRTQRVDGQP;
DLINRRTQRVDGQPM; LINRRTQRVDGQPMY; INRRTQRVDGQPMYG;
NRRTQRVDGQPMYGM; RRTQRVDGQPMYGME; RTQRVDGQPMYGMES;
TQRVDGQPMYGMESQ; QRVDGQPMYGMESQV; RVDGQPMYGMESQVE;
VDGQPMYGMESQVEE; DGQPMYGMESQVEEV; GQPMYGMESQVEEVR;
QPMYGMESQVEEVRV; PMYGMESQVEEVRVF; MYGMESQVEEVRVFD;
YGMESQVEEVRVFDG; GMESQVEEVRVFDGT; MESQVEEVRVFDGTE;
ESQVEEVRVFDGTER; SQVEEVRVFDGTERL; QVEEVRVFDGTERLP;
VEEVRVFDGTERLPG; EEVRVFDGTERLPGD; EVRVFDGTERLPGDP;
VRVFDGTERLPGDPD; RVFDGTERLPGDPDM; VFDGTERLPGDPDMI;
FDGTERLPGDPDMIR; DGTERLPGDPDMIRY; GTERLPGDPDMIRYI;
TERLPGDPDMIRYID; ERLPGDPDMIRYIDK; RLPGDPDMIRYIDKQ;
LPGDPDMIRYIDKQG; PGDPDMIRYIDKQGQ; GDPDMIRYIDKQGQL;
DPDMIRYIDKQGQLQ; PDMIRYIDKQGQLQT; DMIRYIDKQGQLQTK;
MIRYIDKQGQLQTKM; IRYIDKQGQLQTKML; TGAFIVIHLINAAF;
GAFIVIHLINAAFV; ATFKLVLFWGWCFRP; TFKLVLFWGWCFRPF;
FKLVLFWGWCFRPFK; KLVLFWGWCFRPFKT; LVLFWGWCFRPFKTL;
VLFWGWCFRPFKTLK; LFWGWCFRPFKTLKA; FWGWCFRPFKTLKAF;
WGWCFRPFKTLKAFT; GWCFRPFKTLKAFTQ; WCFRPFKTLKAFTQM;
CFRPFKTLKAFTQMQ; FRPFKTLKAFTQMQL; RPFKTLKAFTQMQLL;
PFKTLKAFTQMQLLT; FKTLKAFTQMQLLTM; KTLKAFTQMQLLTMG;
TLKAFTQMQLLTMGV; ILFSCNIKNTFPHAY; LFSCNIKNTFPHAYI;
FSCNIKNTFPHAYII; SCNIKNTFPHAYIIF; CNIKNTFPHAYIIFH;
NIKNTFPHAYIIFHP; KSIHTYLRIQPFLPF; SIHTYLRIQPFLPFN;
IHTYLRIQPFLPFNN; HTYLRIQPFLPFNNS; TYLRIQPFLPFNNSR;
YLRIQPFLPFNNSRL; LRIQPFLPFNNSRLY; RIQPFLPFNNSRLYI;
IQPFLPFNNSRLYIS; QPFLPFNNSRLYISC; PFLPFNNSRLYISCK;
FLPFNNSRLYISCKI; LPFNNSRLYISCKIS; PFNNSRLYISCKISY;
FNNSRLYISCKISYR; NNSRLYISCKISYRP; NSRLYISCKISYRPK;
SRLYISCKISYRPKP; RLYISCKISYRPKPN; LYISCKISYRPKPNI;
YISCKISYRPKPNIY; ISCKISYRPKPNIYF; SCKISYRPKPNIYFG;
CKISYRPKPNIYFGP; KISYRPKPNIYFGPK; ISYRPKPNIYFGPKI;
SYRPKPNIYFGPKIY; YRPKPNIYFGPKIYL; RPKPNIYFGPKIYLS;
PKPNIYFGPKIYLSY; KPNIYFGPKIYLSYK; PNIYFGPKIYLSYKS;
NIYFGPKIYLSYKSS; IYFGPKIYLSYKSSL; YFGPKIYLSYKSSLQ; FGPKIYLSYKSSLQG; GPKIYLSYKSSLQGF;
PKIYLSYKSSLQGFR; KIYLSYKSSLQGFRD; IYLSYKSSLQGFRDR;
YLSYKSSLQGFRDRI; LSYKSSLQGFRDRIL; SYKSSLQGFRDRILI;
YKSSLQGFRDRILIH; KSSLQGFRDRILIHC; SSLQGFRDRILIHCN;
SLQGFRDRILIHCNQ; LQGFRDRILIHCNQA; QGFRDRILIHCNQAW;
GFRDRILIHCNQAWW; FRDRILIHCNQAWWK; RDRILIHCNQAWWKY;
DRILIHCNQAWWKYL; RILIHCNQAWWKYLG; ILIHCNQAWWKYLGS;
LIHCNQAWWKYLGSF; IHCNQAWWKYLGSFV; FSSCPFYIFKNNHVL;
SSCPFYIFKNNHVLI; SCPFYIFKNNHVLIY; CPFYIFKNNHVLIYS;
PFYIFKNNHVLIYSY; FYIFKNNHVLIYSYT; PVSSFRYIENNTVQK;
VSSFRYIENNTVQKI; SSFRYIENNTVQKIK; SFRYIENNTVQKIKY;
FRYIENNTVQKIKYY; RYIENNTVQKIKYYR; YIENNTVQKIKYYRI;
IENNTVQKIKYYRIH; ENNTVQKIKYYRIHF; NNTVQKIKYYRIHFR;
HFFPGHMKGIYSFFS; NCIYCLLTNTFLIFT; CIYCLLTNTFLIFTF;
IYCLLTNTFLIFTFC; YCLLTNTFLIFTFCK; CLLTNTFLIFTFCKN;
LLTNTFLIFTFCKNN; LTNTFLIFTFCKNNS; TNTFLIFTFCKNNSI;
NTFLIFTFCKNNSIC; TFLIFTFCKNNSICK; FLIFTFCKNNSICKV;
LIFTFCKNNSICKVL; IFTFCKNNSICKVLF; FTFCKNNSICKVLFM;
TFCKNNSICKVLFMI; FCKNNSICKVLFMIL; CKNNSICKVLFMILK;
KNNSICKVLFMILKV; NNSICKVLFMILKVI; NSICKVLFMILKVIR;
SICKVLFMILKVIRL; ICKVLFMILKVIRLV; CKVLFMILKVIRLVF;
KVLFMILKVIRLVFF; VLFMILKVIRLVFFL; LFMILKVIRLVFFLT;
FMILKVIRLVFFLTL; MILKVIRLVFFLTLF; ILKVIRLVFFLTLFT;
LKVIRLVFFLTLFTL; KVIRLVFFLTLFTLL; VIRLVFFLTLFTLLY;
IRLVFFLTLFTLLYI; RLVFFLTLFTLLYIV; LVFFLTLFTLLYIVL;
VFFLTLFTLLYIVLK; FFLTLFTLLYIVLKF; FPRHLLCFFRLFWAK;
PRHLLCFFRLFWAKI; RHLLCFFRLFWAKIM; HLLCFFRLFWAKIML;
LLCFFRLFWAKIMLL; APLNAFFYSMVWISS; KTKGTQLLTEIINCR;
TKGTQLLTEIINCRN; KGTQLLTEIINCRNS; GTQLLTEIINCRNSM;
TQLLTEIINCRNSMS; QLLTEIINCRNSMSM; LLTEIINCRNSMSMW;
LTEIINCRNSMSMWG; KEYNIMPSTHVSTNK; EYNIMPSTHVSTNKS;
YNIMPSTHVSTNKSY; NIMPSTHVSTNKSYR; IMPSTHVSTNKSYRI;
MPSTHVSTNKSYRIF; PSTHVSTNKSYRIFF; STHVSTNKSYRIFFH;
THVSTNKSYRIFFHK; HVSTNKSYRIFFHKF; VSTNKSYRIFFHKFF;
STNKSYRIFFHKFFI; TNKSYRIFFHKFFIQ; NKSYRIFFHKFFIQN;
KSYRIFFHKFFIQNL; SYRIFFHKFFIQNLS; YRIFFHKFFIQNLSF;
RIFFHKFFIQNLSFF; IFFHKFFIQNLSFFF; FFHKFFIQNLSFFFS;
FHKFFIQNLSFFFSS; HKFFIQNLSFFFSSI; KFFIQNLSFFFSSIH;
FFIQNLSFFFSSIHS; FIQNLSFFFSSIHSK; IQNLSFFFSSIHSKA;
QNLSFFFSSIHSKAG; NLSFFFSSIHSKAGK; LSFFFSSIHSKAGKG;
SFFFSSIHSKAGKGS; FFFSSIHSKAGKGSI; FFSSIHSKAGKGSIT;
FSSIHSKAGKGSITK; SSIHSKAGKGSITKY; SIHSKAGKGSITKYS;
IHSKAGKGSITKYSL; HSKAGKGSITKYSLT; SKAGKGSITKYSLTK;
KAGKGSITKYSLTKK; AGKGSITKYSLTKKL; GKGSITKYSLTKKLY;
IRGKVFRVFYLSFFF; RGKVFRVFYLSFFFG; GKVFRVFYLSFFFGW;
KVFRVFYLSFFFGWC; VLRICCCFFITGKHI; LRICCCFFITGKHIF;
RICCCFFITGKHIFM; ICCCFFITGKHIFMA; CCCFFITGKHIFMAK;
IFIPFFIKGTPPGLP; FIPFFIKGTPPGLPL; IPFFIKGTPPGLPLF;
PFFIKGTPPGLPLFC; FFIKGTPPGLPLFCS; FIKGTPPGLPLFCSI;
IKGTPPGLPLFCSIG; KGTPPGLPLFCSIGW; GTPPGLPLFCSIGWH;
TPPGLPLFCSIGWHL; SFRSLKGVSPIIWTH; FRSLKGVSPIIWTHH;
RSLKGVSPIIWTHHC; SLKGVSPIIWTHHCR; LKGVSPIIWTHHCRV;
KGVSPIIWTHHCRVS; GVSPIIWTHHCRVSS; VSPIIWTHHCRVSSV;
SPIIWTHHCRVSSVR; PIIWTHHCRVSSVRS; IIWTHHCRVSSVRSK;
IWTHHCRVSSVRSKP; WTHHCRVSSVRSKPN; THHCRVSSVRSKPNH;
HHCRVSSVRSKPNHC; HCRVSSVRSKPNHCV; CRVSSVRSKPNHCVK;
RVSSVRSKPNHCVKQ; VSSVRSKPNHCVKQS; SSVRSKPNHCVKQSM;
SVRSKPNHCVKQSMQ; QSIQTKGSFLKNFLF; SIQTKGSFLKNFLFK;
IQTKGSFLKNFLFKC; QTKGSFLKNFLFKCL; TKGSFLKNFLFKCLN;
KGSFLKNFLFKCLNL; GSFLKNFLFKCLNLS; HSMQGQCTEGFLEQI;
SMQGQCTEGFLEQIG; MQGQCTEGFLEQIGH; QGQCTEGFLEQIGHS;
GQCTEGFLEQIGHSL; QCTEGFLEQIGHSLQ; CTEGFLEQIGHSLQY;
TEGFLEQIGHSLQYR; EGFLEQIGHSLQYRV; GFLEQIGHSLQYRVS;
FLEQIGHSLQYRVSG; LEQIGHSLQYRVSGQ; EQIGHSLQYRVSGQR;
QIGHSLQYRVSGQRG; IGHSLQYRVSGQRGK; GHSLQYRVSGQRGKS;
HSLQYRVSGQRGKSA; SLQYRVSGQRGKSAQ; LQYRVSGQRGKSAQT;
QYRVSGQRGKSAQTS; YRVSGQRGKSAQTSE; RVSGQRGKSAQTSEL;
VSGQRGKSAQTSELL; SGQRGKSAQTSELLQ; GQRGKSAQTSELLQV;
QRGKSAQTSELLQVP; RGKSAQTSELLQVPK; GKSAQTSELLQVPKS;
KSAQTSELLQVPKSG; ATFTSCSIFLYKVFI; TFTSCSIFLYKVFIL;
FTSCSIFLYKVFILF; TSCSIFLYKVFILFI; SCSIFLYKVFILFIL;
CSIFLYKVFILFILS; SIFLYKVFILFILSS; IFLYKVFILFILSSS;
FLYKVFILFILSSSP; LYKVFILFILSSSPP; YKVFILFILSSSPPL;
KVFILFILSSSPPLS; VFILFILSSSPPLSG; AFLIKGRFPQAALSR;
FLIKGRFPQAALSRP; LIKGRFPQAALSRPK; IKGRFPQAALSRPKR;
KGRFPQAALSRPKRS; GRFPQAALSRPKRSM; RFPQAALSRPKRSMS;
FPQAALSRPKRSMSS; PQAALSRPKRSMSSM; QAALSRPKRSMSSMD;
AALSRPKRSMSSMDS; ALSRPKRSMSSMDSS; LSRPKRSMSSMDSSL;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

SRPKRSMSSMDSSLL; RPKRSMSSMDSSLLR; PKRSMSSMDSSLLRT;
KRSMSSMDSSLLRTL; RSMSSMDSSLLRTLS 16 mers:

FCKNCKRIGISPNSFA; CKNCKRIGISPNSFAR;
KNCKRIGISPNSFARP; NCKRIGISPNSFARPQ;
CKRIGISPNSFARPQK; KRIGISPNSFARPQKK;
RIGISPNSFARPQKKP; IGISPNSFARPQKKPP;
GISPNSFARPQKKPPH; ISPNSFARPQKKPPHP;
SPNSFARPQKKPPHPY; PNSFARPQKKPPHPYY;
NSFARPQKKPPHPYYL; SFARPQKKPPHPYYLR;
FARPQKKPPHPYYLRE; ARPQKKPPHPYYLRER;
RPQKKPPHPYYLRERV; PQKKPPHPYYLRERVE;
QKKPPHPYYLRERVEA; KKPPHPYYLRERVEAE;
KPPHPYYLRERVEAEA; PPHPYYLRERVEAEAA;
PHPYYLRERVEAEAAS; HPYYLRERVEAEAASA;
PYYLRERVEAEAASAS; YYLRERVEAEAASASY;
YLRERVEAEAASASYI; LRERVEAEAASASYIL;
KKRPQGGAAYPWNAAK; KRPQGGAAYPWNAAKP;
PQEGKCMTHRGMQPNH; QEGKCMTHRGMQPNHD;
EGKCMTHRGMQPNHDL; GKCMTHRGMQPNHDLR;
KCMTHRGMQPNHDLRK; CMTHRGMQPNHDLRKE;
MTHRGMQPNHDLRKES; THRGMQPNHDLRKESA;
LTGRSCLPMECSQTMT; TGRSCLPMECSQTMTS;
GRSCLPMECSQTMTSG; RSCLPMECSQTMTSGR;
SCLPMECSQTMTSGRK; CLPMECSQTMTSGRKV;
LPMECSQTMTSGRKVH; PMECSQTMTSGRKVHD;
MECSQTMTSGRKVHDR; ECSQTMTSGRKVHDRH;
CSQTMTSGRKVHDRHV; SQTMTSGRKVHDRHVL;
QTMTSGRKVHDRHVLR; TMTSGRKVHDRHVLRA;
ESWPCPQLNWTKAMVL; SWPCPQLNWTKAMVLR;
WPCPQLNWTKAMVLRQ; PCPQLNWTKAMVLRQL;
CPQLNWTKAMVLRQLS; PQLNWTKAMVLRQLSR;
QLNWTKAMVLRQLSRQ; LNWTKAMVLRQLSRQA;
NWTKAMVLRQLSRQAS; WTKAMVLRQLSRQASV;
TKAMVLRQLSRQASVK; KAMVLRQLSRQASVKV;
AMVLRQLSRQASVKVG; MVLRQLSRQASVKVGK;
VLRQLSRQASVKVGKT; LRQLSRQASVKVGKTW;
RQLSRQASVKVGKTWT; QLSRQASVKVGKTWTG;
LSRQASVKVGKTWTGT; SRQASVKVGKTWTGTK;
RQASVKVGKTWTGTKK; QASVKVGKTWTGTKKR;
ASVKVGKTWTGTKKRA; SVKVGKTWTGTKKRAQ;
VKVGKTWTGTKKRAQR; KVGKTWTGTKKRAQRI;
VGKTWTGTKKRAQRIF; GKTWTGTKKRAQRIFI;
KTWTGTKKRAQRIFIF; TWTGTKKRAQRIFIFI;
WTGTKKRAQRIFIFIL; TGTKKRAQRIFIFILE;
GTKKRAQRIFIFILEL; TKKRAQRIFIFILELL;
KKRAQRIFIFILELLL; KRAQRIFIFILELLLE;
RAQRIFIFILELLLEF; AQRIFIFILELLLEFC;
QRIFIFILELLLEFCR; RIFIFILELLLEFCRG;
IFIFILELLLEFCRGE; FIFILELLLEFCRGED;
IFILELLLEFCRGEDS; FILELLLEFCRGEDSV;
ILELLLEFCRGEDSVD; LELLLEFCRGEDSVDG;
ELLLEFCRGEDSVDGK; LLLEFCRGEDSVDGKN;
LLEFCRGEDSVDGKNK; LEFCRGEDSVDGKNKS;
EFCRGEDSVDGKNKST; FCRGEDSVDGKNKSTT;
CRGEDSVDGKNKSTTA; RGEDSVDGKNKSTTAL;
GEDSVDGKNKSTTALP; EDSVDGKNKSTTALPA;
DSVDGKNKSTTALPAV; SVDGKNKSTTALPAVK;
VDGKNKSTTALPAVKD; DGKNKSTTALPAVKDS;
GKNKSTTALPAVKDSV; KNKSTTALPAVKDSVK;
NKSTTALPAVKDSVKD; KSTTALPAVKDSVKDS;
VSNPFFFVFPGSWVLL; LPVYLRLLLPQDFQWL;
PVYLRLLLPQDFQWLK; VYLRLLLPQDFQWLKL;
YLRLLLPQDFQWLKLL; LRLLLPQDFQWLKLLL;
RLLLPQDFQWLKLLLG; LLLPQDFQWLKLLLGR;
LLPQDFQWLKLLLGRL; LPQDFQWLKLLLGRLL;
PQDFQWLKLLLGRLLL; QDFQWLKLLLGRLLLL;
ASISNQAWLWNCLTQM; SISNQAWLWNCLTQMS;
ISNQAWLWNCLTQMST; SNQAWLWNCLTQMSTM;
NQAWLWNCLTQMSTMI; QAWLWNCLTQMSTMIF;
AWLWNCLTQMSTMIFC; WLWNCLTQMSTMIFCF;
LWNCLTQMSTMIFCFL; WNCLTQMSTMIFCFLV;
ILLLIIFNTLILGIGV; LLLIIFNTLILGIGVL;
LLIIFNTLILGIGVLL; LIIFNTLILGIGVLLC;
IIFNTLILGIGVLLCL; IFNTLILGIGVLLCLL;
FNTLILGIGVLLCLLL; NTLILGIGVLLCLLLF;
TLILGIGVLLCLLLFP; LILGIGVLLCLLLFPR;
ILGIGVLLCLLLFPRL; LGIGVLLCLLLFPRLC;
GIGVLLCLLLFPRLCG; IGVLLCLLLFPRLCGM;
GVLLCLLLFPRLCGML; VLLCLLLFPRLCGMLL;
LLCLLLFPRLCGMLLG; LCLLLFPRLCGMLLGM;
CLLLFPRLCGMLLGMI; LLLFPRLCGMLLGMIY;
LLFPRLCGMLLGMIYL; LFPRLCGMLLGMIYLL;
PHRNCREEQKDFLETP; HRNCREEQKDFLETPW;
RNCREEQKDFLETPWL; NCREEQKDFLETPWLD;
CREEQKDFLETPWLDF; REEQKDFLETPWLDFW;
EEQKDFLETPWLDFWR; EQKDFLETPWLDFWRK;
QKDFLETPWLDFWRKL; KDFLETPWLDFWRKLP;
DFLETPWLDFWRKLPG; FLETPWLDFWRKLPGQ;
LETPWLDFWRKLPGQL; TFIIIFNNIILIFPLL;
FIIIFNNIILIFPLLG; IIIFNNIILIFPLLGP;
IIFNNIILIFPLLGPQ; IFNNIILIFPLLGPQW;
FNNIILIFPLLGPQWL; NNIILIFPLLGPQWLD;
NIILIFPLLGPQWLDK; KKLLPQEVLIKELLLN;
KLLPQEVLIKELLLNG; LLPQEVLIKELLLNGC;
LPQEVLIKELLLNGCC; PQEVLIKELLLNGCCL;
QEVLIKELLLNGCCLY; EVLIKELLLNGCCLYF;
HLLLKHMKMAPTKRKG; LLLKHMKMAPTKRKGE;
LLKHMKMAPTKRKGEC; LKHMKMAPTKRKGECP;
KHMKMAPTKRKGECPG; HMKMAPTKRKGECPGA;
MKMAPTKRKGECPGAA; KMAPTKRKGECPGAAP;
MAPTKRKGECPGAAPK; APTKRKGECPGAAPKK;
PTKRKGECPGAAPKKP; TKRKGECPGAAPKKPK;
KRKGECPGAAPKKPKE; RKGECPGAAPKKPKEP;
KGECPGAAPKKPKEPV; GECPGAAPKKPKEPVQ;
ECPGAAPKKPKEPVQV; CPGAAPKKPKEPVQVP;
PGAAPKKPKEPVQVPK; GAAPKKPKEPVQVPKL;
AAPKKPKEPVQVPKLL; APKKPKEPVQVPKLLI;
PKKPKEPVQVPKLLIK; KKPKEPVQVPKLLIKG;
KPKEPVQVPKLLIKGG; PKEPVQVPKLLIKGGV;
KEPVQVPKLLIKGGVE; EPVQVPKLLIKGGVEV;
PVQVPKLLIKGGVEVL; VQVPKLLIKGGVEVLE;
QVPKLLIKGGVEVLEV; VPKLLIKGGVEVLEVK;
PKLLIKGGVEVLEVKT; KLLIKGGVEVLEVKTG;
LLIKGGVEVLEVKTGV; LIKGGVEVLEVKTGVD;
IKGGVEVLEVKTGVDA; KGGVEVLEVKTGVDAI;
GGVEVLEVKTGVDAIT; GVEVLEVKTGVDAITE;
VEVLEVKTGVDAITEV; EVLEVKTGVDAITEVE;
VLEVKTGVDAITEVEC; LEVKTGVDAITEVECF;
EVKTGVDAITEVECFL; VKTGVDAITEVECFLN;
KTGVDAITEVECFLNP; TGVDAITEVECFLNPE;
GVDAITEVECFLNPEM; VDAITEVECFLNPEMG;
DAITEVECFLNPEMGD; AITEVECFLNPEMGDP;
ITEVECFLNPEMGDPD; TEVECFLNPEMGDPDE;
EVECFLNPEMGDPDEN; VECFLNPEMGDPDENL;
ECFLNPEMGDPDENLR; CFLNPEMGDPDENLRG;
FLNPEMGDPDENLRGF; LNPEMGDPDENLRGFS;
NPEMGDPDENLRGFSL; PEMGDPDENLRGFSLK;
EMGDPDENLRGFSLKL; MGDPDENLRGFSLKLS;
GDPDENLRGFSLKLSA; DPDENLRGFSLKLSAE;
PDENLRGFSLKLSAEN; DENLRGFSLKLSAEND;
ENLRGFSLKLSAENDF; NLRGFSLKLSAENDFS;
LRGFSLKLSAENDFSS; RGFSLKLSAENDFSSD;
GFSLKLSAENDFSSDS; FSLKLSAENDFSSDSP;
SLKLSAENDFSSDSPE; LKLSAENDFSSDSPER;
KLSAENDFSSDSPERK; LSAENDFSSDSPERKM;
SAENDFSSDSPERKML; AENDFSSDSPERKMLP;
ENDFSSDSPERKMLPC; NDFSSDSPERKMLPCY;
DFSSDSPERKMLPCYS; FSSDSPERKMLPCYST;
SSDSPERKMLPCYSTA; SDSPERKMLPCYSTAR;
DSPERKMLPCYSTARI; SPERKMLPCYSTARIP;
PERKMLPCYSTARIPL; ERKMLPCYSTARIPLP;
RKMLPCYSTARIPLPN; KMLPCYSTARIPLPNL;
MLPCYSTARIPLPNLN; LPCYSTARIPLPNLNE;
PCYSTARIPLPNLNED; CYSTARIPLPNLNEDL;
YSTARIPLPNLNEDLT; STARIPLPNLNEDLTC;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

TARIPLPNLNEDLTCG; ARIPLPNLNEDLTCGN;
RIPLPNLNEDLTCGNL; IPLPNLNEDLTCGNLL;
PLPNLNEDLTCGNLLM; LPNLNEDLTCGNLLMW;
PNLNEDLTCGNLLMWE; NLNEDLTCGNLLMWEA;
LNEDLTCGNLLMWEAV; NEDLTCGNLLMWEAVT;
EDLTCGNLLMWEAVTV; DLTCGNLLMWEAVTVQ;
LTCGNLLMWEAVTVQT; TCGNLLMWEAVTVQTE;
CGNLLMWEAVTVQTEV; GNLLMWEAVTVQTEVI;
NLLMWEAVTVQTEVIG; LLMWEAVTVQTEVIGI;
LMWEAVTVQTEVIGIT; MWEAVTVQTEVIGITS;
WEAVTVQTEVIGITSM; EAVTVQTEVIGITSML;
AVTVQTEVIGITSMLN; VTVQTEVIGITSMLNL;
TVQTEVIGITSMLNLH; VQTEVIGITSMLNLHA;
QTEVIGITSMLNLHAG; TEVIGITSMLNLHAGS;
EVIGITSMLNLHAGSQ; VIGITSMLNLHAGSQK;
IGITSMLNLHAGSQKV; GITSMLNLHAGSQKVH;
ITSMLNLHAGSQKVHE; TSMLNLHAGSQKVHEH;
SMLNLHAGSQKVHEHG; MLNLHAGSQKVHEHGG;
LNLHAGSQKVHEHGGG; NLHAGSQKVHEHGGGK;
LHAGSQKVHEHGGGKP; HAGSQKVHEHGGGKPI;
AGSQKVHEHGGGKPIQ; GSQKVHEHGGGKPIQG;
SQKVHEHGGGKPIQGS; QKVHEHGGGKPIQGSN;
KVHEHGGGKPIQGSNF; VHEHGGGKPIQGSNFH;
HEHGGGKPIQGSNFHF; EHGGGKPIQGSNFHFF;
HGGGKPIQGSNFHFFA; GGGKPIQGSNFHFFAV;
GGKPIQGSNFHFFAVG; GKPIQGSNFHFFAVGG;
KPIQGSNFHFFAVGGE; PIQGSNFHFFAVGGEP;
IQGSNFHFFAVGGEPL; QGSNFHFFAVGGEPLE;
GSNFHFFAVGGEPLEM; SNFHFFAVGGEPLEMQ;
NFHFFAVGGEPLEMQG; FHFFAVGGEPLEMQGV;
HFFAVGGEPLEMQGVL; FFAVGGEPLEMQGVLM;
FAVGGEPLEMQGVLMN; AVGGEPLEMQGVLMNY;
VGGEPLEMQGVLMNYR; GGEPLEMQGVLMNYRS;
GEPLEMQGVLMNYRSK; EPLEMQGVLMNYRSKY;
PLEMQGVLMNYRSKYP; LEMQGVLMNYRSKYPD;
EMQGVLMNYRSKYPDG; MQGVLMNYRSKYPDGT;
QGVLMNYRSKYPDGTI; GVLMNYRSKYPDGTIT;
VLMNYRSKYPDGTITP; LMNYRSKYPDGTITPK;
MNYRSKYPDGTITPKN; NYRSKYPDGTITPKNP;
YRSKYPDGTITPKNPT; RSKYPDGTITPKNPTA;
SKYPDGTITPKNPTAQ; KYPDGTITPKNPTAQS;
YPDGTITPKNPTAQSQ; PDGTITPKNPTAQSQV;
DGTITPKNPTAQSQVM; GTITPKNPTAQSQVMN;
TITPKNPTAQSQVMNT; ITPKNPTAQSQVMNTD;
TPKNPTAQSQVMNTDH; PKNPTAQSQVMNTDHK;
KNPTAQSQVMNTDHKA; NPTAQSQVMNTDHKAY;
PTAQSQVMNTDHKAYL; TAQSQVMNTDHKAYLD;
AQSQVMNTDHKAYLDK; QSQVMNTDHKAYLDKN;
SQVMNTDHKAYLDKNN; QVMNTDHKAYLDKNNA;
VMNTDHKAYLDKNNAY; MNTDHKAYLDKNNAYP;
NTDHKAYLDKNNAYPV; TDHKAYLDKNNAYPVE;
DHKAYLDKNNAYPVEC; HKAYLDKNNAYPVECW;
KAYLDKNNAYPVECWV; AYLDKNNAYPVECWVP;
YLDKNNAYPVECWVPD; LDKNNAYPVECWVPDP;
DKNNAYPVECWVPDPS; KNNAYPVECWVPDPSR;
NNAYPVECWVPDPSRN; NAYPVECWVPDPSRNE;
AYPVECWVPDPSRNEN; YPVECWVPDPSRNENA;
PVECWVPDPSRNENAR; VECWVPDPSRNENARY;
ECWVPDPSRNENARYF; CWVPDPSRNENARYFG;
WVPDPSRNENARYFGT; VPDPSRNENARYFGTF;
PDPSRNENARYFGTFT; DPSRNENARYFGTFTG;
PSRNENARYFGTFTGG; SRNENARYFGTFTGGE;
RNENARYFGTFTGGEN; NENARYFGTFTGGENV;
ENARYFGTFTGGENVP; NARYFGTFTGGENVPP;
ARYFGTFTGGENVPPV; RYFGTFTGGENVPPVL;
YFGTFTGGENVPPVLH; FGTFTGGENVPPVLHV;
GTFTGGENVPPVLHVT; TFTGGENVPPVLHVTN;
FTGGENVPPVLHVTNT; TGGENVPPVLHVTNTA;
GGENVPPVLHVTNTAT; GENVPPVLHVTNTATT;
ENVPPVLHVTNTATTV; NVPPVLHVTNTATTVL;
VPPVLHVTNTATTVLL; PPVLHVTNTATTVLLD;
PVLHVTNTATTVLLDE; VLHVTNTATTVLLDEQ;
LHVTNTATTVLLDEQG; HVTNTATTVLLDEQGV;
VTNTATTVLLDEQGVG; TNTATTVLLDEQGVGP;

NTATTVLLDEQGVGPL; TATTVLLDEQGVGPLC;
ATTVLLDEQGVGPLCK; TTVLLDEQGVGPLCKA;
TVLLDEQGVGPLCKAD; VLLDEQGVGPLCKADS;
LLDEQGVGPLCKADSL; LDEQGVGPLCKADSLY;
DEQGVGPLCKADSLYV; EQGVGPLCKADSLYVS;
QGVGPLCKADSLYVSA; GVGPLCKADSLYVSAA;
VGPLCKADSLYVSAAD; GPLCKADSLYVSAADI;
PLCKADSLYVSAADIC; LCKADSLYVSAADICG;
CKADSLYVSAADICGL; KADSLYVSAADICGLF;
ADSLYVSAADICGLFT; DSLYVSAADICGLFTN;
SLYVSAADICGLFTNS; LYVSAADICGLFTNSS;
YVSAADICGLFTNSSG; VSAADICGLFTNSSGT;
SAADICGLFTNSSGTQ; AADICGLFTNSSGTQQ;
ADICGLFTNSSGTQQW; DICGLFTNSSGTQQWR;
ICGLFTNSSGTQQWRG; CGLFTNSSGTQQWRGL;
GLFTNSSGTQQWRGLA; LFTNSSGTQQWRGLAR;
FTNSSGTQQWRGLARY; TNSSGTQQWRGLARYF;
NSSGTQQWRGLARYFK; SSGTQQWRGLARYFKI;
SGTQQWRGLARYFKIR; GTQQWRGLARYFKIRL;
TQQWRGLARYFKIRLR; QQWRGLARYFKIRLRK;
QWRGLARYFKIRLRKR; WRGLARYFKIRLRKRS;
RGLARYFKIRLRKRSV; GLARYFKIRLRKRSVK;
LARYFKIRLRKRSVKN; ARYFKIRLRKRSVKNP;
RYFKIRLRKRSVKNPY; YFKIRLRKRSVKNPYP;
FKIRLRKRSVKNPYPI; KIRLRKRSVKNPYPIS;
IRLRKRSVKNPYPISF; RLRKRSVKNPYPISFL;
LRKRSVKNPYPISFLL; RKRSVKNPYPISFLLS;
KRSVKNPYPISFLLSD; RSVKNPYPISFLLSDL;
SVKNPYPISFLLSDLI; VKNPYPISFLLSDLIN;
KNPYPISFLLSDLINR; NPYPISFLLSDLINRR;
PYPISFLLSDLINRRT; YPISFLLSDLINRRTQ;
PISFLLSDLINRRTQR; ISFLLSDLINRRTQRV;
SFLLSDLINRRTQRVD; FLLSDLINRRTQRVDG;
LLSDLINRRTQRVDGQ; LSDLINRRTQRVDGQP;
SDLINRRTQRVDGQPM; DLINRRTQRVDGQPMY;
LINRRTQRVDGQPMYG; INRRTQRVDGQPMYGM;
NRRTQRVDGQPMYGME; RRTQRVDGQPMYGMES;
RTQRVDGQPMYGMESQ; TQRVDGQPMYGMESQV;
QRVDGQPMYGMESQVE; RVDGQPMYGMESQVEE;
VDGQPMYGMESQVEEV; DGQPMYGMESQVEEVR;
GQPMYGMESQVEEVRV; QPMYGMESQVEEVRVF;
PMYGMESQVEEVRVFD; MYGMESQVEEVRVFDG;
YGMESQVEEVRVFDGT; GMESQVEEVRVFDGTE;
MESQVEEVRVFDGTER; ESQVEEVRVFDGTERL;
SQVEEVRVFDGTERLP; QVEEVRVFDGTERLPG;
VEEVRVFDGTERLPGD; EEVRVFDGTERLPGDP;
EVRVFDGTERLPGDPD; VRVFDGTERLPGDPDM;
RVFDGTERLPGDPDMI; VFDGTERLPGDPDMIR;
FDGTERLPGDPDMIRY; DGTERLPGDPDMIRYI;
GTERLPGDPDMIRYID; TERLPGDPDMIRYIDK;
ERLPGDPDMIRYIDKQ; RLPGDPDMIRYIDKQG;
LPGDPDMIRYIDKQGQ; PGDPDMIRYIDKQGQL;
GDPDMIRYIDKQGQLQ; DPDMIRYIDKQGQLQT;
PDMIRYIDKQGQLQTK; DMIRYIDKQGQLQTKM;
MIRYIDKQGQLQTKML; TGAFIVHIHLINAAFV;
ATFKLVLFWGWCFRPF; TFKLVLFWGWCFRPFK;
FKLVLFWGWCFRPFKT; KLVLFWGWCFRPFKTL;
LVLFWGWCFRPFKTLK; VLFWGWCFRPFKTLKA;
LFWGWCFRPFKTLKAF; FWGWCFRPFKTLKAFT;
WGWCFRPFKTLKAFTQ; GWCFRPFKTLKAFTQM;
WCFRPFKTLKAFTQMQ; CFRPFKTLKAFTQMQL;
FRPFKTLKAFTQMQLL; RPFKTLKAFTQMQLLT;
PFKTLKAFTQMQLLTM; PKTLKAFTQMQLLTMG;
KTLKAFTQMQLLTMGV; ILFSCNIKNTFPHAYI;
LFSCNIKNTFPHAYII; FSCNIKNTFPHAYIIF;
SCNIKNTFPHAYIIFH; CNIKNTFPHAYIIFHP;
KSIHTYLRIQPFLPFN; SIHTYLRIQPFLPFNN;
IHTYLRIQPFLPFNNS; HTYLRIQPFLPFNNSR;
TYLRIQPFLPFNNSRL; YLRIQPFLPFNNSRLY;
LRIQPFLPFNNSRLYI; RIQPFLPFNNSRLYIS;
IQPFLPFNNSRLYISC; QPFLPFNNSRLYISCK;
PFLPFNNSRLYISCKI; FLPFNNSRLYISCKIS;
LPFNNSRLYISCKISY; PFNNSRLYISCKISYR;
FNNSRLYISCKISYRP; NNSRLYISCKISYRPK;

TABLE O-continued

Predicted MHC class 2 BK virus peptide sequences. Prediction of 13-, 14-, 15-, 16-mers from all 6 reading frames of the genome (access no #V01108) obtained using the program displayed in FIG. 2.

NSRLYISCKISYRPKP; SRLYISCKISYRPKPN;
IYFGPKIYLSYKSSLQ; YFGPKIYLSYKSSLQG;
FGPKIYLSYKSSLQGF; GPKIYLSYKSSLQGFR;
PKIYLSYKSSLQGFRD; KIYLSYKSSLQGFRDR;
IYLSYKSSLQGFRDRI; YLSYKSSLQGFRDRIL;
LSYKSSLQGFRDRILI; SYKSSLQGFRDRILIH;
YKSSLQGFRDRILIHC; KSSLQGFRDRILIHCN;
SSLQGFRDRILIHCNQ; SLQGFRDRILIHCNQA;
LQGFRDRILIHCNQAW; QGFRDRILIHCNQAWW;
GFRDRILIHCNQAWWK; FRDRILIHCNQAWWKY;
RDRILIHCNQAWWKYL; DRILIHCNQAWWKYLG;
RILIHCNQAWWKYLGS; ILIHCNQAWWKYLGSF;
LIHCNQAWWKYLGSFV; FSSCPFYIFKNNHVLI;
SSCPFYIFKNNHVLIY; SCPFYIFKNNHVLIYS;
CPFYIFKNNHVLIYSY; PFYIFKNNHVLIYSYT;
PVSSFRYIENNTVQKI; VSSFRYIENNTVQKIK;
SSFRYIENNTVQKIKY; SFRYIENNTVQKIKYY;
FRYIENNTVQKIKYYR; RYIENNTVQKIKYYRI;
YIENNTVQKIKYYRIH; IENNTVQKIKYYRIHF;
ENNTVQKIKYYRIHFR; NCIYCLLTNTFLIFTF;
CIYCLLTNTFLIFTFC; IYCLLTNTFLIFTFCK;
YCLLTNTFLIFTFCKN; CLLTNTFLIFTFCKNN;
LLTNTFLIFTFCKNNS; LTNTFLIFTFCKNNSI;
TNTFLIFTFCKNNSIC; NTFLIFTFCKNNSICK;
TFLIFTFCKNNSICKV; FLIFTFCKNNSICKVL;
LIFTFCKNNSICKVLF; IFTFCKNNSICKVLFM;
FTFCKNNSICKVLFMI; TFCKNNSICKVLFMIL;
FCKNNSICKVLFMILK; CKNNSICKVLFMILKV;
KNNSICKVLFMILKVI; NNSICKVLFMILKVIR;
NSICKVLFMILKVIRL; SICKVLFMILKVIRLV;
ICKVLFMILKVIRLVF; CKVLFMILKVIRLVFF;
KVLFMILKVIRLVFFL; VLFMILKVIRLVFFLT;
LFMILKVIRLVFFLTL; FMILKVIRLVFFLTLF;
MILKVIRLVFFLTLFT; ILKVIRLVFFLTLFTL;
LKVIRLVFFLTLFTLL; KVIRLVFFLTLFTLLY;
VIRLVFFLTLFTLLYI; IRLVFFLTLFTLLYIV;
RLVFFLTLFTLLYIVL; LVFFLTLFTLLYIVLK;
VFFLTLFTLLYIVLKF; FPRHLLCFFRLFWAKI;
PRHLLCFFRLFWAKIM; RHLLCFFRLFWAKIML;
HLLCFFRLFWAKIMLL; KTKGTQLLTEIINCRN;
TKGTQLLTEIINCRNS; KGTQLLTEIINCRNSM;
GTQLLTEIINCRNSMS; TQLLTEIINCRNSMSM;
QLLTEIINCRNSMSMW; LLTEIINCRNSMSMWS;
KEYNIMPSTHVSTNKS; EYNIMPSTHVSTNKSY;
YNIMPSTHVSTNKSYR; NIMPSTHVSTNKSYRI;
IMPSTHVSTNKSYRIF; MPSTHVSTNKSYRIFF;
PSTHVSTNKSYRIFFH; STHVSTNKSYRIFFHK;
THVSTNKSYRIFFHKF; HVSTNKSYRIFFHKFF;
VSTNKSYRIFFHKFFI; STNKSYRIFFHKFFIQ;
TNKSYRIFFHKFFIQN; NKSYRIFFHKFFIQNL;
KSYRIFFHKFFIQNLS; SYRIFFHKFFIQNLSF;
YRIFFHKFFIQNLSFF; RIFFHKFFIQNLSFFF;
IFFHKFFIQNLSFFFS; FFHKFFIQNLSFFFSS;
FHKFFIQNLSFFFSSI; HKFFIQNLSFFFSSIH;
KFFIQNLSFFFSSIHS; FFIQNLSFFFSSIHSK;
FIQNLSFFFSSIHSKA; IQNLSFFFSSIHSKAG;
QNLSFFFSSIHSKAGK; NLSFFFSSIHSKAGKG;
LSFFFSSIHSKAGKGS; SFFFSSIHSKAGKGSI;
FFFSSIHSKAGKGSIT; FFSSIHSKAGKGSITK;
FSSIHSKAGKGSITKY; SSIHSKAGKGSITKYS;
SIHSKAGKGSITKYSL; IHSKAGKGSITKYSLT;
HSKAGKGSITKYSLTK; SKAGKGSITKYSLTKK;
KAGKGSITKYSLTKKL; AGKGSITKYSLTKKLV;
IRGKVFRVFYLSFFFG; RGKVFRVFYLSFFFGW;
GKVFRVFYLSFFFGWC; VLRICCCFFITGKHIF;
LRICCCFFITGKHIFM; RICCCFFITGKHIFMA;
ICCCFFITGKHIFMAK; IFIPFFIKGTPPGLPL;
FIPFFIKGTPPGLPLF; IPFFIKGTPPGLPLFC;
PPFFIKGTPPGLPLFCS; FFIKGTPPGLPLFCSI;
FIKGTPPGLPLFCSIG; IKGTPPGLPLFCSIGW;
KGTPPGLPLFCSIGWH; GTPPGLPLFCSIGWHL;
SFRSLKGVSPIIWTHH; FRSLKGVSPIIWTHHC;
RSLKGVSPIIWTHHCR; SLKGVSPIIWTHHCRV;
LKGVSPIIWTHHCRVS; KGVSPIIWTHHCRVSS;
GVSPIIWTHHCRVSSV; VSPIIWTHHCRVSSVR;
SPIIWTHHCRVSSVRS; PIIWTHHCRVSSVRSK;
IIWTHHCRVSSVRSKP; IWTHHCRVSSVRSKPN;
WTHHCRVSSVRSKPNH; THHCRVSSVRSKPNHC;
HHCRVSSVRSKPNHCV; HCRVSSVRSKPNHCVK;
CRVSSVRSKPNHCVKQ; RVSSVRSKPNHCVKQS;
VSSVRSKPNHCVKQSM; SSVRSKPNHCVKQSMQ;
QSIQTKGSFLKNFLFK; SIQTKGSFLKNFLFKC;
IQTKGSFLKNFLFKCL; QTKGSFLKNFLFKCLN;
TKGSFLKNFLFKCLNL; KGSFLKNFLFKCLNLS;
HSMQGQCTEGFLEQIG; SMQGQCTEGFLEQIGH;
MQGQCTEGFLEQIGHS; QGQCTEGFLEQIGHSL;
GQCTEGFLEQIGHSLQ; QCTEGFLEQIGHSLQY;
CTEGFLEQIGHSLQYR; TEGFLEQIGHSLQYRV;
EGFLEQIGHSLQYRVS; GFLEQIGHSLQYRVSG;
FLEQIGHSLQYRVSGQ; LEQIGHSLQYRVSGQR;
EQIGHSLQYRVSGQRG; QIGHSLQYRVSGQRGK;
IGHSLQYRVSGQRGKS; GHSLQYRVSGQRGKSA;
HSLQYRVSGQRGKSAQ; SLQYRVSGQRGKSAQT;
LQYRVSGQRGKSAQTS; QYRVSGQRGKSAQTSE;
YRVSGQRGKSAQTSEL; RVSGQRGKSAQTSELL;
VSGQRGKSAQTSELLQ; SGQRGKSAQTSELLQV;
GQRGKSAQTSELLQVP; QRGKSAQTSELLQVPK;
RGKSAQTSELLQVPKS; GKSAQTSELLQVPKSG;
ATFTSCSIFLYKVFIL; TFTSCSIFLYKVFILF;
FTSCSIFLYKVFILFI; TSCSIFLYKVFILFIL;
SCSIFLYKVFILFILS; CSIFLYKVFILFILSS;
SIFLYKVFILFILSSS; IFLYKVFILFILSSSP;
FLYKVFILFILSSSPP; LYKVFILFILSSSPPL;
YKVFILFILSSSPPLS; KVFILFILSSSPPLSG;
AFLIKGRFPQAALSRP; FLIKGRFPQAALSRPK;
LIKGRFPQAALSRPKR; IKGRFPQAALSRPKRS;
KGRFPQAALSRPKRSM; GRFPQAALSRPKRSMS;
RFPQAALSRPKRSMSS; FPQAALSRPKRSMSSM;
PQAALSRPKRSMSSMD; QAALSRPKRSMSSMDS;
AALSRPKRSMSSMDSS; ALSRPKRSMSSMDSSL;
LSRPKRSMSSMDSSLL; SRPKRSMSSMDSSLLR;
RPKRSMSSMDSSLLRT; PKRSMSSMDSSLLRTL;
KRSMSSMDSSLLRTLS

---

BK virus, reading frame 2

13 mers:

GFPQIVLLGLRKS; FPQIVLLGLRKSL; PQIVLLGLRKSLH;
QIVLLGLRKSLHT; IVLLGLRKSLHTL; VLLGLRKSLHTLT;
LLGLRKSLHTLTT; LGLRKSLHTLTTT; EKGWRQRRPRPLI; KGWRQRRPRPLIY;
GWRQRRPRPLIYY; WRQRRPRPLIYYK; RQRRPRPLIYYKK;
QRRPRPLIYYKKK; RRPRPLIYYKKKG; RPRPLIYYKKKGH;
PRPLIYYKKKGHR; RPLIYYKKKGHRE; PLIYYKKKGHREE;
LIYYKKKGHREEL; IYYKKKGHREELL; YYKKKGHREELLT;
YKKKGHREELLTH; KKKGHREELLTHG; KKGHREELLTHGM;
KGHREELLTHGMQ; GHREELLTHGMQP; HREELLTHGMQPN;
REELLTHGMQPNH; EELLTHGMQPNHD; ELLTHGMQPNHDL;
LLTHGMQPNHDLR; LTHGMQPNHDLRK; THGMQPNHDLRKE;
HGMQPNHDLRKES; GMQPNHDLRKESA; LTGECSQTMTSGR;
TGECSQTMTSGRK; GECSQTMTSGRKV; ECSQTMTSGRKVH;
CSQTMTSGRKVHD; SQTMTSGRKVHDS; QTMTSGRKVHDSQ;
TMTSGRKVHDSQG; MTSGRKVHDSQGG; TSGRKVHDSQGGA;
SGRKVHDSQGGAA; GRKVHDSQGGAAY; RKVHDSQGGAAYP;
KVHDSQGGAAYPW; VHDSQGGAAYPWN; HDSQGGAAYPWNA;
DSQGGAAYPWNAA; SQGGAAYPWNAAK; QGGAAYPWNAAKP;
PQEGKCMTDMFCE; QEGKCMTDMFCEP; EGKCMTDMFCEPR;
GKCMTDMFCEPRN; KCMTDMFCEPRNL; CMTDMFCEPRNLG;
MTDMFCEPRNLGL; TDMFCEPRNLGLV; DMFCEPRNLGLVP;
MFCEPRNLGLVPS; TGQRPWFCASCHD; GQRPWFCASCHDK;
QRPWFCASCHDKL; RPWFCASCHDKLQ; KLVKPGLEQKKEL;
LVKPGLEQKKELR; VKPGLEQKKELRG; KPGLEQKKELRGF;
PGLEQKKELRGFL; GLEQKKELRGFLF; LEQKKELRGFLFL;
EQKKELRGFLFLF; VIPFFLYFQVHGC; IPFFLYFQVHGCC;
PFFLYFQVHGCCS; FFLYFQVHGCCSS; FLYFQVHGCCSST;
LYFQVHGCCSSTF; YFQVHGCCSSTFG; FQVHGCCSSTFGG;
QVHGCCSSTFGGP; VHGCCSSTFGGPS; HGCCSSTFGGPSC;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GCCSSTFGGPSCQ; CCSSTFGGPSCQC; CSSTFGGPSCQCI;
NCCWGGCCCYRSS; CCWGGCCCYRSSN; CWGGCCCYRSSNC;
WGGCCCYRSSNCI; GGCCCYRSSNCIP; GCCCYRSSNCIPC;
CCCYRSSNCIPCY; CCYRSSNCIPCYC; CYRSSNCIPCYCR;
YRSSNCIPCYCRG; RSSNCIPCYCRGH; SSNCIPCYCRGHN;
SNCIPCYCRGHNK; NCIPCYCRGHNKY; CIPCYCRGHNKYL;
IPCYCRGHNKYLR; PCYCRGHNKYLRG; CYCRGHNKYLRGY;
YCRGHNKYLRGYS; CRGHNKYLRGYSC; RGHNKYLRGYSCY;
GHNKYLRGYSCYR; HNKYLRGYSCYRP; NKYLRGYSCYRPN;
KYLRGYSCYRPNS; YLRGYSCYRPNSS; LRGYSCYRPNSSN;
RGYSCYRPNSSNI; GYSCYRPNSSNIC; YSCYRPNSSNICC;
SCYRPNSSNICCN; CYRPNSSNICCNC; YRPNSSNICCNCW;
RPNSSNICCNCWC; PNSSNICCNCWCS; NSSNICCNCWCSW;
SSNICCNCWCSWG; SNICCNCWCSWGY; NICCNCWCSWGYC;
ICCNCWCSWGYCW; CCNCWCSWGYCWV; CNCWCSWGYCWVC;
NCWCSWGYCWVCC; CWCSWGYCWVCCF; WCSWGYCWVCCFN;
CSWGYCWVCCFNS; SWGYCWVCCFNSN; WGYCWVCCFNSNC;
LGSQSFHCRPLSA; GSQSFHCRPLSAI; SQSFHCRPLSAIR;
QSFHCRPLSAIRH; SFHCRPLSAIRHG; PHCRPLSAIRHGF;
HCRPLSAIRHGFG; CRPLSAIRHGFGI; RPLSAIRHGFGIV;
ALGSFFVCYYFPG; LGSFFVCYYFPGF; GSFFVCYYFPGFV;
SFFVCYYFPGFVA; FFVCYYFPGFVAC; FVCYYFPGFVACY;
YTFYNLTGIAEKN; TFYNLTGIAEKNR; FYNLTGIAEKNRK;
YNLTGIAEKNRKI; NLTGIAEKNRKIF; IFGGNYLDNCKCP;
FGGNYLDNCKCPY; GGNYLDNCKCPYK; GNYLDNCKCPYKL;
NYLDNCKCPYKLL; QYRRSYTKNGLKK; YRRSYTKNGLKKS;
RRSYTKNGLKKST; RSYTKNGLKKSTK; SYTKNGLKKSTKC;
YTKNGLKKSTKCT; TKNGLKKSTKCTF; KNGLKKSTKCTFR;
NGLKKSTKCTFRR; GLKKSTKCTFRRV; LKKSTKCTFRRVY;
KKSTKCTFRRVYR; KSTKCTFRRVYRK; STKCTFRRVYRKN;
TKCTFRRVYRKNY; KCTFRRVYRKNYC; CTFRRVYRKNYCP;
TFRRVYRKNYCPR; FRRVYRKNYCPRR; RRVYRKNYCPRRC;
SKNCSSMDVAFTS; KNCSSMDVAFTSR; NCSSMDVAFTSRP;
CSSMDVAFTSRPV; SSMDVAFTSRPVR; SMDVAFTSRPVRD;
MDVAFTSRPVRDC; DVAFTSRPVRDCN; VAFTSRPVRDCNT;
AFTSRPVRDCNTC; FTSRPVRDCNTCS; RWPQPKEKESVQG;
WPQPKEKESVQGQ; PQPKEKESVQGQL; QPKEKESVQGQLP;
PKEKESVQGQLPK; KEKESVQGQLPKS; EKESVQGQLPKSQ;
KESVQGQLPKSQR; ESVQGQLPKSQRN; SVQGQLPKSQRNP;
VQGQLPKSQRNPC; QGQLPKSQRNPCK; GQLPKSQRNPCKC;
QLPKSQRNPCKCQ; LPKSQRNPCKCQN; PKSQRNPCKCQNY;
TQKWGIQMKTLGA; QKWGIQMKTLGAL; KWGIQMKTLGALV;
VLKMTLAVIAQRE; LKMTLAVIAQREK; KMTLAVIAQREKC;
MTLAVIAQREKCF; TLAVIAQREKCFP; LAVIAQREKCFPV;
AVIAQREKCFPVT; VIAQREKCFPVTA; IAQREKCFPVTAQ;
AQREKCFPVTAQQ; QREKCFPVTAQQE; REKCFPVTAQQEF;
EKCFPVTAQQEFP; KCFPVTAQQEFPS; CFPVTAQQEFPSP;
FPVTAQQEFPSPI; LACLTFMQGHKKC; ACLTFMQGHKKCM;
CLTFMQGHKKCMS; LTFMQGHKKCMSM; TFMQGHKKCMSMV;
FMQGHKKCMSMVE; MQGHKKCMSMVEE; QGHKKCMSMVEEN;
GHKKCMSMVEENL; HKKCMSMVEENLF; KKCMSMVEENLFK;
KCMSMVEENLFKA; CMSMVEENLFKAV; MSMVEENLFKAVI;
SMVEENLFKAVIS; MVEENLFKAVIST; VEENLFKAVISTS;
EENLFKAVISTSL; ENLFKAVISTSLL; ILTIRPIWTKTML;
LTIRPIWTKTMLI; TIRPIWTKTMLIQ; IRPIWTKTMLIQL;
RPIWTKTMLIQLS; PIWTKTMLIQLSA; IWTKTMLIQLSAG;
WTKTMLIQLSAGY; TKTMLIQLSAGYL; KTMLIQLSAGYLI;
TMLIQLSAGYLIP; MLIQLSAGYLIPV; LIQLSAGYLIPVE;
IQLSAGYLIPVEM; QLSAGYLIPVEMK; LSAGYLIPVEMKM;
SAGYLIPVEMKML; AGYLIPVEMKMLG; GYLIPVEMKMLGI;
YLIPVEMKMLGIL; LIPVEMKMLGILG; IPVEMKMLGILGL;
PVEMKMLGILGLS; VEMKMLGILGLSQ; EMKMLGILGLSQE;
MKMLGILGLSQEG; KMLGILGLSQEGK; MLGILGLSQEGKM;
LGILGLSQEGKMF; GILGLSQEGKMFP; ILGLSQEGKMFPQ;
LGLSQEGKMFPQY; GLSQEGKMFPQYF; LSQEGKMFPQYFS;
MNRVWGLFVKLIA; NRVWGLFVKLIAC; RVWGLFVKLIACM;
VWGLFVKLIACMF; WGLFVKLIACMFQ; GLFVKLIACMFQL;
LFVKLIACMFQLL; FVKLIACMFQLLI; VKLIACMFQLLIF;
KLIACMFQLLIFV; LIACMFQLLIFVA; IACMFQLLIFVAC;
ACMFQLLIFVACL; CMFQLLIFVACLL; MFQLLIFVACLLT;
FQLLIFVACLLTA; QLLIFVACLLTAL; LLIFVACLLTALE;
LIFVACLLTALEH; IFVACLLTALEHN; FVACLLTALEHNS;
VACLLTALEHNSG; ACLLTALEHNSGE; CLLTALEHNSGEA;
LLTALEHNSGEAL; LTALEHNSGEALQ; TALEHNSGEALQD;
ALEHNSGEALQDI; LEHNSGEALQDIL; EHNSGEALQDILR;
HNSGEALQDILRS; NSGEALQDILRSA; TGEPREWMGSLCM;
GEPREWMGSLCMV; EPREWMGSLCMVW; PREWMGSLCMVWN;
REWMGSLCMVWNP; EWMGSLCMVWNPR; KRLGCLMAQKDFQ;
RLGCLMAQKDFQG; LGCLMAQKDFQGT; GCLMAQKDFQGTQ;
CLMAQKDFQGTQI; DILTNRDNCKPKC; ILTNRDNCKPKCF;
LTNRDNCKPKCFK; TNRDNCKPKCFKQ; NRDNCKPKCFKQV;
RDNCKPKCFKQVL; DNCKPKCFKQVLL; NCKPKCFKQVLLL;
CKPKCFKQVLLLY; KPKCFKQVLLLYI; PKCFKQVLLLYIY;
KCFKQVLLLYIYI; MLLLYKPLLSLCY; LLLYKPLLSLCYF;
LLYKPLLSLCYFG; LYKPLLSLCYFGG; YKPLLSLCYFGGG;
KPLLSLCYFGGGV; PLLSLCYFGGGVL; LLSLCYFGGGVLG;
LSLCYFGGGVLGL; SLCYFGGGVLGLL; LCYFGGGVLGLLK;
CYFGGGVLGLLKH; LWGSDLWESSAGA; WGSDLWESSAGAE;
GSDLWESSAGAEV; SDLWESSAGAEVS; DLWESSAGAEVSE;
LWESSAGAEVSET; WESSAGAEVSETW; ESSAGAEVSETWE;
SSAGAEVSETWEE; SAGAEVSETWEEH; AGAEVSETWEEHC;
GAEVSETWEEHCD; AEVSETWEEHCDW; EVSETWEEHCDWD;
VSETWEEHCDWDS; SETWEEHCDWDSV; ETWEEHCDWDSVL;
TWEEHCDWDSVLD; WEEHCDWDSVLDP; EEHCDWDSVLDPC;
EHCDWDSVLDPCP; HCDWDSVLDPCPE; CDWDSVLDPCPES;
DWDSVLDPCPESS; WDSVLDPCPESSV; DSVLDPCPESSVS;
SVLDPCPESSVSE; VLDPCPESSVSES; LDPCPESSVSESS;
DPCPESSVSESSS; PCPESSVSESSSL; CPESSVSESSSLV;
PESSVSESSSLVI; ESSVSESSSLVIS; SSVSESSSLVISR;
SVSESSSLVISRI; VSESSSLVISRIH; SESSSLVISRIHF;
ESSSLVISRIHFP; SSSLVISRIHFPM; SSLVISRIHFPMH;
SLVISRIHFPMHI; LVISRIHFPMHIL; VISRIHFPMHILY;
ISRIHFPMHILYF; SRIHFPMHILYFI; RIHFPMHILYFIL;
IHFPMHILYFILE; HFPMHILYFILEK; FPMHILYFILEKV;
PMHILYFILEKVY; MHILYFILEKVYI; HILYFILEKVYIL;
ILYFILEKVYILI; LYFILEKVYILIS; YFILEKVYILISE;
FILEKVYILISES; ILEKVYILISESS; LEKVYILISESSL;
EKVYILISESSLS; KVYILISESSLSF; VYILISESSLSFH;
YILISESSLSFHS; ILISESSLSFHST; LISESSLSFHSTI;
ISESSLSFHSTIL; SESSLSFHSTILD; ESSLSFHSTILDC;
SSLSFHSTILDCI; SLSFHSTILDCIS; LSFHSTILDCISV;
SFHSTILDCISVA; FHSTILDCISVAK; HSTILDCISVAKS;
STILDCISVAKSA; TILDCISVAKSAT; ILDCISVAKSATG;
LDCISVAKSATGL; DCISVAKSATGLN; CISVAKSATGLNQ;
ISVAKSATGLNQI; SVAKSATGLNQIS; VAKSATGLNQISS;
AKSATGLNQISSS; KSATGLNQISSSN; SATGLNQISSSNK;
ATGLNQISSSNKV; TGLNQISSSNKVI; GLNQISSSNKVIP;
LNQISSSNKVIPL; NQISSSNKVIPLC; QISSSNKVIPLCK;
ISSSNKVIPLCKI; SSSNKVIPLCKIL; SSNKVIPLCKILF;
SNKVIPLCKILFS; NKVIPLCKILFSS; KVIPLCKILFSSK;
VIPLCKILFSSKN; IPLCKILFSSKNS; PLCKILFSSKNSE;
LCKILFSSKNSEF; CKILFSSKNSEFC; KILFSSKNSEFCK;
ILFSSKNSEFCKD; LFSSKNSEFCKDF; FSSKNSEFCKDFL;
SSKNSEFCKDFLK; SKNSEFCKDFLKY; KNSEFCKDFLKYI;
NSEFCKDFLKYIL; SEFCKDFLKYILG; EFCKDFLKYILGL;
FCKDFLKYILGLK; CKDFLKYILGLKS; KDFLKYILGLKSI;
DFLKYILGLKSIC; FLKYILGLKSICL; LKYILGLKSICLT;
KYILGLKSICLTN; YILGLKSICLTNL; ILGLKSICLTNLA;
LGLKSICLTNLAC; GLKSICLTNLACR; LKSICLTNLACRV;
KSICLTNLACRVL; SICLTNLACRVLG; ICLTNLACRVLGT;
CLTNLACRVLGTY; LTNLACRVLGTYG; TNLACRVLGTYGS;
NLACRVLGTYGSF; LACRVLGTYGSFI; ACRVLGTYGSFIV;
CRVLGTYGSFIVT; RVLGTYGSFIVTK; VLGTYGSFIVTKP;
LGTGYSFIVTKPG; GTGYSFIVTKPGG; TGYSFIVTKPGGN;
GYSFIVTKPGGNI; YSFIVTKPGGNIW; SFIVTKPGGNIWV;
FIVTKPGGNIWVL; IVTKPGGNIWVLL; VTKPGGNIWVLLF;
TKPGGNIWVLLFK; KPGGNIWVLLFKC; PGGNIWVLLFKCF;
GGNIWVLLFKCFF; GNIWVLLFKCFFS; NIWVLLFKCFFSK;
IWVLLFKCFFSKF; WVLLFKCFFSKFT; VLLFKCFFSKFTL;
LLFKCFFSKFTLT; LFKCFFSKFTLTL; FKCFFSKFTLTLP;
KCFFSKFTLTLPS; CFFSKFTLTLPSK; SLKLSKLFIPCPE;
LKLSKLFIPCPEG; KLSKLFIPCPEGK; LSKLFIPCPEGKS;
SKLFIPCPEGKSF; KLFIPCPEGKSFD; LFIPCPEGKSFDS;
FIPCPEGKSFDSA; IPCPEGKSFDSAP; PCPEGKSFDSAPV;
CPEGKSFDSAPVP; PEGKSFDSAPVPF; EGKSFDSAPVPFT;
GKSFDSAPVPFTS; KSFDSAPVPFTSS; SFDSAPVPFTSSK;
FDSAPVPFTSSKT; DSAPVPFTSSKTT; SAPVPFTSSKTTM;
APVPFTSSKTTMY; SIATPSSKVSLSM; IATPSSKVSLSMG;

TABLE O-continued

Predicted MHC class 2 BK virus peptide sequences. Prediction of 13-, 14-, 15-, 16-mers from all 6 reading frames of the genome (access no #V01108) obtained using the program displayed in FIG. 2.

ATPSSKVSLSMGR; TPSSKVSLSMGRF; PSSKVSLSMGRFT;
SSKVSLSMGRFTF; SKVSLSMGRFTFK; KVSLSMGRFTFKA;
VSLSMGRFTFKAL; SLSMGRFTFKALP; LSMGRFTFKALPP;
SMGRFTFKALPPH; MGRFTFKALPPHK; GRFTFKALPPHKS;
RFTFKALPPHKSN; FTFKALPPHKSNN; TFKALPPHKSNNP;
FKALPPHKSNNPA; KALPPHKSNNPAA; ALPPHKSNNPAAS;
LPPHKSNNPAASV; PPHKSNNPAASVV; PHKSNNPAASVVF;
HKSNNPAASVVFP; KSNNPAASVVFPL; SNNPAASVVFPLS;
NNPAASVVFPLSM; NPAASVVFPLSMG; PAASVVFPLSMGP;
AASVVFPLSMGPL; ASVVFPLSMGPLN; SVVFPLSMGPLNN;
VVFPLSMGPLNNQ; VFPLSMGPLNNQY; FPLSMGPLNNQYL;
PLSMGPLNNQYLL; LSMGPLNNQYLLL; SMGPLNNQYLLLG;
MGPLNNQYLLLGT; GPLNNQYLLLGTL; PLNNQYLLLGTLK;
LNNQYLLLGTLKT; NNQYLLLGTLKTI; NQYLLLGTLKTIQ;
QYLLLGTLKTIQC; YLLLGTLKTIQCK; LLLGTLKTIQCKK;
LLGTLKTIQCKKS; LGTLKTIQCKKSN; GTLKTIQCKKSNI;
TLKTIQCKKSNIT; LKTIQCKKSNITE; KTIQCKKSNITES;
TIQCKKSNITESI; IQCKKSNITESIL; QCKKSNITESILG;
CKKSNITESILGS; KKSNITESILGSK; KSNITESILGSKQ;
SNITESILGSKQC; NITESILGSKQCS; ITESILGSKQCSQ;
TESILGSKQCSQA; ESILGSKQCSQAT; SILGSKQCSQATP;
ILGSKQCSQATPA; LGSKQCSQATPAI; GSKQCSQATPAIY;
SKQCSQATPAIYC; KQCSQATPAIYCS; QCSQATPAIYCSS;
CSQATPAIYCSST; SQATPAIYCSSTA; QATPAIYCSSTAF;
ATPAIYCSSTAFP; RVSTLFLAKTVST; VSTLFLAKTVSTA;
STLFLAKTVSTAC; FLLSAKIIAFAKC; LLSAKIIAFAKCF;
LSAKIIAFAKCFS; NSKYIPNNKNTSS; SKYIPNNKNTSSH;
KYIPNNKNTSSHF; YIPNNKNTSSHFV; IPNNKNTSSHFVS;
PNNKNTSSHFVST; NNKNTSSHFVSTA; NKNTSSHFVSTAY;
KNTSSHFVSTAYS; NTSSHFVSTAYSV; TSSHFVSTAYSVI;
SSHFVSTAYSVIN; SHFVSTAYSVINF; HFVSTAYSVINFQ;
FVSTAYSVINFQD; VSTAYSVINFQDT; STAYSVINFQDTC;
TAYSVINFQDTCF; AYSVINFQDTCFV; YSVINFQDTCFVS;
SVINFQDTCFVSS; VINFQDTCFVSSG; INFQDTCFVSSGS;
NFQDTCFVSSGSS; FQDTCFVSSGSSG; QDTCFVSSGSSGL;
DTCFVSSGSSGLK; TCFVSSGSSGLKS; CFVSSGSSGLKSC;
FVSSGSSGLKSCS; VSSGSSGLKSCSF; SSGSSGLKSCSFK;
SGSSGLKSCSFKP; GSSGLKSCSFKPP; MLSSIVWYGSLVK;
LSSIVWYGSLVKA; SSIVWYGSLVKAL; SIVWYGSLVKALY;
IVWYGSLVKALYS; VWYGSLVKALYSK; WYGSLVKALYSKY;
YGSLVKALYSKYS; GSLVKALYSKYSL; SLVKALYSKYSLL;
LVKALYSKYSLLT; VKALYSKYSLLTP; KALYSKYSLLTPL;
ALYSKYSLLTPLQ; LYSKYSLLTPLQI; YSKYSLLTPLQIK;
SKYSLLTPLQIKK; KYSLLTPLQIKKL; YSLLTPLQIKKLV;
SLLTPLQIKKLVH; LLTPLQIKKLVHS; LTPLQIKKLVHSF;
TPLQIKKLVHSF; QKLLIAETLCLCG; KLLIAETLCLCGV;
LLIAETLCLCGVK; LIAETLCLCGVKK; IAETLCLCGVKKN;
AETLCLCGVKKNI; ETLCLCGVKKNII; TLCLCGVKKNIIL;
LCLCGVKKNIILC; CLCGVKKNIILCP; LCGVKKNIILCPA;
CGVKKNIILCPAH; GVKKNIILCPAHM; VKKNIILCPAHMC;
KKNIILCPAHMCL; KNIILCPAHMCLL; NIILCPAHMCLLI;
IILCPAHMCLLIK; ILCPAHMCLLIKV; LCPAHMCLLIKVT;
CPAHMCLLIKVTE; PAHMCLLIKVTEY; AHMCLLIKVTEYF;
HMCLLIKVTEYFS; MCLLIKVTEYFSI; CLLIKVTEYFSIS;
LLIKVTEYFSISF; LIKVTEYFSISFL; IKVTEYFSISFLY;
KVTEYFSISFLYR; VTEYFSISFLYRI; AFSLVVYTAKQAR;
FSLVVYTAKQARV; SLVVYTAKQARVL; LVVYTAKQARVLL;
VVYTAKQARVLLL; VYTAKQARVLLLN; YTAKQARVLLLNT;
TAKQARVLLLNTA; LRNWCRSEGKSLG; RNWCRSEGKSLGS;
NWCRSEGKSLGSS; WCRSEGKSLGSST; CRSEGKSLGSSTF;
RSEGKSLGSSTFL; SEGKSLGSSTFLF; EGKSLGSSTFLFF;
GKSLGSSTFLFFL; KSLGSSTFLFFLG; SLGSSTFLFFLGG;
LGSSTFLFFLGGV; GSSTFLFFLGGVE; SSTFLFFLGGVEC;
ESAVASSSLANIS; SAVASSSLANISS; AVASSSLANISSW;
VASSSLANISSWQ; ASSSLANISSWQN; SSSLANISSWQNK;
SSLANISSWQNKS; SLANISSWQNKSS; LANISSWQNKSSS;
ANISSWQNKSSSH; NISSWQNKSSSHF; ISSWQNKSSSHFS;
SSWQNKSSSHFSL; SWQNKSSSHFSLK; WQNKSSSHFSLKE;
QNKSSSHFSLKEL; NKSSSHFSLKELH; KSSSHFSLKELHQ;
SSSHFSLKELHQD; SSHFSLKELHQDS; SHFSLKELHQDSH;
HFSLKELHQDSHS; FSLKELHQDSHSS; SLKELHQDSHSSV;
LKELHQDSHSSVP; VGTYKKNNYLGPF; GTYKKNNYLGPFN;
TYKKNNYLGPFNI; YKKNNYLGPFNIL; KKNNYLGPFNILL;
KNNYLGPFNILLF; NNYLGPFNILLFI; REFLQLFGPTIAE;

EFLQLFGPTIAEF; FLQLFGPTIAEFL; LQLFGPTIAEFLQ;
QLFGPTIAEFLQL; LFGPTIAEFLQLG; FGPTIAEFLQLGL;
GPTIAEFLQLGLS; PTIAEFLQLGLSQ; TIAEFLQLGLSQT;
IAEFLQLGLSQTT; AEFLQLGLSQTTV; SSQCSSNLSKPRA;
SQCSSNLSKPRAL; QCSSNLSKPRALF; CSSNLSKPRALFL;
SSNLSKPRALFLK; SNLSKPRALFLKI; NLSKPRALFLKIF;
LSKPRALFLKIFY; SKPRALFLKIFYL; KPRALFLKIFYLN;
PRALFLKIFYLNA; RALFLKIFYLNAL; ALFLKIFYLNALI;
ADIACKGSAQKAF; DIACKGSAQKAFW; IACKGSAQKAFWN;
ACKGSAQKAFWNK; AIPCSTGYLGKEE; IPCSTGYLGKEEN;
PCSTGYLGKEENQ; CSTGYLGKEENQH; STGYLGKEENQHK;
TGYLGKEENQHKP; GYLGKEENQHKPL; YLGKEENQHKPLS;
LGKEENQHKPLSY; GKEENQHKPLSYS; KEENQHKPLSYSR;
EENQHKPLSYSRF; ENQHKPLSYSRFQ; NQHKPLSYSRFQN;
QHKPLSYSRFQNQ; HKPLSYSRFQNQA; KPLSYSRFQNQAD;
PLSYSRFQNQADE; LSYSRFQNQADEL; SYSRFQNQADELP;
YSRFQNQADELPL; SRFQNQADELPLH; RFQNQADELPLHP;
FQNQADELPLHPA; QNQADELPLHPAP; NQADELPLHPAPF;
QADELPLHPAPFF; ADELPLHPAPFFY; DELPLHPAPFFYT;
ELPLHPAPFFYTK; LPLHPAPFFYTKY; PLHPAPFFYTKYS;
LHPAPFFYTKYSF; HPAPFFYTKYSFS; PAPFFYTKYSFSS;
APFFYTKYSFSSF; PFFYTKYSFSSFY; FFYTKYSFSSFYP;
FYTKYSFSSFYPR; YTKYSFSSFYPRR; TKYSFSSFYPRRP;
KYSFSSFYPRRPL; YSFSSFYPRRPLC; SFSSFYPRRPLCQ;
FSSFYPRRPLCQG; SSFYPRRPLCQGE; SFYPRRPLCQGEI;
FYPRRPLCQGEIP; YPRRPLCQGEIPY; PRRPLCQGEIPYT;
RRPLCQGEIPYTS; RPLCQGEIPYTSL; PLCQGEIPYTSLN;
LCQGEIPYTSLNK; CQGEIPYTSLNKL; QGEIPYTSLNKLF;
GEIPYTSLNKLFS; EIPYTSLNKLFSL; IPYTSLNKLFSLR;
PYTSLNKLFSLRE; YTSLNKLFSLRED; TSLNKLFSLREDF;
SLNKLFSLREDFP; LNKLFSLREDFPR; NKLFSLREDFPRQ;
KLFSLREDFPRQL; LFSLREDFPRQLF; FSLREDFPRQLFQ;
SLREDFPRQLFQG; LREDFPRQLFQGL; REDFPRQLFQGLK;
EDFPRQLFQGLKG; DFPRQLFQGLKGP 14 mers:

GFPQIVLLGLRKSL; FPQIVLLGLRKSLH; PQIVLLGLRKSLHT;
QIVLLGLRKSLHTL; IVLLGLRKSLHTLT; VLLGLRKSLHTLTT;
EKGWRQRRPRPLIY; KGWRQRRPRPLIYY; GWRQRRPRPLIYYK;
WRQRRPRPLIYYKK; RQRRPRPLIYYKKK; QRRPRPLIYYKKKG;
RRPRPLIYYKKKGH; RPRPLIYYKKKGHR; PRPLIYYKKKGHRE;
RPLIYYKKKGHREE; PLIYYKKKGHREEL; LIYYKKKGHREELL;
IYYKKKGHREELLT; YYKKKGHREELLTH; YKKKGHREELLTHG;
KKKGHREELLTHGM; KKGHREELLTHGMQ; KGHREELLTHGMQP;
GHREELLTHGMQPN; HREELLTHGMQPNH; REELLTHGMQPNHD;
EELLTHGMQPNHDL; ELLTHGMQPNHDLR; LLTHGMQPNHDLRK;
LTHGMQPNHDLRKE; THGMQPNHDLRKES; HGMQPNHDLRKESA;
LTGECSQTMTSGRK; TGECSQTMTSGRKV; GECSQTMTSGRKVH;
ECSQTMTSGRKVHD; CSQTMTSGRKVHDS; SQTMTSGRKVHDSQ;
QTMTSGRKVHDSQG; TMTSGRKVHDSQGG; MTSGRKVHDSQGGA;
TSGRKVHDSQGGAA; SGRKVHDSQGGAAY; GRKVHDSQGGAAYP;
RKVHDSQGGAAYPW; KVHDSQGGAAYPWN; VHDSQGGAAYPWNA;
HDSQGGAAYPWNAA; DSQGGAAYPWNAAK; SQGGAAYPWNAAKP;
PQEGKCMTDMFCEP; QEGKCMTDMFCEPR; EGKCMTDMFCEPRN;
GKCMTDMFCEPRNL; KCMTDMFCEPRNLG; CMTDMFCEPRNLGL;
MTDMFCEPRNLGLV; TDMFCEPRNLGLVP; DMFCEPRNLGLVPS;
TGQRPWFCASCHDK; GQRPWFCASCHDKL; QRPWFCASCHDKLQ;
KLVKPGLEQKKELR; LVKPGLEQKKELRG; VKPGLEQKKELRGF;
KPGLEQKKELRGFL; PGLEQKKELRGFLF; GLEQKKELRGFLFL;
EQKKELRGFLFLF; VIPPFLYFQVHGCC; IPPFLYFQVHGCCS;
PPFLYFQVHGCCSS; PFLYFQVHGCCSST; FLYFQVHGCCSSTF;
LYFQVHGCCSSTFG; YFQVHGCCSSTFGG; FQVHGCCSSTFGGP;
QVHGCCSSTFGGPS; VHGCCSSTFGGPSC; HGCCSSTFGGPSCQ;
GCCSSTFGGPSCQC; CCSSTFGGPSCQCI; NCCWGGCCCYRSSN;
CCWGGCCCYRSSNC; CWGGCCCYRSSNCI; WGGCCCYRSSNCIP;
GGCCCYRSSNCIPC; GCCCYRSSNCIPCY; CCCYRSSNCIPCYC;
CCYRSSNCIPCYCR; CYRSSNCIPCYCRG; YRSSNCIPCYCRGH;
RSSNCIPCYCRGHN; SSNCIPCYCRGHNK; SNCIPCYCRGHNKY;
NCIPCYCRGHNKYL; CIPCYCRGHNKYLR; IPCYCRGHNKYLRG;
PCYCRGHNKYLRGY; CYCRGHNKYLRGYS; YCRGHNKYLRGYSC;
CRGHNKYLRGYSCY; RGHNKYLRGYSCYR; GHNKYLRGYSCYRP;
HNKYLRGYSCYRPN; NKYLRGYSCYRPNS; KYLRGYSCYRPNSS;
YLRGYSCYRPNSSN; LRGYSCYRPNSSNI; RGYSCYRPNSSNIC;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GYSCYRPNSSNICC; YSCYRPNSSNICCN; SCYRPNSSNICCNC;
CYRPNSSNICCNCW; YRPNSSNICCNCWC; RPNSSNICCNCWCS;
PNSSNICCNCWCSW; NSSNICCNCWCSWG; SSNICCNCWCSWGY;
SNICCNCWCSWGYC; NICCNCWCSWGYCW; ICCNCWCSWGYCWV;
CCNCWCSWGYCWVC; CNCWCSWGYCWVCC; NCWCSWGYCWVCCF;
CWCSWGYCWVCCFN; WCSWGYCWVCCFNS; CSWGYCWVCCFNSN;
SWGYCWVCCFNSNC; LGSQSFHCRPLSAI; GSQSFHCRPLSAIR;
SQSFHCRPLSAIRH; QSFHCRPLSAIRHG; SFHCRPLSAIRHGF;
FHCRPLSAIRHGFG; HCRPLSAIRHGFGI; CRPLSAIRHGFGIV;
ALGSFFVCYYFPGF; LGSFFVCYYFPGFV; GSFFVCYYFPGFVA;
SFFVCYYFPGFVAC; FFVCYYFPGFVACY; YTFYNLTGIAEKNR;
TFYNLTGIAEKNRK; FYNLTGIAEKNRKI; YNLTGIAEKNRKIF;
IFGGNYLDNCKPY; FGGNYLDNCKPYK; GGNYLDNCKPYKL;
GNYLDNCKPYKLL; QYRRSYTKNGLKKS; YRRSYTKNGLKKST;
RRSYTKNGLKKSTK; RSYTKNGLKKSTKC; SYTKNGLKKSTKCT;
YTKNGLKKSTKCTF; TKNGLKKSTKCTFR; KNGLKKSTKCTFRR;
NGLKKSTKCTFRRV; GLKKSTKCTFRRVY; LKKSTKCTFRRVYR;
KKSTKCTFRRVYRK; KSTKCTFRRVYRKN; STKCTFRRVYRKNY;
TKCTFRRVYRKNYC; KCTFRRVYRKNYCP; CTFRRVYRKNYCPR;
TFRRVYRKNYCPRR; FRRVYRKNYCPRRC; SKNCSSMDVAFTSR;
KNCSSMDVAFTSRP; NCSSMDVAFTSRPV; CSSMDVAFTSRPVR;
SSMDVAFTSRPVRD; SMDVAFTSRPVRDC; MDVAFTSRPVRDCN;
DVAFTSRPVRDCNT; VAFTSRPVRDCNTC; AFTSRPVRDCNTCS;
RWPQPKEKESVQGQ; WPQPKEKESVQGQL; PQPKEKESVQGQLP;
QPKEKESVQGQLPK; PKEKESVQGQLPKS; KEKESVQGQLPKSQ;
EKESVQGQLPKSQR; KESVQGQLPKSQRN; ESVQGQLPKSQRNP;
SVQGQLPKSQRNPC; VQGQLPKSQRNPCK; QGQLPKSQRNPCKQ;
GQLPKSQRNPCKCQ; QLPKSQRNPCKCQN; LPKSQRNPCKCQNY;
TQKWGIQMKTLGAL; QKWGIQMKTLGALV; VLKMTLAVIAQREK;
LKMTLAVIAQREKC; KMTLAVIAQREKCF; MTLAVIAQREKCFP;
TLAVIAQREKCFPV; LAVIAQREKCFPVT; AVIAQREKCFPVTA;
VIAQREKCFPVTAQ; IAQREKCFPVTAQQ; AQREKCFPVTAQQE;
QREKCFPVTAQQEF; REKCFPVTAQQEFP; EKCFPVTAQQEFPS;
KCFPVTAQQEFPSP; CFPVTAQQEFPSPI; LACLTFMQGHKKCM;
ACLTFMQGHKKCMS; CLTFMQGHKKCMSM; LTFMQGHKKCMSMV;
TFMQGHKKCMSMVE; FMQGHKKCMSMVEE; MQGHKKCMSMVEEN;
QGHKKCMSMVEENL; GHKKCMSMVEENLF; HKKCMSMVEENLFK;
KKCMSMVEENLFKA; KCMSMVEENLFKAV; CMSMVEENLFKAVI;
MSMVEENLFKAVIS; SMVEENLFKAVIST; MVEENLFKAVISTS;
VEENLFKAVISTSL; EENLFKAVISTSLL; ILTIRPIWTKTMLI;
LTIRPIWTKTMLIQ; TIRPIWTKTMLIQL; IRPIWTKTMLIQLS;
RPIWTKTMLIQLSA; PIWTKTMLIQLSAG; IWTKTMLIQLSAGY;
WTKTMLIQLSAGYL; TKTMLIQLSAGYLI; KTMLIQLSAGYLIP;
TMLIQLSAGYLIPV; MLIQLSAGYLIPVE; LIQLSAGYLIPVEM;
IQLSAGYLIPVEMK; QLSAGYLIPVEMKM; LSAGYLIPVEMKML;
SAGYLIPVEMKMLG; AGYLIPVEMKMLGI; GYLIPVEMKMLGIL;
YLIPVEMKMLGILG; LIPVEMKMLGILGL; IPVEMKMLGILGLS;
PVEMKMLGILGLSQ; VEMKMLGILGLSQE; EMKMLGILGLSQEG;
MKMLGILGLSQEGK; KMLGILGLSQEGKM; MLGILGLSQEGKMF;
LGILGLSQEGKMFP; GILGLSQEGKMFPQ; ILGLSQEGKMFPQY;
LGLSQEGKMFPQYF; GLSQEGKMFPQYFM; MNRVWGLFVKLIAC;
NRVWGLFVKLIACM; RVWGLFVKLIACMF; VWGLFVKLIACMFQ;
WGLFVKLIACMFQL; GLFVKLIACMFQLL; LFVKLIACMFQLLI;
FVKLIACMFQLLIF; VKLIACMFQLLIFV; KLIACMFQLLIFVA;
LIACMFQLLIFVAC; IACMFQLLIFVACL; ACMFQLLIFVACLL;
CMFQLLIFVACLLT; MFQLLIFVACLLTA; FQLLIFVACLLTAL;
QLLIFVACLLTALE; LLIFVACLLTALEH; LIFVACLLTALEHN;
IFVACLLTALEHNS; FVACLLTALEHNSG; VACLLTALEHNSGE;
ACLLTALEHNSGEA; CLLTALEHNSGEAL; LLTALEHNSGEALQ;
LTALEHNSGEALQD; TALEHNSGEALQDI; ALEHNSGEALQDIL;
LEHNSGEALQDILR; EHNSGEALQDILRS; HNSGEALQDILRSA;
TGEPREWMGSLCMV; GEPREWMGSLCMVW; EPREWMGSLCMVWN;
PREWMGSLCMVWNP; REWMGSLCMVWNPR; KRLGCLMAQKDFQG;
RLGCLMAQKDFQGT; LGCLMAQKDFQGTQ; GCLMAQKDFQGTQI;
DILTNRDNCKPKCF; ILTNRDNCKPKCFK; LTNRDNCKPKCFKQ;
TNRDNCKPKCFKQV; NRDNCKPKCFKQVL; RDNCKPKCFKQVLL;
DNCKPKCFKQVLLL; NCKPKCFKQVLLLY; CKPKCFKQVLLLYI;
KPKCFKQVLLLYIY; PKCFKQVLLLYIYI; MLLLYKPLLSLCYF;
LLLYKPLLSLCYFG; LLYKPLLSLCYFGG; LYKPLLSLCYFGGG;
YKPLLSLCYFGGGV; KPLLSLCYFGGGVL; PLLSLCYFGGGVLG;
LLSLCYFGGGVLGL; LSLCYFGGGVLGLL; SLCYFGGGVLGLLK;
LCYFGGGVLGLLKH; LWGSDLWESSAGAE; WGSDLWESSAGAEV;
GSDLWESSAGAEVS; SDLWESSAGAEVSE; DLWESSAGAEVSET;
LWESSAGAEVSETW; WESSAGAEVSETWE; ESSAGAEVSETWEE;
SSAGAEVSETWEEH; SAGAEVSETWEEHC; AGAEVSETWEEHCD;
GAEVSETWEEHCDW; AEVSETWEEHCDWD; EVSETWEEHCDWDS;
VSETWEEHCDWDSV; SETWEEHCDWDSVL; ETWEEHCDWDSVLD;
TWEEHCDWDSVLDP; WEEHCDWDSVLDPC; EEHCDWDSVLDPCP;
EHCDWDSVLDPCPE; HCDWDSVLDPCPES; CDWDSVLDPCPESS;
DWDSVLDPCPESSV; WDSVLDPCPESSVS; DSVLDPCPESSVSE;
SVLDPCPESSVSES; VLDPCPESSVSESS; LDPCPESSVSESSS;
DPCPESSVSESSSL; PCPESSVSESSSLV; CPESSVSESSSLVI;
PESSVSESSSLVIS; ESSVSESSSLVISR; SSVSESSSLVISRI;
SVSESSSLVISRIH; VSESSSLVISRIHF; SESSSLVISRIHFP;
ESSSLVISRIHFPM; SSSLVISRIHFPMH; SSLVISRIHFPMHI;
SLVISRIHFPMHIL; LVISRIHFPMHILY; VISRIHFPMHILYF;
ISRIHFPMHILYFI; SRIHFPMHILYFIL; RIHFPMHILYFILE;
IHFPMHILYFILEK; HFPMHILYFILEKV; FPMHILYFILEKVY;
PMHILYFILEKVYI; MHILYFILEKVYIL; HILYFILEKVYILI;
ILYFILEKVYILIS; LYFILEKVYILISE; YFILEKVYILISES;
FILEKVYILISESS; ILEKVYILISESSL; LEKVYILISESSLS;
EKVYILISESSLSF; KVYILISESSLSFH; VYILISESSLSFHS;
YILISESSLSFHST; ILISESSLSFHSTI; LISESSLSFHSTIL;
ISESSLSFHSTILD; SESSLSFHSTILDC; ESSLSFHSTILDCI;
SSLSFHSTILDCIS; SLSFHSTILDCISV; LSFHSTILDCISVA;
SFHSTILDCISVAK; FHSTILDCISVAKS; HSTILDCISVAKSA;
STILDCISVAKSAT; TILDCISVAKSATG; ILDCISVAKSATGL;
LDCISVAKSATGLN; DCISVAKSATGLNQ; CISVAKSATGLNQI;
ISVAKSATGLNQIS; SVAKSATGLNQISS; VAKSATGLNQISSS;
AKSATGLNQISSSN; KSATGLNQISSSNK; SATGLNQISSSNKV;
ATGLNQISSSNKVI; TGLNQISSSNKVIP; GLNQISSSNKVIPL;
LNQISSSNKVIPLC; NQISSSNKVIPLCK; QISSSNKVIPLCKI;
ISSSNKVIPLCKIL; SSSNKVIPLCKILF; SSNKVIPLCKILFS;
SNKVIPLCKILFSS; NKVIPLCKILFSSK; KVIPLCKILFSSKN;
VIPLCKILFSSKNS; IPLCKILFSSKNSE; PLCKILFSSKNSEF;
LCKILFSSKNSEFC; CKILFSSKNSEFCK; KILFSSKNSEFCKD;
ILFSSKNSEFCKDF; LFSSKNSEFCKDFL; FSSKNSEFCKDFLK;
SSKNSEFCKDFLKY; SKNSEFCKDFLKYI; KNSEFCKDFLKYIL;
NSEFCKDFLKYILG; SEFCKDFLKYILGL; EFCKDFLKYILGLK;
FCKDFLKYILGLKS; CKDFLKYILGLKSI; KDFLKYILGLKSIC;
DFLKYILGLKSICL; FLKYILGLKSICLT; LKYILGLKSICLTN;
KYILGLKSICLTNL; YILGLKSICLTNLA; ILGLKSICLTNLAC;
LGLKSICLTNLACR; GLKSICLTNLACRV; LKSICLTNLACRVL;
KSICLTNLACRVLG; SICLTNLACRVLGT; ICLTNLACRVLGTY;
CLTNLACRVLGTGY; LTNLACRVLGTGYS; TNLACRVLGTGYSF;
NLACRVLGTGYSFI; LACRVLGTGYSFIV; ACRVLGTGYSFIVT;
CRVLGTGYSFIVTK; RVLGTGYSFIVTKP; VLGTGYSFIVTKPG;
LGTGYSFIVTKPGG; GTGYSFIVTKPGGN; TGYSFIVTKPGGNI;
GYSFIVTKPGGNIW; YSFIVTKPGGNIWV; SFIVTKPGGNIWVL;
FIVTKPGGNIWVLL; IVTKPGGNIWVLLF; VTKPGGNIWVLLFK;
TKPGGNIWVLLFKC; KPGGNIWVLLFKCF; PGGNIWVLLFKCFF;
GGNIWVLLFKCFFS; GNIWVLLFKCFFSK; NIWVLLFKCFFSKF;
IWVLLFKCFFSKFT; WVLLFKCFFSKFTL; VLLFKCFFSKFTLT;
LLFKCFFSKFTLTL; LFKCFFSKFTLTLP; FKCFFSKFTLTLPS;
KCFFSKFTLTLPSK; SLKLSKLFIPCPEG; LKLSKLFIPCPEGK;
KLSKLFIPCPEGKS; LSKLFIPCPEGKSF; SKLFIPCPEGKSFD;
KLFIPCPEGKSFDS; LFIPCPEGKSFDSA; FIPCPEGKSFDSAP;
IPCPEGKSFDSAPV; PCPEGKSFDSAPVP; CPEGKSFDSAPVPF;
PEGKSFDSAPVPFT; EGKSFDSAPVPFTS; GKSFDSAPVPFTSS;
KSFDSAPVPFTSSK; SFDSAPVPFTSSKT; FDSAPVPFTSSKTT;
DSAPVPFTSSKTTM; SAPVPFTSSKTTMY; SIATPSSKVSLSMG;
IATPSSKVSLSMGR; ATPSSKVSLSMGRF; TPSSKVSLSMGRFT;
PSSKVSLSMGRFTF; SSKVSLSMGRFTFK; SKVSLSMGRFTFKA;
KVSLSMGRFTFKAL; VSLSMGRFTFKALP; SLSMGRFTFKALPP;
LSMGRFTFKALPPH; SMGRFTFKALPPHK; MGRFTFKALPPHKS;
GRFTFKALPPHKSN; RFTFKALPPHKSNN; FTFKALPPHKSNNP;
TFKALPPHKSNNPA; FKALPPHKSNNPAA; KALPPHKSNNPAAS;
ALPPHKSNNPAASV; LPPHKSNNPAASVV; PPHKSNNPAASVVF;
PHKSNNPAASVVFP; HKSNNPAASVVFPL; KSNNPAASVVFPLS;
SNNPAASVVFPLSM; NNPAASVVFPLSMG; NPAASVVFPLSMGP;
PAASVVFPLSMGPL; AASVVFPLSMGPLN; ASVVFPLSMGPLNN;
SVVFPLSMGPLNNQ; VVFPLSMGPLNNQY; VFPLSMGPLNNQYL;
FPLSMGPLNNQYLL; PLSMGPLNNQYLLL; LSMGPLNNQYLLLG;
SMGPLNNQYLLLGT; MGPLNNQYLLLGTL; GPLNNQYLLLGTLK;
PLNNQYLLLGTLKT; LNNQYLLLGTLKTI; NNQYLLLGTLKTIQ;
NQYLLLGTLKTIQC; QYLLLGTLKTIQCK; YLLLGTLKTIQCKK;
LLLGTLKTIQCKKS; LLGTLKTIQCKKSN; LGTLKTIQCKKSNI;
GTLKTIQCKKSNIT; TLKTIQCKKSNITE; LKTIQCKKSNITES;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

KTIQCKKSNITESI; TIQCKKSNITESIL; IQCKKSNITESILG;
QCKKSNITESILGS; CKKSNITESILGSK; KKSNITESILGSKQ;
KSNITESILGSKQC; SNITESILGSKQCS; NITESILGSKQCSQ;
ITESILGSKQCSQA; TESILGSKQCSQAT; ESILGSKQCSQATP;
SILGSKQCSQATPA; ILGSKQCSQATPAI; LGSKQCSQATPAIY;
GSKQCSQATPAIYC; SKQCSQATPAIYCS; KQCSQATPAIYCSS;
QCSQATPAIYCSST; CSQATPAIYCSSTA; SQATPAIYCSSTAF;
QATPAIYCSSTAFP; RVSTLFLAKTVSTA; VSTLFLAKTVSTAC;
FLLSAKIIAFAKCF; LLSAKIIAFAKCFS; NSKYIPNNKNTSSH;
SKYIPNNKNTSSHF; KYIPNNKNTSSHFV; YIPNNKNTSSHFVS;
IPNNKNTSSHFVST; PNNKNTSSHFVSTA; NNKNTSSHFVSTAY;
NKNTSSHFVSTAYS; KNTSSHFVSTAYSV; NTSSHFVSTAYSVI;
TSSHFVSTAYSVIN; SSHFVSTAYSVINF; SHFVSTAYSVINFQ;
HFVSTAYSVINFQD; FVSTAYSVINFQDT; VSTAYSVINFQDTC;
STAYSVINFQDTCF; TAYSVINFQDTCFV; AYSVINFQDTCFVS;
YSVINFQDTCFVSS; SVINFQDTCFVSSG; VINFQDTCFVSSGS;
INFQDTCFVSSGSS; NFQDTCFVSSGSSG; FQDTCFVSSGSSGL;
QDTCFVSSGSSGLK; DTCFVSSGSSGLKS; TCFVSSGSSGLKSC;
CFVSSGSSGLKSCS; FVSSGSSGLKSCSF; VSSGSSGLKSCSFK;
SSGSSGLKSCSFKP; SGSSGLKSCSFKPP; MLSSIVWYGSLVKA;
LSSIVWYGSLVKAL; SSIVWYGSLVKALY; SIVWYGSLVKALYS;
IVWYGSLVKALYSK; VWYGSLVKALYSKY; WYGSLVKALYSKYS;
YGSLVKALYSKYSL; GSLVKALYSKYSLL; SLVKALYSKYSLLT;
LVKALYSKYSLLTP; VKALYSKYSLLTPL; KALYSKYSLLTPLQ;
ALYSKYSLLTPLQI; LYSKYSLLTPLQIK; YSKYSLLTPLQIKK;
SKYSLLTPLQIKKL; KYSLLTPLQIKKLK; YSLLTPLQIKKLKV;
SLLTPLQIKKLKVH; LLTPLQIKKLKVHS; LTPLQIKKLKVHSF;
QKLLIAETLCLCGV; KLLIAETLCLCGVK; LLIAETLCLCGVKK;
LIAETLCLCGVKKN; IAETLCLCGVKKNI; AETLCLCGVKKNII;
ETLCLCGVKKNIIL; TLCLCGVKKNIILC; LCLCGVKKNIILCP;
CLCGVKKNIILCPA; LCGVKKNIILCPAH; CGVKKNIILCPAHM;
GVKKNIILCPAHMC; VKKNIILCPAHMCL; KKNIILCPAHMCLL;
KNIILCPAHMCLLI; NIILCPAHMCLLIK; IILCPAHMCLLIKV;
ILCPAHMCLLIKVT; LCPAHMCLLIKVTE; CPAHMCLLIKVTEY;
PAHMCLLIKVTEYF; AHMCLLIKVTEYFS; HMCLLIKVTEYFSI;
MCLLIKVTEYFSIS; CLLIKVTEYFSISF; LLIKVTEYFSISFL;
LIKVTEYFSISFLY; IKVTEYFSISFLYR; KVTEYFSISFLYRI;
AFSLVVYTAKQARV; FSLVVYTAKQARVL; SLVVYTAKQARVLL;
LVVYTAKQARVLLL; VVYTAKQARVLLLN; VYTAKQARVLLLNT;
YTAKQARVLLLNTA; LRNWCRSEGKSLGS; RNWCRSEGKSLGSS;
NWCRSEGKSLGSST; WCRSEGKSLGSSTF; CRSEGKSLGSSTFL;
RSEGKSLGSSTFLF; SEGKSLGSSTFLFF; EGKSLGSSTFLFFL;
GKSLGSSTFLFFLG; KSLGSSTFLFFLGG; SLGSSTFLFFLGGV;
LGSSTFLFFLGGVE; GSSTFLFFLGGVEC; ESAVASSSLANISS;
SAVASSSLANISSW; AVASSSLANISSWQ; VASSSLANISSWQN;
ASSSLANISSWQNK; SSSLANISSWQNKS; SSLANISSWQNKSS;
SLANISSWQNKSSS; LANISSWQNKSSSH; ANISSWQNKSSSHF;
NISSWQNKSSSHFS; ISSWQNKSSSHFSL; SSWQNKSSSHFSLK;
SWQNKSSSHFSLKE; WQNKSSSHFSLKEL; QNKSSSHFSLKELH;
NKSSSHFSLKELHQ; KSSSHFSLKELHQD; SSSHFSLKELHQDS;
SSHFSLKELHQDSH; SHFSLKELHQDSHS; HFSLKELHQDSHSS;
FSLKELHQDSHSSV; SLKELHQDSHSSVP; VGTYKKNNYLGPFN;
GTYKKNNYLGPFNI; TYKKNNYLGPFNIL; YKKNNYLGPFNILL;
KKNNYLGPFNILLF; KNNYLGPFNILLFI; REFLQLFGPTIAEF;
EFLQLFGPTIAEFL; FLQLFGPTIAEFLQ; LQLFGPTIAEFLQL;
QLFGPTIAEFLQLG; LFGPTIAEFLQLGL; FGPTIAEFLQLGLS;
GPTIAEFLQLGLSQ; PTIAEFLQLGLSQT; TIAEFLQLGLSQTT;
IAEFLQLGLSQTTV; SSQCSSNLSKPRAL; SQCSSNLSKPRALF;
QCSSNLSKPRALFL; CSSNLSKPRALFLK; SSNLSKPRALFLKI;
SNLSKPRALFLKIF; NLSKPRALFLKIFY; LSKPRALFLKIFYL;
SKPRALFLKIFYLN; KPRALFLKIFYLNA; PRALFLKIFYLNAL;
RALFLKIFYLNALI; ADIACKGSAQKAFW; DIACKGSAQKAFWN;
IACKGSAQKAFWNK; AIPCSTGYLGKEEN; IPCSTGYLGKEENQ;
PCSTGYLGKEENQH; CSTGYLGKEENQHK; STGYLGKEENQHKP;
TGYLGKEENQHKPL; GYLGKEENQHKPLS; YLGKEENQHKPLSY;
LGKEENQHKPLSYS; GKEENQHKPLSYSR; KEENQHKPLSYSRF;
EENQHKPLSYSRFQ; ENQHKPLSYSRFQN; NQHKPLSYSRFQNQ;
QHKPLSYSRFQNQA; HKPLSYSRFQNQAD; KPLSYSRFQNQADE;
PLSYSRFQNQADEL; LSYSRFQNQADELP; SYSRFQNQADELPL;
YSRFQNQADELPLH; SRFQNQADELPLHP; RFQNQADELPLHPA;
FQNQADELPLHPAP; QNQADELPLHPAPF; NQADELPLHPAPFF;
QADELPLHPAPFFY; ADELPLHPAPFFYT; DELPLHPAPFFYTK;
ELPLHPAPFFYTKY; LPLHPAPFFYTKYS; PLHPAPFFYTKYSF;
LHPAPFFYTKYSFS; HPAPFFYTKYSFSS; PAPFFYTKYSFSSF;
APFFYTKYSFSSFY; PFFYTKYSFSSFYP; FFYTKYSFSSFYPR;
FYTKYSFSSFYPRR; YTKYSFSSFYPRRP; TKYSFSSFYPRRPL;
KYSFSSFYPRRPLC; YSFSSFYPRRPLCQ; SFSSFYPRRPLCQG;
FSSFYPRRPLCQGE; SSFYPRRPLCQGEI; SFYPRRPLCQGEIP;
FYPRRPLCQGEIPY; YPRRPLCQGEIPYT; PRRPLCQGEIPYTS;
RRPLCQGEIPYTSL; RPLCQGEIPYTSLN; PLCQGEIPYTSLNK;
LCQGEIPYTSLNKL; CQGEIPYTSLNKLF; QGEIPYTSLNKLFS;
GEIPYTSLNKLFSL; EIPYTSLNKLFSLR; IPYTSLNKLFSLRE;
PYTSLNKLFSLRED; YTSLNKLFSLREDF; TSLNKLFSLREDFP;
SLNKLFSLREDFPR; LNKLFSLREDFPRQ; NKLFSLREDFPRQL;
KLFSLREDFPRQLF; LFSLREDFPRQLFQ; FSLREDFPRQLFQG;
SLREDFPRQLFQGL; LREDFPRQLFQGLK; REDFPRQLFQGLKG;
EDFPRQLFQGLKGP 15 mers:

GFPQIVLLGLRKSLH; FPQIVLLGLRKSLHT; PQIVLLGLRKSLHTL;
QIVLLGLRKSLHTLT; IVLLGLRKSLHTLTT; EKGWRQRRPRPLIYY;
KGWRQRRPRPLIYYK; GWRQRRPRPLIYYKK; WRQRRPRPLIYYKKK;
RQRRPRPLIYYKKKG; QRRPRPLIYYKKKGH; RRPRPLIYYKKKGHR;
RPRPLIYYKKKGHRE; PRPLIYYKKKGHREE; RPLIYYKKKGHREEL;
PLIYYKKKGHREELL; LIYYKKKGHREELLT; IYYKKKGHREELLTH;
YYKKKGHREELLTHG; YKKKGHREELLTHGM; KKKGHREELLTHGMQ;
KKGHREELLTHGMQP; KGHREELLTHGMQPN; GHREELLTHGMQPNH;
HREELLTHGMQPNHD; REELLTHGMQPNHDL; EELLTHGMQPNHDLR;
ELLTHGMQPNHDLRK; LLTHGMQPNHDLRKE; LTHGMQPNHDLRKES;
THGMQPNHDLRKESA; LTGECSQTMTSGRKV; TGECSQTMTSGRKVH;
GECSQTMTSGRKVHD; ECSQTMTSGRKVHDS; CSQTMTSGRKVHDSQ;
SQTMTSGRKVHDSQG; QTMTSGRKVHDSQGG; TMTSGRKVHDSQGGA;
MTSGRKVHDSQGGAA; TSGRKVHDSQGGAAY; SGRKVHDSQGGAAYP;
GRKVHDSQGGAAYPW; RKVHDSQGGAAYPWN; KVHDSQGGAAYPWNA;
VHDSQGGAAYPWNAA; HDSQGGAAYPWNAAK; DSQGGAAYPWNAAKP;
PQEGKCMTDMFCEPR; QEGKCMTDMFCEPRN; EGKCMTDMFCEPRNL;
GKCMTDMFCEPRNLG; KCMTDMFCEPRNLGL; CMTDMFCEPRNLGLV;
MTDMFCEPRNLGLVP; TDMFCEPRNLGLVPS; TGQRPWFCASCHDKL;
GQRPWFCASCHDKLG; KLVKPGLEQKKELRG; LVKPGLEQKKELRGF;
VKPGLEQKKELRGFL; KPGLEQKKELRGFLF; PGLEQKKELRGFLFL;
GLEQKKELRGFLFLF; VIPFFLYFQVHGCCS; IPFFLYFQVHGCCSS;
PFFLYFQVHGCCSST; FFLYFQVHGCCSSTF; FLYFQVHGCCSSTFG;
LYFQVHGCCSSTFGG; YFQVHGCCSSTFGGP; FQVHGCCSSTFGGPS;
QVHGCCSSTFGGPSC; VHGCCSSTFGGPSCQ; HGCCSSTFGGPSCQC;
GCCSSTFGGPSCQCI; NCCWGGCCCYRSSNC; CCWGGCCCYRSSNCI;
CWGGCCCYRSSNCIP; WGGCCCYRSSNCIPC; GGCCCYRSSNCIPCY;
GCCCYRSSNCIPCYC; CCCYRSSNCIPCYCR; CCYRSSNCIPCYCRG;
CYRSSNCIPCYCRGH; YRSSNCIPCYCRGHN; RSSNCIPCYCRGHNK;
SSNCIPCYCRGHNKY; SNCIPCYCRGHNKYL; NCIPCYCRGHNKYLR;
CIPCYCRGHNKYLRG; IPCYCRGHNKYLRGY; PCYCRGHNKYLRGYS;
CYCRGHNKYLRGYSC; YCRGHNKYLRGYSCY; CRGHNKYLRGYSCYR;
RGHNKYLRGYSCYRP; GHNKYLRGYSCYRPN; HNKYLRGYSCYRPNS;
NKYLRGYSCYRPNSS; KYLRGYSCYRPNSSN; YLRGYSCYRPNSSNI;
LRGYSCYRPNSSNIC; RGYSCYRPNSSNICC; GYSCYRPNSSNICCN;
YSCYRPNSSNICCNC; SCYRPNSSNICCNCW; CYRPNSSNICCNCWC;
YRPNSSNICCNCWCS; RPNSSNICCNCWCSW; PNSSNICCNCWCSWG;
NSSNICCNCWCSWGY; SSNICCNCWCSWGYC; SNICCNCWCSWGYCW;
NICCNCWCSWGYCWV; ICCNCWCSWGYCWVC; CCNCWCSWGYCWVCC;
CNCWCSWGYCWVCCF; NCWCSWGYCWVCCFN; CWCSWGYCWVCCFNS;
WCSWGYCWVCCFNSN; CSWGYCWVCCFNSNC; LGSQSFHCRPLSAIR;
GSQSFHCRPLSAIRH; SQSFHCRPLSAIRHG; QSFHCRPLSAIRHGF;
SFHCRPLSAIRHGFG; FHCRPLSAIRHGFGI; HCRPLSAIRHGFGIV;
ALGSFFVCYYFPGFV; LGSFFVCYYFPGFVA; GSFFVCYYFPGFVAC;
SFFVCYYFPGFVACY; YTFYNLTGIAEKNRK; TFYNLTGIAEKNRKI;
FYNLTGIAEKNRKIF; IFGGNYLDNCKCPYK; FGGNYLDNCKCPYKL;
GGNYLDNCKCPYKLL; QYRRSYTKNGLKKST; YRRSYTKNGLKKSTK;
RRSYTKNGLKKSTKC; RSYTKNGLKKSTKCT; SYTKNGLKKSTKCTF;
YTKNGLKKSTKCTFR; TKNGLKKSTKCTFRR; KNGLKKSTKCTFRRV;
NGLKKSTKCTFRRVY; GLKKSTKCTFRRVYR; LKKSTKCTFRRVYRK;
KKSTKCTFRRVYRKN; KSTKCTFRRVYRKNY; STKCTFRRVYRKNYC;
TKCTFRRVYRKNYCP; KCTFRRVYRKNYCPR; CTFRRVYRKNYCPRR;
TFRRVYRKNYCPRRC; SKNCSSMDVAFTSRP; KNCSSMDVAFTSRPV;
NCSSMDVAFTSRPVR; CSSMDVAFTSRPVRD; SSMDVAFTSRPVRDC;
SMDVAFTSRPVRDCN; MDVAFTSRPVRDCNT; DVAFTSRPVRDCNTC;
VAFTSRPVRDCNTCS; RWPQPKEKESVQGQL; WPQPKEKESVQGQLP;
PQPKEKESVQGQLPK; QPKEKESVQGQLPKS; PKEKESVQGQLPKSQ;
KEKESVQGQLPKSQR; EKESVQGQLPKSQRN; KESVQGQLPKSQRNP;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

ESVQGQLPKSQRNPC; SVQGQLPKSQRNPCK; VQGQLPKSQRNPCKC;
QGQLPKSQRNPCKCQ; GQLPKSQRNPCKCQN; QLPKSQRNPCKCQNY;
TQKWGIQMKTLGALV; VLKMTLAVIAQREKC; LKMTLAVIAQREKCF;
KMTLAVIAQREKCFP; MTLAVIAQREKCFPV; TLAVIAQREKCFPVT;
LAVIAQREKCFPVTA; AVIAQREKCFPVTAQ; VIAQREKCFPVTAQQ;
IAQREKCFPVTAQQE; AQREKCFPVTAQQEF; QREKCFPVTAQQEFP;
REKCFPVTAQQEFPS; EKCFPVTAQQEFPSP; KCFPVTAQQEFPSPI;
LACLTFMQGHKKCMS; ACLTFMQGHKKCMSM; CLTFMQGHKKCMSMV;
LTFMQGHKKCMSMVE; TFMQGHKKCMSMVEE; FMQGHKKCMSMVEEN;
MQGHKKCMSMVEENL; QGHKKCMSMVEENLF; GHKKCMSMVEENLFK;
HKKCMSMVEENLFKA; KKCMSMVEENLFKAV; KCMSMVEENLFKAVI;
CMSMVEENLFKAVIS; MSMVEENLFKAVIST; SMVEENLFKAVISTS;
MVEENLFKAVISTSL; VEENLFKAVISTSLL; ILTIRPIWTKTMLIQ;
LTIRPIWTKTMLIQL; TIRPIWTKTMLIQLS; IRPIWTKTMLIQLSA;
RPIWTKTMLIQLSAG; PIWTKTMLIQLSAGY; IWTKTMLIQLSAGYL;
WTKTMLIQLSAGYLI; TKTMLIQLSAGYLIP; KTMLIQLSAGYLIPV;
TMLIQLSAGYLIPVE; MLIQLSAGYLIPVEM; LIQLSAGYLIPVEMK;
IQLSAGYLIPVEMKM; QLSAGYLIPVEMKML; LSAGYLIPVEMKMLG;
SAGYLIPVEMKMLGI; AGYLIPVEMKMLGIL; GYLIPVEMKMLGILG;
YLIPVEMKMLGILGL; LIPVEMKMLGILGLS; IPVEMKMLGILGLSQ;
PVEMKMLGILGLSQE; VEMKMLGILGLSQEG; EMKMLGILGLSQEGK;
MKMLGILGLSQEGKM; KMLGILGLSQEGKMF; MLGILGLSQEGKMFP;
LGILGLSQEGKMFPQ; GILGLSQEGKMFPQY; ILGLSQEGKMFPQYF;
LGLSQEGKMFPQYFM; MNRVWGLFVKLIACM; NRVWGLFVKLIACMF;
RVWGLFVKLIACMFQ; VWGLFVKLIACMFQL; WGLFVKLIACMFQLL;
GLFVKLIACMFQLLI; LFVKLIACMFQLLIF; FVKLIACMFQLLIFV;
VKLIACMFQLLIFVA; KLIACMFQLLIFVAC; LIACMFQLLIFVACL;
IACMFQLLIFVACLL; ACMFQLLIFVACLLT; CMFQLLIFVACLLTA;
MFQLLIFVACLLTAL; FQLLIFVACLLTALE; QLLIFVACLLTALEH;
LLIFVACLLTALEHN; LIFVACLLTALEHNS; IFVACLLTALEHNSG;
FVACLLTALEHNSGE; VACLLTALEHNSGEA; ACLLTALEHNSGEAL;
CLLTALEHNSGEALQ; LLTALEHNSGEALQD; LTALEHNSGEALQDI;
TALEHNSGEALQDIL; ALEHNSGEALQDILR; LEHNSGEALQDILRS;
EHNSGEALQDILRSA; TGEPREWMGSLCMVW; GEPREWMGSLCMVWN;
EPREWMGSLCMVWNP; PREWMGSLCMVWNPR; KRLGCLMAQKDFQGT;
RLGCLMAQKDFQGTQ; LGCLMAQKDFQGTQI; DILTNRDNCKPKCFK;
ILTNRDNCKPKCFKQ; LTNRDNCKPKCFKQV; TNRDNCKPKCFKQVL;
NRDNCKPKCFKQVLL; RDNCKPKCFKQVLLL; DNCKPKCFKQVLLLY;
NCKPKCFKQVLLLYI; CKPKCFKQVLLLYIY; KPKCFKQVLLLYIYI;
MLLLYKPLLSLCYFG; LLLYKPLLSLCYFGG; LLYKPLLSLCYFGGG;
LYKPLLSLCYFGGGV; YKPLLSLCYFGGGVL; KPLLSLCYFGGGVLG;
PLLSLCYFGGGVLGL; LLSLCYFGGGVLGLL; LSLCYFGGGVLGLLK;
SLCYFGGGVLGLLKH; LWGSDLWESSAGAEV; WGSDLWESSAGAEVS;
GSDLWESSAGAEVSE; SDLWESSAGAEVSET; DLWESSAGAEVSETW;
LWESSAGAEVSETWE; WESSAGAEVSETWEE; ESSAGAEVSETWEEH;
SSAGAEVSETWEEHC; SAGAEVSETWEEHCD; AGAEVSETWEEHCDW;
GAEVSETWEEHCDWD; AEVSETWEEHCDWDS; EVSETWEEHCDWDSV;
VSETWEEHCDWDSVL; SETWEEHCDWDSVLD; ETWEEHCDWDSVLDP;
TWEEHCDWDSVLDPC; WEEHCDWDSVLDPCP; EEHCDWDSVLDPCPE;
EHCDWDSVLDPCPES; HCDWDSVLDPCPESS; CDWDSVLDPCPESSV;
DWDSVLDPCPESSVS; WDSVLDPCPESSVSE; DSVLDPCPESSVSES;
SVLDPCPESSVSESS; VLDPCPESSVSESSS; LDPCPESSVSESSSL;
DPCPESSVSESSSLV; PCPESSVSESSSLVI; CPESSVSESSSLVIS;
PESSVSESSSLVISR; ESSVSESSSLVISRI; SSVSESSSLVISRIH;
SVSESSSLVISRIHF; VSESSSLVISRIHFP; SESSSLVISRIHFPM;
ESSSLVISRIHFPMH; SSSLVISRIHFPMHI; SSLVISRIHFPMHIL;
SLVISRIHFPMHILY; LVISRIHFPMHILYF; VISRIHFPMHILYFI;
ISRIHFPMHILYFIL; SRIHFPMHILYFILE; RIHFPMHILYFILEK;
IHFPMHILYFILEKV; HFPMHILYFILEKVY; FPMHILYFILEKVYI;
PMHILYFILEKVYIL; MHILYFILEKVYILI; HILYFILEKVYILIS;
ILYFILEKVYILISE; LYFILEKVYILISES; YFILEKVYILISESS;
FILEKVYILISESSL; ILEKVYILISESSLS; LEKVYILISESSLSF;
EKVYILISESSLSFH; KVYILISESSLSFHS; VYILISESSLSFHST;
YILISESSLSFHSTI; ILISESSLSFHSTIL; LISESSLSFHSTILD;
ISESSLSFHSTILDC; SESSLSFHSTILDCI; ESSLSFHSTILDCIS;
SSLSFHSTILDCISV; SLSFHSTILDCISVA; LSFHSTILDCISVAK;
SFHSTILDCISVAKS; FHSTILDCISVAKSA; HSTILDCISVAKSAT;
STILDCISVAKSATG; TILDCISVAKSATGL; ILDCISVAKSATGLN;
LDCISVAKSATGLNQ; DCISVAKSATGLNQI; CISVAKSATGLNQIS;
ISVAKSATGLNQISS; SVAKSATGLNQISSS; VAKSATGLNQISSSN;
AKSATGLNQISSSNK; KSATGLNQISSSNKV; SATGLNQISSSNKVI;
ATGLNQISSSNKVIP; TGLNQISSSNKVIPL; GLNQISSSNKVIPLC;
LNQISSSNKVIPLCK; NQISSSNKVIPLCKI; QISSSNKVIPLCKIL;
ISSSNKVIPLCKILF; SSSNKVIPLCKILFS; SSNKVIPLCKILFSS;
SNKVIPLCKILFSSK; NKVIPLCKILFSSKN; KVIPLCKILFSSKNS;
VIPLCKILFSSKNSE; IPLCKILFSSKNSEF; PLCKILFSSKNSEFC;
LCKILFSSKNSEFCK; CKILFSSKNSEFCKD; KILFSSKNSEFCKDF;
ILFSSKNSEFCKDFL; LFSSKNSEFCKDFLK; FSSKNSEFCKDFLKY;
SSKNSEFCKDFLKYI; SKNSEFCKDFLKYIL; KNSEFCKDFLKYILG;
NSEFCKDFLKYILGL; SEFCKDFLKYILGLK; EFCKDFLKYILGLKS;
FCKDFLKYILGLKSI; CKDFLKYILGLKSIC; KDFLKYILGLKSICL;
DFLKYILGLKSICLT; FLKYILGLKSICLTN; LKYILGLKSICLTNL;
KYILGLKSICLTNLA; YILGLKSICLTNLAC; ILGLKSICLTNLACR;
LGLKSICLTNLACRV; GLKSICLTNLACRVL; LKSICLTNLACRVLG;
KSICLTNLACRVLGT; SICLTNLACRVLGTG; ICLTNLACRVLGTGY;
CLTNLACRVLGTGYS; LTNLACRVLGTGYSF; TNLACRVLGTGYSFI;
NLACRVLGTGYSFIV; LACRVLGTGYSFIVT; ACRVLGTGYSFIVTK;
CRVLGTGYSFIVTKP; RVLGTGYSFIVTKPG; VLGTGYSFIVTKPGG;
LGTGYSFIVTKPGGN; GTGYSFIVTKPGGNI; TGYSFIVTKPGGNIW;
GYSFIVTKPGGNIWV; YSFIVTKPGGNIWVL; SFIVTKPGGNIWVLL;
FIVTKPGGNIWVLLF; IVTKPGGNIWVLLFK; VTKPGGNIWVLLFKC;
TKPGGNIWVLLFKCF; KPGGNIWVLLFKCFF; PGGNIWVLLFKCFFS;
GGNIWVLLFKCFFSK; GNIWVLLFKCFFSKF; NIWVLLFKCFFSKFT;
IWVLLFKCFFSKFTL; WVLLFKCFFSKFTLT; VLLFKCFFSKFTLTL;
LLFKCFFSKFTLTLP; LFKCFFSKFTLTLPS; FKCFFSKFTLTLPSK;
SLKLSKLFIPCPEGK; LKLSKLFIPCPEGKS; KLSKLFIPCPEGKSF;
LSKLFIPCPEGKSFD; SKLFIPCPEGKSFDS; KLFIPCPEGKSFDSA;
LFIPCPEGKSFDSAP; FIPCPEGKSFDSAPV; IPCPEGKSFDSAPVP;
PCPEGKSFDSAPVPF; CPEGKSFDSAPVPFT; PEGKSFDSAPVPFTS;
EGKSFDSAPVPFTSS; GKSFDSAPVPFTSSK; KSFDSAPVPFTSSKT;
SFDSAPVPFTSSKTT; FDSAPVPFTSSKTTM; DSAPVPFTSSKTTMS;
SIATPSSKVSLSMGR; IATPSSKVSLSMGRF; ATPSSKVSLSMGRFT;
TPSSKVSLSMGRFTP; PSSKVSLSMGRFTFK; SSKVSLSMGRFTFKA;
SKVSLSMGRFTFKAL; KVSLSMGRFTFKALP; VSLSMGRFTFKALPP;
SLSMGRFTFKALPPH; LSMGRFTFKALPPHK; SMGRFTFKALPPHKS;
MGRFTFKALPPHKSN; GRFTFKALPPHKSNN; RFTFKALPPHKSNNP;
FTFKALPPHKSNNPA; TFKALPPHKSNNPAA; FKALPPHKSNNPAAS;
KALPPHKSNNPAASV; ALPPHKSNNPAASVV; LPPHKSNNPAASVVF;
PPHKSNNPAASVVFP; PHKSNNPAASVVFPL; HKSNNPAASVVFPLS;
KSNNPAASVVFPLSM; SNNPAASVVFPLSMG; NNPAASVVFPLSMGP;
NPAASVVFPLSMGPL; PAASVVFPLSMGPLN; AASVVFPLSMGPLNN;
ASVVFPLSMGPLNNQ; SVVFPLSMGPLNNQY; VVFPLSMGPLNNQYL;
VFPLSMGPLNNQYLL; FPLSMGPLNNQYLLL; PLSMGPLNNQYLLLG;
LSMGPLNNQYLLLGT; SMGPLNNQYLLLGTL; MGPLNNQYLLLGTLK;
GPLNNQYLLLGTLKT; PLNNQYLLLGTLKTI; LNNQYLLLGTLKTIQ;
NNQYLLLGTLKTIQC; NQYLLLGTLKTIQCK; QYLLLGTLKTIQCKK;
YLLLGTLKTIQCKKS; LLLGTLKTIQCKKSN; LLGTLKTIQCKKSNI;
LGTLKTIQCKKSNIT; GTLKTIQCKKSNITE; TLKTIQCKKSNITES;
LKTIQCKKSNITESI; KTIQCKKSNITESIL; TIQCKKSNITESILG;
IQCKKSNITESILGS; QCKKSNITESILGSK; CKKSNITESILGSKQ;
KKSNITESILGSKQC; KSNITESILGSKQCS; SNITESILGSKQCSQ;
NITESILGSKQCSQA; ITESILGSKQCSQAT; TESILGSKQCSQATP;
ESILGSKQCSQATPA; SILGSKQCSQATPAI; ILGSKQCSQATPAIY;
LGSKQCSQATPAIYC; GSKQCSQATPAIYCS; SKQCSQATPAIYCSS;
KQCSQATPAIYCSST; QCSQATPAIYCSSTA; CSQATPAIYCSSTAF;
SQATPAIYCSSTAFP; RVSTLFLAKTVSTAC; FLLSAKIIAFAKCFS;
NSKYIPNNKNTSSHF; SKYIPNNKNTSSHFV; KYIPNNKNTSSHFVS;
YIPNNKNTSSHFVST; IPNNKNTSSHFVSTA; PNNKNTSSHFVSTAY;
NNKNTSSHFVSTAYS; NKNTSSHFVSTAYSV; KNTSSHFVSTAYSVI;
NTSSHFVSTAYSVIN; TSSHFVSTAYSVINF; SSHFVSTAYSVINFQ;
SHFVSTAYSVINFQD; HFVSTAYSVINFQDT; FVSTAYSVINFQDTC;
VSTAYSVINFQDTCF; STAYSVINFQDTCFV; TAYSVINFQDTCFVS;
AYSVINFQDTCFVSS; YSVINFQDTCFVSSG; SVINFQDTCFVSSGS;
VINFQDTCFVSSGSS; INFQDTCFVSSGSSG; NFQDTCFVSSGSSGL;
FQDTCFVSSGSSGLK; QDTCFVSSGSSGLKS; DTCFVSSGSSGLKSC;
TCFVSSGSSGLKSCS; CFVSSGSSGLKSCSF; FVSSGSSGLKSCSFK;
VSSGSSGLKSCSFKP; SSGSSGLKSCSFKPP; MLSSIVWYGSLVKAL;
LSSIVWYGSLVKALY; SSIVWYGSLVKALYS; SIVWYGSLVKALYSK;
IVWYGSLVKALYSKY; VWYGSLVKALYSKYS; WYGSLVKALYSKYSL;
YGSLVKALYSKYSLL; GSLVKALYSKYSLLT; SLVKALYSKYSLLTP;
LVKALYSKYSLLTPL; VKALYSKYSLLTPLQ; KALYSKYSLLTPLQI;
ALYSKYSLLTPLQIK; LYSKYSLLTPLQIKK; YSKYSLLTPLQIKKL;
SKYSLLTPLQIKKLV; KYSLLTPLQIKKLVK; YSLLTPLQIKKLKVH;
SLLTPLQIKKLKVHS; LLTPLQIKKLKVHSF; QKLLIAETLCLCGVK;
KLLIAETLCLCGVKK; LLIAETLCLCGVKKN; LIAETLCLCGVKKNI;
IAETLCLCGVKKNII; AETLCLCGVKKNIIL; ETLCLCGVKKNIILC;
TLCLCGVKKNIILCP; LCLCGVKKNIILCPA; CLCGVKKNIILCPAH;
LCGVKKNIILCPAHM; CGVKKNIILCPAHMC; GVKKNIILCPAHMCL;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

VKKNIILCPAHMCLL; KKNIILCPAHMCLLI; KNIILCPAHMCLLIK;
NIILCPAHMCLLIKV; IILCPAHMCLLIKVT; ILCPAHMCLLIKVTE;
LCPAHMCLLIKVTEY; CPAHMCLLIKVTEYF; PAHMCLLIKVTEYFS;
AHMCLLIKVTEYFSI; HMCLLIKVTEYFSIS; MCLLIKVTEYFSISF;
CLLIKVTEYFSISFL; LLIKVTEYFSISFLY; LIKVTEYFSISFLYR;
IKVTEYFSISFLYRI; AFSLVVYTAKQARVL; FSLVVYTAKQARVLL;
SLVVYTAKQARVLLL; LVVYTAKQARVLLLN; VVYTAKQARVLLLNT;
VYTAKQARVLLLNTA; LRNWCRSEGKSLGSS; RNWCRSEGKSLGSST;
NWCRSEGKSLGSSTF; WCRSEGKSLGSSTFL; CRSEGKSLGSSTFLF;
RSEGKSLGSSTFLFF; SEGKSLGSSTFLFFL; EGKSLGSSTFLFFLG;
GKSLGSSTFLFFLGG; KSLGSSTFLFFLGGV; SLGSSTFLFFLGGVE;
LGSSTFLFFLGGVEC; ESAVASSSLANISSW; SAVASSSLANISSWQ;
AVASSSLANISSWQN; VASSSLANISSWQNK; ASSSLANISSWQNKS;
SSSLANISSWQNKSS; SSLANISSWQNKSSS; SLANISSWQNKSSSH;
LANISSWQNKSSSHF; ANISSWQNKSSSHFS; NISSWQNKSSSHFSL;
ISSWQNKSSSHFSLK; SSWQNKSSSHFSLKE; SWQNKSSSHFSLKEL;
WQNKSSSHFSLKELH; QNKSSSHFSLKELHQ; NKSSSHFSLKELHQD;
KSSSHFSLKELHQDS; SSSHFSLKELHQDSH; SSHFSLKELHQDSHS;
SHFSLKELHQDSHSS; HFSLKELHQDSHSSV; FSLKELHQDSHSSVG;
VGTYKKNNYLGPFNI; GTYKKNNYLGPFNIL; TYKKNNYLGPFNILL;
YKKNNYLGPFNILLF; KKNNYLGPFNILLFI; REFLQLFGPTIAEFL;
EFLQLFGPTIAEFLQ; FLQLFGPTIAEFLQL; LQLFGPTIAEFLQLG;
QLFGPTIAEFLQLGL; LFGPTIAEFLQLGLS; FGPTIAEFLQLGLSQ;
GPTIAEFLQLGLSQT; PTIAEFLQLGLSQTT; TIAEFLQLGLSQTTV;
SSQCSSNLSKPRALF; SQCSSNLSKPRALFL; QCSSNLSKPRALFLK;
CSSNLSKPRALFLKI; SSNLSKPRALFLKIF; SNLSKPRALFLKIFY;
NLSKPRALFLKIFYL; LSKPRALFLKIFYLN; SKPRALFLKIFYLNS;
KPRALFLKIFYLNAL; PRALFLKIFYLNALI; ADIACKGSAQKAFWN;
DIACKGSAQKAFWNK; AIPCSTGYLGKEENQ; IPCSTGYLGKEENQH;
PCSTGYLGKEENQHK; CSTGYLGKEENQHKP; STGYLGKEENQHKPL;
TGYLGKEENQHKPLS; GYLGKEENQHKPLSY; YLGKEENQHKPLSYS;
LGKEENQHKPLSYSR; GKEENQHKPLSYSRF; KEENQHKPLSYSRFQ;
EENQHKPLSYSRFQN; ENQHKPLSYSRFQNQ; NQHKPLSYSRFQNQA;
QHKPLSYSRFQNQAD; HKPLSYSRFQNQADE; KPLSYSRFQNQADEL;
PLSYSRFQNQADELP; LSYSRFQNQADELPL; SYSRFQNQADELPLH;
YSRFQNQADELPLHP; SRFQNQADELPLHPA; RFQNQADELPLHPAP;
FQNQADELPLHPAPF; QNQADELPLHPAPFF; NQADELPLHPAPFFY;
QADELPLHPAPFFYT; ADELPLHPAPFFYTK; DELPLHPAPFFYTKY;
ELPLHPAPFFYTKYS; LPLHPAPFFYTKYSF; PLHPAPFFYTKYSFS;
LHPAPFFYTKYSFSS; HPAPFFYTKYSFSSF; PAPFFYTKYSFSSFY;
APFFYTKYSFSSFYP; PFFYTKYSFSSFYPR; FFYTKYSFSSFYPRR;
FYTKYSFSSFYPRRP; YTKYSFSSFYPRRPL; TKYSFSSFYPRRPLC;
KYSFSSFYPRRPLCQ; YSFSSFYPRRPLCQG; SFSSFYPRRPLCQGE;
FSSFYPRRPLCQGEI; SSFYPRRPLCQGEIP; SFYPRRPLCQGEIPY;
FYPRRPLCQGEIPYT; YPRRPLCQGEIPYTS; PRRPLCQGEIPYTSL;
RRPLCQGEIPYTSLN; RPLCQGEIPYTSLNK; PLCQGEIPYTSLNKL;
LCQGEIPYTSLNKLF; CQGEIPYTSLNKLFS; QGEIPYTSLNKLFSL;
GEIPYTSLNKLFSLR; EIPYTSLNKLFSLRE; IPYTSLNKLFSLRED;
PYTSLNKLFSLREDF; YTSLNKLFSLREDFP; TSLNKLFSLREDFPR;
SLNKLFSLREDFPRQ; LNKLFSLREDFPRQL; NKLFSLREDFPRQLF;
KLFSLREDFPRQLFQ; LFSLREDFPRQLFQG; FSLREDFPRQLFQGL;
SLREDFPRQLFQGLK; LREDFPRQLFQGLKG; REDFPRQLFQGLKGP 16 mers:

GFPQIVLLGLRKSLHT; FPQIVLLGLRKSLHTL;
PQIVLLGLRKSLHTLT; QIVLLGLRKSLHTLTT;
EKGWRQRRPRPLIYYK; KGWRQRRPRPLIYYKK;
GWRQRRPRPLIYYKKK; WRQRRPRPLIYYKKKG;
RQRRPRPLIYYKKKGH; QRRPRPLIYYKKKGHR;
RRPRPLIYYKKKGHRE; RPRPLIYYKKKGHREE;
PRPLIYYKKKGHREEL; RPLIYYKKKGHREELL;
PLIYYKKKGHREELLT; LIYYKKKGHREELLTH;
IYYKKKGHREELLTHG; YYKKKGHREELLTHGM;
YKKKGHREELLTHGMQ; KKKGHREELLTHGMQP;
KKGHREELLTHGMQPN; KGHREELLTHGMQPNH;
GHREELLTHGMQPNHD; HREELLTHGMQPNHDL;
REELLTHGMQPNHDLR; EELLTHGMQPNHDLRK;
ELLTHGMQPNHDLRKE; LLTHGMQPNHDLRKES;
LTHGMQPNHDLRKESA; LTGECSQTMTSGRKVH;
TGECSQTMTSGRKVHD; GECSQTMTSGRKVHDS;
ECSQTMTSGRKVHDSQ; CSQTMTSGRKVHDSQG;
SQTMTSGRKVHDSQGG; QTMTSGRKVHDSQGGA;
TMTSGRKVHDSQGGAA; MTSGRKVHDSQGGAAY;

TSGRKVHDSQGGAAYP; SGRKVHDSQGGAAYPW;
GRKVHDSQGGAAYPWN; RKVHDSQGGAAYPWNA;
KVHDSQGGAAYPWNAA; VHDSQGGAAYPWNAAK;
HDSQGGAAYPWNAAKP; PQEGKCMTDMFCEPRN;
QEGKCMTDMFCEPRNL; EGKCMTDMFCEPRNLG;
GKCMTDMFCEPRNLGL; KCMTDMFCEPRNLGLV;
CMTDMFCEPRNLGLVP; MTDMFCEPRNLGLVPS;
TGQRPWFCASCHDKLQ; KLVKPGLEQKKELRGF;
LVKPGLEQKKELRGFL; VKPGLEQKKELRGFLF;
KPGLEQKKELRGFLFL; PGLEQKKELRGFLFLF;
VIPPFLYFQVHGCCSS; IPFFLYFQVHGCCSST;
PFFLYFQVHGCCSSTF; FFLYFQVHGCCSSTFG;
FLYFQVHGCCSSTFGG; LYFQVHGCCSSTFGGP;
YFQVHGCCSSTFGGPS; FQVHGCCSSTFGGPSC;
QVHGCCSSTFGGPSCQ; VHGCCSSTFGGPSCQC;
HGCCSSTFGGPSCQCI; NCCWGGCCCYRSSNCI;
CCWGGCCCYRSSNCIP; CWGGCCCYRSSNCIPC;
WGGCCCYRSSNCIPCY; GGCCCYRSSNCIPCYC;
GCCCYRSSNCIPCYCR; CCCYRSSNCIPCYCRG;
CCYRSSNCIPCYCRGH; CYRSSNCIPCYCRGHN;
YRSSNCIPCYCRGHNK; RSSNCIPCYCRGHNKY;
SSNCIPCYCRGHNKYL; SNCIPCYCRGHNKYLR;
NCIPCYCRGHNKYLRG; CIPCYCRGHNKYLRGY;
IPCYCRGHNKYLRGYS; PCYCRGHNKYLRGYSC;
CYCRGHNKYLRGYSCY; YCRGHNKYLRGYSCYR;
CRGHNKYLRGYSCYRP; RGHNKYLRGYSCYRPN;
GHNKYLRGYSCYRPNS; HNKYLRGYSCYRPNSS;
NKYLRGYSCYRPNSSN; KYLRGYSCYRPNSSNI;
YLRGYSCYRPNSSNIC; LRGYSCYRPNSSNICC;
RGYSCYRPNSSNICCN; GYSCYRPNSSNICCNC;
YSCYRPNSSNICCNCW; SCYRPNSSNICCNCWC;
CYRPNSSNICCNCWCS; YRPNSSNICCNCWCSW;
RPNSSNICCNCWCSWG; PNSSNICCNCWCSWGY;
NSSNICCNCWCSWGYC; SSNICCNCWCSWGYCW;
SNICCNCWCSWGYCWV; NICCNCWCSWGYCWVC;
ICCNCWCSWGYCWVCC; CCNCWCSWGYCWVCCF;
CNCWCSWGYCWVCCFN; NCWCSWGYCWVCCFNS;
CWCSWGYCWVCCFNSN; WCSWGYCWVCCFNSNC;
LGSQSFHCRPLSAIRH; GSQSFHCRPLSAIRHG;
SQSFHCRPLSAIRHGF; QSFHCRPLSAIRHGFG;
SFHCRPLSAIRHGFGI; FHCRPLSAIRHGFGIV;
ALGSFFVCYYFPGFVA; LGSFFVCYYFPGFVAC;
GSFFVCYYFPGFVACY; SFFVCYYFPGFVACYT;
FFVCYYFPGFVACYTY; YTFYNLTGIAEKNRKI;
TFYNLTGIAEKNRKIF; IFGGNYLDNCKCPYKL;
FGGNYLDNCKCPYKLL; QYRRSYTKNGLKKSTK;
YRRSYTKNGLKKSTKC; RRSYTKNGLKKSTKCT;
RSYTKNGLKKSTKCTF; SYTKNGLKKSTKCTFR;
YTKNGLKKSTKCTFRR; TKNGLKKSTKCTFRRV;
KNGLKKSTKCTFRRVY; NGLKKSTKCTFRRVYR;
GLKKSTKCTFRRVYRK; LKKSTKCTFRRVYRKN;
KKSTKCTFRRVYRKNY; KSTKCTFRRVYRKNYC;
STKCTFRRVYRKNYCP; TKCTFRRVYRKNYCPR;
KCTFRRVYRKNYCPRR; CTFRRVYRKNYCPRRC;
SKNCSSMDVAFTSRPV; KNCSSMDVAFTSRPVR;
NCSSMDVAFTSRPVRD; CSSMDVAFTSRPVRDC;
SSMDVAFTSRPVRDCN; SMDVAFTSRPVRDCNT;
MDVAFTSRPVRDCNTC; DVAFTSRPVRDCNTCS;
RWPQPKEKESVQGQLP; WPQPKEKESVQGQLPK;
PQPKEKESVQGQLPKS; QPKEKESVQGQLPKSQ;
PKEKESVQGQLPKSQR; KEKESVQGQLPKSQRN;
EKESVQGQLPKSQRNP; KESVQGQLPKSQRNPC;
ESVQGQLPKSQRNPCK; SVQGQLPKSQRNPCKC;
VQGQLPKSQRNPCKCQ; QGQLPKSQRNPCKCQN;
GQLPKSQRNPCKCQNY; VLKMTLAVIAQREKCF;
LKMTLAVIAQREKCFP; KMTLAVIAQREKCFPV;
MTLAVIAQREKCFPVT; TLAVIAQREKCFPVTA;
LAVIAQREKCFPVTAQ; AVIAQREKCFPVTAQQ;
VIAQREKCFPVTAQQE; IAQREKCFPVTAQQEF;
AQREKCFPVTAQQEFP; QREKCFPVTAQQEFPS;
REKCFPVTAQQEFPSP; EKCFPVTAQQEFPSPI;
LACLTFMQGHKKCMSM; ACLTFMQGHKKCMSMV;
CLTFMQGHKKCMSMVE; LTFMQGHKKCMSMVEE;
TFMQGHKKCMSMVEEN; FMQGHKKCMSMVEENL;
MQGHKKCMSMVEENLF; QGHKKCMSMVEENLFK;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GHKKCMSMVEENLFKA; HKKCMSMVEENLFKAV;
KKCMSMVEENLFKAVI; KCMSMVEENLFKAVIS;
CMSMVEENLFKAVIST; MSMVEENLFKAVISTS;
SMVEENLFKAVISTSL; MVEENLFKAVISTSLL;
ILTIRPIWTKTMLIQL; LTIRPIWTKTMLIQLS;
TIRPIWTKTMLIQLSA; IRPIWTKTMLIQLSAG;
RPIWTKTMLIQLSAGY; PIWTKTMLIQLSAGYL;
IWTKTMLIQLSAGYLI; WTKTMLIQLSAGYLIP;
TKTMLIQLSAGYLIPV; KTMLIQLSAGYLIPVE;
TMLIQLSAGYLIPVEM; MLIQLSAGYLIPVEMK;
LIQLSAGYLIPVEMKM; IQLSAGYLIPVEMKML;
QLSAGYLIPVEMKMLG; LSAGYLIPVEMKMLGI;
SAGYLIPVEMKMLGIL; AGYLIPVEMKMLGILG;
GYLIPVEMKMLGILGL; YLIPVEMKMLGILGLS;
LIPVEMKMLGILGLSQ; IPVEMKMLGILGLSQE;
PVEMKMLGILGLSQEG; VEMKMLGILGLSQEGK;
EMKMLGILGLSQEGKM; MKMLGILGLSQEGKMF;
KMLGILGLSQEGKMFP; MLGILGLSQEGKMFPQ;
LGILGLSQEGKMFPQY; GILGLSQEGKMFPQYF;
ILGLSQEGKMFPQYFM; MNRVWGLFVKLIACMF;
NRVWGLFVKLIACMFQ; RVWGLFVKLIACMFQL;
VWGLFVKLIACMFQLL; WGLFVKLIACMFQLLI;
GLFVKLIACMFQLLIF; LFVKLIACMFQLLIFV;
FVKLIACMFQLLIFVA; VKLIACMFQLLIFVAC;
KLIACMFQLLIFVACL; LIACMFQLLIFVACLL;
IACMFQLLIFVACLLT; ACMFQLLIFVACLLTA;
CMFQLLIFVACLLTAL; MFQLLIFVACLLTALE;
FQLLIFVACLLTALEH; QLLIFVACLLTALEHN;
LLIFVACLLTALEHNS; LIFVACLLTALEHNSG;
IFVACLLTALEHNSGE; FVACLLTALEHNSGEA;
VACLLTALEHNSGEAL; ACLLTALEHNSGEALQ;
CLLTALEHNSGEALQD; LLTALEHNSGEALQDI;
LTALEHNSGEALQDIL; TALEHNSGEALQDILR;
ALEHNSGEALQDILRS; LEHNSGEALQDILRSA;
TGEPREWMGSLCMVWN; GEPREWMGSLCMVWNP;
EPREWMGSLCMVWNPR; KRLGCLMAQKDFQGTQ;
RLGCLMAQKDFQGTQI; DILTNRDNCKPKCFKQ;
ILTNRDNCKPKCFKQV; LTNRDNCKPKCFKQVL;
TNRDNCKPKCFKQVLL; NRDNCKPKCFKQVLLL;
RDNCKPKCFKQVLLLY; DNCKPKCFKQVLLLYI;
NCKPKCFKQVLLLYIY; CKPKCFKQVLLLYIYI;
MLLLYKPLLSLCYFGG; LLLYKPLLSLCYFGGG;
LLYKPLLSLCYFGGGV; LYKPLLSLCYFGGGVL;
YKPLLSLCYFGGGVLG; KPLLSLCYFGGGVLGL;
PLLSLCYFGGGVLGLL; LLSLCYFGGGVLGLLK;
LSLCYFGGGVLGLLKH; LWGSDLWESSAGAEVS;
WGSDLWESSAGAEVSE; GSDLWESSAGAEVSET;
SDLWESSAGAEVSETW; DLWESSAGAEVSETWE;
LWESSAGAEVSETWEE; WESSAGAEVSETWEEH;
ESSAGAEVSETWEEHC; SSAGAEVSETWEEHCD;
SAGAEVSETWEEHCDW; AGAEVSETWEEHCDWD;
GAEVSETWEEHCDWDS; AEVSETWEEHCDWDSV;
EVSETWEEHCDWDSVL; VSETWEEHCDWDSVLD;
SETWEEHCDWDSVLDP; ETWEEHCDWDSVLDPC;
TWEEHCDWDSVLDPCP; WEEHCDWDSVLDPCPE;
EEHCDWDSVLDPCPES; EHCDWDSVLDPCPESS;
HCDWDSVLDPCPESSV; CDWDSVLDPCPESSVS;
DWDSVLDPCPESSVSE; WDSVLDPCPESSVSES;
DSVLDPCPESSVSESS; SVLDPCPESSVSESSS;
VLDPCPESSVSESSSL; LDPCPESSVSESSSLV;
DPCPESSVSESSSLVI; PCPESSVSESSSLVIS;
CPESSVSESSSLVISR; PESSVSESSSLVISRI;
ESSVSESSSLVISRIH; SSVSESSSLVISRIHF;
SVSESSSLVISRIHFP; VSESSSLVISRIHFPM;
SESSSLVISRIHFPMH; ESSSLVISRIHFPMHI;
SSSLVISRIHFPMHIL; SSLVISRIHFPMHILY;
SLVISRIHFPMHILYF; LVISRIHFPMHILYFI;
VISRIHFPMHILYFIL; ISRIHFPMHILYFILE;
SRIHFPMHILYFILEK; RIHFPMHILYFILEKV;
IHFPMHILYFILEKVY; HFPMHILYFILEKVYI;
FPMHILYFILEKVYIL; PMHILYFILEKVYILI;
MHILYFILEKVYILIS; HILYFILEKVYILISE;
ILYFILEKVYILISES; LYFILEKVYILISESS;
YFILEKVYILISESSL; FILEKVYILISESSLS;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

ILEKVYILISESSLSF; LEKVYILISESSLSFH;
EKVYILISESSLSFHS; KVYILISESSLSFHST;
VYILISESSLSFHSTI; YILISESSLSFHSTIL;
ILISESSLSFHSTILD; LISESSLSFHSTILDC;
ISESSLSFHSTILDCI; SESSLSFHSTILDCIS;
ESSLSFHSTILDCISV; SSLSFHSTILDCISVA;
SLSFHSTILDCISVAK; LSFHSTILDCISVAKS;
SFHSTILDCISVAKSA; FHSTILDCISVAKSAT;
HSTILDCISVAKSATG; STILDCISVAKSATGL;
TILDCISVAKSATGLN; ILDCISVAKSATGLNQ;
LDCISVAKSATGLNQI; DCISVAKSATGLNQIS;
CISVAKSATGLNQISS; ISVAKSATGLNQISSS;
SVAKSATGLNQISSSN; VAKSATGLNQISSSNK;
AKSATGLNQISSSNKV; KSATGLNQISSSNKVI;
SATGLNQISSSNKVIP; ATGLNQISSSNKVIPL;
TGLNQISSSNKVIPLC; GLNQISSSNKVIPLCK;
LNQISSSNKVIPLCKI; NQISSSNKVIPLCKIL;
QISSSNKVIPLCKILF; ISSSNKVIPLCKILFS;
SSSNKVIPLCKILFSS; SSNKVIPLCKILFSSK;
SNKVIPLCKILFSSKN; NKVIPLCKILFSSKNS;
KVIPLCKILFSSKNSE; VIPLCKILFSSKNSEF;
IPLCKILFSSKNSEFC; PLCKILFSSKNSEFCK;
LCKILFSSKNSEFCKD; CKILFSSKNSEFCKDF;
KILFSSKNSEFCKDFL; ILFSSKNSEFCKDFLK;
LFSSKNSEFCKDFLKY; FSSKNSEFCKDFLKYI;
SSKNSEFCKDFLKYIL; SKNSEFCKDFLKYILG;
KNSEFCKDFLKYILGL; NSEFCKDFLKYILGLK;
SEFCKDFLKYILGLKS; EFCKDFLKYILGLKSI;
FCKDFLKYILGLKSIC; CKDFLKYILGLKSICL;
KDFLKYILGLKSICLT; DFLKYILGLKSICLTN;
FLKYILGLKSICLTNL; LKYILGLKSICLTNLA;
KYILGLKSICLTNLAC; YILGLKSICLTNLACR;
ILGLKSICLTNLACRV; LGLKSICLTNLACRVL;
GLKSICLTNLACRVLG; LKSICLTNLACRVLGT;
KSICLTNLACRVLGTG; SICLTNLACRVLGTGY;
ICLTNLACRVLGTGYS; CLTNLACRVLGTGYSF;
LTNLACRVLGTGYSFI; TNLACRVLGTGYSFIV;
NLACRVLGTGYSFIVT; LACRVLGTGYSFIVTK;
ACRVLGTGYSFIVTKP; CRVLGTGYSFIVTKPG;
RVLGTGYSFIVTKPGG; VLGTGYSFIVTKPGGN;
LGTGYSFIVTKPGGNI; GTGYSFIVTKPGGNIW;
TGYSFIVTKPGGNIWV; GYSFIVTKPGGNIWVL;
YSFIVTKPGGNIWVLL; SFIVTKPGGNIWVLLF;
FIVTKPGGNIWVLLFK; IVTKPGGNIWVLLFKC;
VTKPGGNIWVLLFKCF; TKPGGNIWVLLFKCFF;
KPGGNIWVLLFKCFFS; PGGNIWVLLFKCFFSK;
GGNIWVLLFKCFFSKF; GNIWVLLFKCFFSKFT;
NIWVLLFKCFFSKFTL; IWVLLFKCFFSKFTLT;
WVLLFKCFFSKFTLTL; VLLFKCFFSKFTLTLP;
LLFKCFFSKFTLTLPS; LFKCFFSKFTLTLPSK;
SLKLSKLFIPCPEGKS; LKLSKLFIPCPEGKSF;
KLSKLFIPCPEGKSFD; LSKLFIPCPEGKSFDS;
SKLFIPCPEGKSFDSA; KLFIPCPEGKSFDSAP;
LFIPCPEGKSFDSAPV; FIPCPEGKSFDSAPVP;
IPCPEGKSFDSAPVPF; PCPEGKSFDSAPVPFT;
CPEGKSFDSAPVPFTS; PEGKSFDSAPVPFTSS;
EGKSFDSAPVPFTSSK; GKSFDSAPVPFTSSKT;
KSFDSAPVPFTSSKTT; SFDSAPVPFTSSKTTM;
FDSAPVPFTSSKTTMY; SIATPSSKVSLSMGRF;
IATPSSKVSLSMGRFT; ATPSSKVSLSMGRFTF;
TPSSKVSLSMGRFTFK; PSSKVSLSMGRFTFKA;
SSKVSLSMGRFTFKAL; SKVSLSMGRFTFKALP;
KVSLSMGRFTFKALPP; VSLSMGRFTFKALPPH;
SLSMGRFTFKALPPHK; LSMGRFTFKALPPHKS;
SMGRFTFKALPPHKSN; MGRFTFKALPPHKSNN;
GRFTFKALPPHKSNNP; RFTFKALPPHKSNNPA;
FTFKALPPHKSNNPAA; TFKALPPHKSNNPAAS;
FKALPPHKSNNPAASV; KALPPHKSNNPAASVV;
ALPPHKSNNPAASVVF; LPPHKSNNPAASVVFP;
PPHKSNNPAASVVFPL; PHKSNNPAASVVFPLS;
HKSNNPAASVVFPLSM; KSNNPAASVVFPLSMG;
SNNPAASVVFPLSMGP; NNPAASVVFPLSMGPL;
NPAASVVFPLSMGPLN; PAASVVFPLSMGPLNN;
AASVVFPLSMGPLNNQ; ASVVFPLSMGPLNNQY;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

SVVFPLSMGPLNNQYL; VVFPLSMGPLNNQYLL;
VFPLSMGPLNNQYLLL; FPLSMGPLNNQYLLLG;
PLSMGPLNNQYLLLGT; LSMGPLNNQYLLLGTL;
SMGPLNNQYLLLGTLK; MGPLNNQYLLLGTLKT;
GPLNNQYLLLGTLKTI; PLNNQYLLLGTLKTIQ;
LNNQYLLLGTLKTIQC; NNQYLLLGTLKTIQCK;
NQYLLLGTLKTIQCKK; QYLLLGTLKTIQCKKS;
YLLLGTLKTIQCKKSN; LLLGTLKTIQCKKSNI;
LLGTLKTIQCKKSNIT; LGTLKTIQCKKSNITE;
GTLKTIQCKKSNITES; TLKTIQCKKSNITESI;
LKTIQCKKSNITESIL; KTIQCKKSNITESILG;
TIQCKKSNITESILGS; IQCKKSNITESILGSK;
QCKKSNITESILGSKQ; CKKSNITESILGSKQC;
KKSNITESILGSKQCS; KSNITESILGSKQCSQ;
SNITESILGSKQCSQA; NITESILGSKQCSQAT;
ITESILGSKQCSQATP; TESILGSKQCSQATPA;
ESILGSKQCSQATPAI; SILGSKQCSQATPAIY;
ILGSKQCSQATPAIYC; LGSKQCSQATPAIYCS;
GSKQCSQATPAIYCSS; SKQCSQATPAIYCSST;
KQCSQATPAIYCSSTA; QCSQATPAIYCSSTAF;
CSQATPAIYCSSTAFP; NSKYIPNNKNTSSHFV;
SKYIPNNKNTSSHFVS; KYIPNNKNTSSHFVST;
YIPNNKNTSSHFVSTA; IPNNKNTSSHFVSTAY;
PNNKNTSSHFVSTAYS; NNKNTSSHFVSTAYSV;
NKNTSSHFVSTAYSVI; KNTSSHFVSTAYSVIN;
NTSSHFVSTAYSVINF; TSSHFVSTAYSVINFQ;
SSHFVSTAYSVINFQD; SHFVSTAYSVINFQDT;
HFVSTAYSVINFQDTC; FVSTAYSVINFQDTCF;
VSTAYSVINFQDTCFV; STAYSVINFQDTCFVS;
TAYSVINFQDTCFVSS; AYSVINFQDTCFVSSG;
YSVINFQDTCFVSSGS; SVINFQDTCFVSSGSS;
VINFQDTCFVSSGSSG; INFQDTCFVSSGSSGL;
NFQDTCFVSSGSSGLK; FQDTCFVSSGSSGLKS;
QDTCFVSSGSSGLKSC; DTCFVSSGSSGLKSCS;
TCFVSSGSSGLKSCSF; CFVSSGSSGLKSCSFK;
FVSSGSSGLKSCSFKP; VSSGSSGLKSCSFKPP;
MLSSIVWYGSLVKALY; LSSIVWYGSLVKALYS;
SSIVWYGSLVKALYSK; SIVWYGSLVKALYSKY;
IVWYGSLVKALYSKYS; VWYGSLVKALYSKYSL;
WYGSLVKALYSKYSLL; YGSLVKALYSKYSLLT;
GSLVKALYSKYSLLTP; SLVKALYSKYSLLTPL;
LVKALYSKYSLLTPLQ; VKALYSKYSLLTPLQI;
KALYSKYSLLTPLQIK; ALYSKYSLLTPLQIKK;
LYSKYSLLTPLQIKKL; YSKYSLLTPLQIKKLK;
SKYSLLTPLQIKKLKV; KYSLLTPLQIKKLKVH;
YSLLTPLQIKKLKVHS; SLLTPLQIKKLKVHSF;
QKLLIAETLCLCGVKK; KLLIAETLCLCGVKKN;
LLIAETLCLCGVKKNI; LIAETLCLCGVKKNII;
IAETLCLCGVKKNIIL; AETLCLCGVKKNIILC;
ETLCLCGVKKNIILCP; TLCLCGVKKNIILCPA;
LCLCGVKKNIILCPAH; CLCGVKKNIILCPAHM;
LCGVKKNIILCPAHMC; CGVKKNIILCPAHMCL;
GVKKNIILCPAHMCLL; VKKNIILCPAHMCLLI;
KKNIILCPAHMCLLIK; KNIILCPAHMCLLIKV;
NIILCPAHMCLLIKVT; IILCPAHMCLLIKVTE;
ILCPAHMCLLIKVTEY; LCPAHMCLLIKVTEYF;
CPAHMCLLIKVTEYFS; PAHMCLLIKVTEYFSI;
AHMCLLIKVTEYFSIS; HMCLLIKVTEYFSISF;
MCLLIKVTEYFSISFL; CLLIKVTEYFSISFLY;
LLIKVTEYFSISFLYR; LIKVTEYFSISFLYRI;
APFSLVVYTAKQARVLL; FSLVVYTAKQARVLLL;
SLVVYTAKQARVLLLN; LVVYTAKQARVLLLNT;
VVYTAKQARVLLLNTA; LRNWCRSEGKSLGSST;
RNWCRSEGKSLGSSTF; NWCRSEGKSLGSSTFL;
WCRSEGKSLGSSTFLF; CRSEGKSLGSSTFLFF;
RSEGKSLGSSTFLFFL; SEGKSLGSSTFLFFLG;
EGKSLGSSTFLFFLGG; GKSLGSSTFLFFLGGV;
KSLGSSTFLFFLGGVE; SLGSSTFLFFLGGVEC;
ESAVASSSLANISSWQ; SAVASSSLANISSWQN;
AVASSSLANISSWQNK; VASSSLANISSWQNKS;
ASSSLANISSWQNKSS; SSSLANISSWQNKSSS;
SSLANISSWQNKSSSH; SLANISSWQNKSSSHF;
LANISSWQNKSSSHFS; ANISSWQNKSSSHFSL;
NISSWQNKSSSHFSLK; ISSWQNKSSSHFSLKE;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

SSWQNKSSSHFSLKEL; SWQNKSSSHFSLKELH;
WQNKSSSHFSLKELHQ; QNKSSSHFSLKELHQD;
NKSSSHFSLKELHQDS; KSSSHFSLKELHQDSH;
SSSHFSLKELHQDSHS; SSHFSLKELHQDSHSS;
SHFSLKELHQDSHSSV; HFSLKELHQDSHSSVP;
VGTYKKNNYLGPFNIL; GTYKKNNYLGPFNILL;
TYKKNNYLGPFNILLF; YKKNNYLGPFNILLFI;
REFLQLFGPTIAEFLQ; EFLQLFGPTIAEFLQL;
FLQLFGPTIAEFLQLG; LQLFGPTIAEFLQLGL;
QLFGPTIAEFLQLGLS; LFGPTIAEFLQLGLSQ;
FGPTIAEFLQLGLSQT; GPTIAEFLQLGLSQTT;
PTIAEFLQLGLSQTTV; SSQCSSNLSKPRALFL;
SQCSSNLSKPRALFLK; QCSSNLSKPRALFLKI;
CSSNLSKPRALFLKIF; SSNLSKPRALFLKIFY;
SNLSKPRALFLKIFYL; NLSKPRALFLKIFYLN;
LSKPRALFLKIFYLNA; SKPRALFLKIFYLNAL;
KPRALFLKIFYLNALI; ADIACKGSAQKAFWNK;
AIPCSTGYLGKEENQH; IPCSTGYLGKEENQHK;
PCSTGYLGKEENQHKP; CSTGYLGKEENQHKPL;
STGYLGKEENQHKPLS; TGYLGKEENQHKPLSY;
GYLGKEENQHKPLSYS; YLGKEENQHKPLSYSR;
LGKEENQHKPLSYSRF; GKEENQHKPLSYSRFQ;
KEENQHKPLSYSRFQN; EENQHKPLSYSRFQNQ;
ENQHKPLSYSRFQNQA; NQHKPLSYSRFQNQAD;
QHKPLSYSRFQNQADE; HKPLSYSRFQNQADEL;
KPLSYSRFQNQADELP; PLSYSRFQNQADELPL;
LSYSRFQNQADELPLH; SYSRFQNQADELPLHP;
YSRFQNQADELPLHPA; SRFQNQADELPLHPAP;
RFQNQADELPLHPAPF; FQNQADELPLHPAPFF;
QNQADELPLHPAPFFY; NQADELPLHPAPFFYT;
QADELPLHPAPFFYTK; ADELPLHPAPFFYTKY;
DELPLHPAPFFYTKYS; ELPLHPAPFFYTKYSF;
LPLHPAPFFYTKYSFS; PLHPAPFFYTKYSFSS;
LHPAPFFYTKYSFSSF; HPAPFFYTKYSFSSFY;
PAPFFYTKYSFSSFYP; APFFYTKYSFSSFYPR;
PFFYTKYSFSSFYPRR; FFYTKYSFSSFYPRRP;
FYTKYSFSSFYPRRPL; YTKYSFSSFYPRRPLC;
TKYSFSSFYPRRPLCQ; KYSFSSFYPRRPLCQG;
YSFSSFYPRRPLCQGE; SFSSFYPRRPLCQGEI;
FSSFYPRRPLCQGEIP; SSFYPRRPLCQGEIPY;
SFYPRRPLCQGEIPYT; FYPRRPLCQGEIPYTS;
YPRRPLCQGEIPYTSL; PRRPLCQGEIPYTSLN;
RRPLCQGEIPYTSLNK; RPLCQGEIPYTSLNKL;
PLCQGEIPYTSLNKLF; LCQGEIPYTSLNKLFS;
CQGEIPYTSLNKLFSL; QGEIPYTSLNKLFSLR;
GEIPYTSLNKLFSLRE; EIPYTSLNKLFSLRED;
IPYTSLNKLFSLREDF; PYTSLNKLFSLREDFP;
YTSLNKLFSLREDFPR; TSLNKLFSLREDFPRQ;
SLNKLFSLREDFPRQL; LNKLFSLREDFPRQLF;
NKLFSLREDFPRQLFQ; KLFSLREDFPRQLFQG;
LFSLREDFPRQLFQGL; FSLREDFPRQLFQGLK;
SLREDFPRQLFQGLKG; LREDFPRQLFQGLKGP;

BK virus, reading frame 3

13 mers:

ASEKASTPLLLER; SEKASTPLLLERK; EKASTPLLLERKG;
KASTPLLLERKGG; ASTPLLLERKGGG; STPLLLERKGGGR;
TPLLLERKGGGRG; PLLLERKGGGRGG; LLLERKGGGRGGL;
LLERKGGGRGGLG; LERKGGGRGGLGL; ERKGGGRGGLGLL;
RKGGGRGGLGLLY; KGGGRGGLGLLYI; GGGRGGLGLLYII;
GGRGGLGLLYIIK; GRGGLGLLYIIKK; RGGLGLLYIIKKK;
GGLLLYIIKKKA; GLGLLYIIKKAT; LGLLYIIKKKATG;
GLLYIIKKKATGR; LLYIIKKKATGRS; LYIIKKKATGRSC;
YIIKKKATGRSCL; IIKKKATGRSCLP; IKKKATGRSCLPM;
KKKATGRSCLPME; KKATGRSCLPMEC; KATGRSCLPMECS;
ATGRSCLPMECSQ; TGRSCLPMECSQT; GRSCLPMECSQTM;
RSCLPMECSQTMT; SCLPMECSQTMTS; CLPMECSQTMTSG;
LPMECSQTMTSGR; PMECSQTMTSGRK; MECSQTMTSGRKV;
ECSQTMTSGRKVH; CSQTMTSGRKVHD; SQTMTSGRKVHDS;
QTMTSGRKVHDSQ; TMTSGRKVHDSQG; MTSGRKVHDSQGN;
TSGRKVHDSQGNA; SGRKVHDSQGNAA; GRKVHDSQGNAAK;

TABLE O-continued

Predicted MHC class 2 BK virus peptide sequences. Prediction of 13-, 14-, 15-, 16-mers from all 6 reading frames of the genome (access no #V01108) obtained using the program displayed in FIG. 2.

RKVHDSQGNAAKP; PQEGKCMTHREEL; QEGKCMTHREELL;
EGKCMTHREELLT; GKCMTHREELLTH; KCMTHREELLTHG;
CMTHREELLTHGM; MTHREELLTHGMQ; THREELLTHGMQP;
HREELLTHGMQPN; REELLTHGMQPNH; EELLTHGMQPNHD;
ELLTHGMQPNHDL; LLTHGMQPNHDLR; LTHGMQPNHDLRK;
THGMQPNHDLRKE; HGMQPNHDLRKES; GMQPNHDLRKESA;
QTCFASLGILALS; TCFASLGILALSP; CFASLGILALSPV;
FASLGILALSPVK; ASLGILALSPVKL; SLGILALSPVKLD;
LGILALSPVKLDK; GILALSPVKLDKG; ILALSPVKLDKGH;
LALSPVKLDKGHG; ALSPVKLDKGHGS; LSPVKLDKGHGSA;
SPVKLDKGHGSAP; PVKLDKGHGSAPA; VKLDKGHGSAPAV;
KLDKGHGSAPAVT; LDKGHGSAPAVTT; DKGHGSAPAVTTS;
KGHGSAPAVTTSF; GHGSAPAVTTSFS; HGSAPAVTTSFSE;
GSAPAVTTSFSES; SAPAVTTSFSESW; NLDWNKKKSSEDF;
LDWNKKKSSEDFY; DWNKKKSSEDFYF; WNKKKSSEDFYFY;
NKKKSSEDFYFYF; KKKSSEDFYFYFR; KKSSEDFYFYFRA;
KSSEDFYFYFRAF; SSEDFYFYFRAFA; SEDFYFYFRAFAG;
EDFYFYFRAFAGI; DFYFYFRAFAGIL; RQCRREKQKYHCF;
QCRREKQKYHCFT; CRREKQKYHCFTC; RREKQKYHCFTCC;
REKQKYHCFTCCK; EKQKYHCFTCCKR; KQKYHCFTCCKRL;
QKYHCFTCCKRLC; KYHCFTCCKRLCK; YHCFTCCKRLCKR;
HCFTCCKRLCKRL; CFTCCKRLCKRLL; FTCCKRLCKRLLG;
TCCKRLCKRLLGK; SLFFCISRFMGAA; LFFCISRFMGAAL;
FFCISRFMGAALA; FCISRFMGAALAL; CISRFMGAALALL;
ISRFMGAALALLG; SRFMGAALALLGD; RFMGAALALLGDL;
FMGAALALLGDLV; MGAALALLGDLVA; GAALALLGDLVAS;
AALALLGDLVASV; ALALLGDLVASVS; LALLGDLVASVSE;
ALLGDLVASVSEA; LLGDLVASVSEAA; LGDLVASVSEAAA;
GDLVASVSEAAAA; DLVASVSEAAAAT; LVASVSEAAAATG;
VASVSEAAAATGF; ASVSEAAAATGFS; SVSEAAAATGFSV;
VSEAAAATGFSVA; SEAAAATGFSVAE; EAAAATGFSVAEI;
AAAATGFSVAEIA; AAATGFSVAEIAA; AATGFSVAEIAAG;
ATGFSVAEIAAGE; TGFSVAEIAAGEA; GFSVAEIAAGEAA;
FSVAEIAAGEAAA; SVAEIAAGEAAAA; VAEIAAGEAAAAI;
AEIAAGEAAAAIE; EIAAGEAAAAIEV; IAAGEAAAAIEVQ;
AAGEAAAAIEVQI; AGEAAAAIEVQIA; GEAAAAIEVQIAS;
EAAAAIEVQIASL; AAAAIEVQIASLA; AAAIEVQIASLAT;
AAIEVQIASLATV; AIEVQIASLATVE; IEVQIASLATVEG;
EVQIASLATVEGI; VQIASLATVEGIT; QIASLATVEGITS;
IASLATVEGITST; ASLATVEGITSTS; SLATVEGITSTSE;
LATVEGITSTSEA; ATVEGITSTSEAI; TVEGITSTSEAIA;
VEGITSTSEAIAA; EGITSTSEAIAAI; GITSTSEAIAAIG;
ITSTSEAIAAIGL; TSTSEAIAAIGLT; STSEAIAAIGLTP;
TSEAIAAIGLTPQ; SEAIAAIGLTPQT; EAIAAIGLTPQTY;
AIAAIGLTPQTYA; IAAIGLTPQTYAV; AAIGLTPQTYAVI;
AIGLTPQTYAVIA; IGLTPQTYAVIAG; GLTPQTYAVIAGA;
LTPQTYAVIAGAP; TPQTYAVIAGAPG; PQTYAVIAGAPGA;
QTYAVIAGAPGAI; TYAVIAGAPGAIA; YAVIAGAPGAIAG;
AVIAGAPGAIAGF; VIAGAPGAIAGFA; IAGAPGAIAGFAA;
AGAPGAIAGFAAL; GAPGAIAGFAALI; APGAIAGFAALIQ;
PGAIAGFAALIQT; GAIAGFAALIQTV; AIAGFAALIQTVS;
IAGFAALIQTVSG; AGFAALIQTVSGI; GFAALIQTVSGIS;
FAALIQTVSGISS; AALIQTVSGISSL; ALIQTVSGISSLA;
LIQTVSGISSLAQ; IQTVSGISSLAQV; QTVSGISSLAQVG;
TVSGISSLAQVGY; VSGISSLAQVGYK; SGISSLAQVGYKF;
GISSLAQVGYKFF; ISSLAQVGYKFFD; SSLAQVGYKFFDD;
SLAQVGYKFFDDW; LAQVGYKFFDDWD; AQVGYKFFDDWDH;
QVGYKFFDDWDHK; VGYKFFDDWDHKV; GYKFFDDWDHKVS;
YKFFDDWDHKVST; KFFDDWDHKVSTV; FFDDWDHKVSTVG;
FDDWDHKVSTVGL; DDWDHKVSTVGLY; DWDHKVSTVGLYQ;
WDHKVSTVGLYQQ; DHKVSTVGLYQQS; HKVSTVGLYQQSG;
KVSTVGLYQQSGM; VSTVGLYQQSGMA; STVGLYQQSGMAL;
TVGLYQQSGMALE; VGLYQQSGMALEL; GLYQQSGMALELF;
LYQQSGMALELFN; YQQSGMALELFNP; QQSGMALELFNPD;
QSGMALELFNPDE; SGMALELFNPDEY; GMALELFNPDEYY;
MALELFNPDEYYD; ALELFNPDEYYDI; LELFNPDEYYDIL;
ELFNPDEYYDILF; LFNPDEYYDILFP; FNPDEYYDILFPG;
NPDEYYDILFPGV; PDEYYDILFPGVN; DEYYDILFPGVNT;
EYYDILFPGVNTF; YYDILFPGVNTFV; YDILFPGVNTFVN;
DILFPGVNTFVNN; ILFPGVNTFVNNI; LFPGVNTFVNNIQ;
FPGVNTFVNNIQY; PGVNTFVNNIQYL; GVNTFVNNIQYLD;
VNTFVNNIQYLDP; NTFVNNIQYLDPR; TFVNNIQYLDPRH;
FVNNIQYLDPRHW; VNNIQYLDPRHWG; NNIQYLDPRHWGP;
NIQYLDPRHWGPS; IQYLDPRHWGPSL; QYLDPRHWGPSLF;
YLDPRHWGPSLFA; LDPRHWGPSLFAT; DPRHWGPSLFATI;
PRHWGPSLFATIS; RHWGPSLFATISQ; HWGPSLFATISQA;
WGPSLFATISQAL; GPSLFATISQALW; PSLFATISQALWH;
SLFATISQALWHV; LFATISQALWHVI; FATISQALWHVIR;
ATISQALWHVIRD; TISQALWHVIRDD; ISQALWHVIRDDI;
SQALWHVIRDDIP; QALWHVIRDDIPS; ALWHVIRDDIPSI;
LWHVIRDDIPSIT; WHVIRDDIPSITS; HVIRDDIPSITSQ;
VIRDDIPSITSQE; IRDDIPSITSQEL; RDDIPSITSQELQ;
DDIPSITSQELQR; DIPSITSQELQRR; IPSITSQELQRRT;
PSITSQELQRRTE; SITSQELQRRTER; ITSQELQRRTERF;
TSQELQRRTERFF; SQELQRRTERFFR; QELQRRTERFFRD;
ELQRRTERFFRDS; LQRRTERFFRDSL; QRRTERFFRDSLA;
RRTERFFRDSLAR; RTERFFRDSLARF; TERFFRDSLARFL;
ERFFRDSLARFLE; RFFRDSLARFLEE; FFRDSLARFLEET;
FRDSLARFLEETT; RDSLARFLEETTW; DSLARFLEETTWT;
SLARFLEETTWTI; LARFLEETTWTIV; ARFLEETTWTIVN;
RFLEETTWTIVNA; FLEETTWTIVNAP; LEETTWTIVNAPI;
EETTWTIVNAPIN; ETTWTIVNAPINF; TTWTIVNAPINFY;
TWTIVNAPINFYN; WTIVNAPINFYNY; TIVNAPINFYNYI;
IVNAPINFYNYIQ; VNAPINFYNYIQQ; NAPINFYNYIQQY;
APINFYNYIQQYY; PINFYNYIQQYYS; INFYNYIQQYYSD;
NFYNYIQQYYSDL; FYNYIQQYYSDLS; YNYIQQYYSDLSP;
NYIQQYYSDLSPI; YIQQYYSDLSPIR; IQQYYSDLSPIRP;
QQYYSDLSPIRPS; QYYSDLSPIRPSM; YYSDLSPIRPSMV;
YSDLSPIRPSMVR; SDLSPIRPSMVRQ; DLSPIRPSMVRQV;
LSPIRPSMVRQVA; SPIRPSMVRQVAE; PIRPSMVRQVAER;
IRPSMVRQVAERE; RPSMVRQVAEREG; PSMVRQVAEREGT;
SMVRQVAEREGTR; MVRQVAEREGTRV; VRQVAEREGTRVH;
RQVAEREGTRVHF; QVAEREGTRVHFG; VAEREGTRVHFGH;
AEREGTRVHFGHT; EREGTRVHFGHTY; REGTRVHFGHTYS;
EGTRVHFGHTYSI; GTRVHFGHTYSID; TRVHFGHTYSIDD;
RVHFGHTYSIDDA; VHFGHTYSIDDAD; HFGHTYSIDDADS;
FGHTYSIDDADSI; GHTYSIDDADSIE; HTYSIDDADSIEE;
TYSIDDADSIEEV; YSIDDADSIEEVT; SIDDADSIEEVTQ;
IDDADSIEEVTQR; DDADSIEEVTQRM; DADSIEEVTQRMD;
ADSIEEVTQRMDL; DSIEEVTQRMDLR; SIEEVTQRMDLRN;
IEEVTQRMDLRNQ; EEVTQRMDLRNQQ; EVTQRMDLRNQQS;
VTQRMDLRNQQSV; TQRMDLRNQQSVH; QRMDLRNQQSVHS;
RMDLRNQQSVHSG; MDLRNQQSVHSGE; DLRNQQSVHSGEF;
LRNQQSVHSGEFI; RNQQSVHSGEFIE; NQQSVHSGEFIEK;
QQSVHSGEFIEKT; QSVHSGEFIEKTI; SVHSGEFIEKTIA;
VHSGEFIEKTIAP; HSGEFIEKTIAPG; SGEFIEKTIAPGG;
GEFIEKTIAPGGA; EFIEKTIAPGGAN; FIEKTIAPGGANQ;
IEKTIAPGGANQR; EKTIAPGGANQRT; KTIAPGGANQRTA;
TIAPGGANQRTAP; IAPGGANQRTAPQ; APGGANQRTAPQW;
PGGANQRTAPQWM; GGANQRTAPQWML; GANQRTAPQWMLP;
ANQRTAPQWMLPL; NQRTAPQWMLPLL; QRTAPQWMLPLLL;
RTAPQWMLPLLLG; TAPQWMLPLLLGL; APQWMLPLLLGLY;
PQWMLPLLLGLYG; QWMLPLLLGLYGT; WMLPLLLGLYGTV;
MLPLLLGLYGTVT; LPLLLGLYGTVTP; PLLLGLYGTVTPA;
LLLGLYGTVTPAL; LLGLYGTVTPALE; LGLYGTVTPALEA;
GLYGTVTPALEAY; LYGTVTPALEAYE; YGTVTPALEAYED;
GTVTPALEAYEDG; TVTPALEAYEDGP; VTPALEAYEDGPN;
TPALEAYEDGPNQ; PALEAYEDGPNQK; ALEAYEDGPNQKK;
LEAYEDGPNQKKR; EAYEDGPNQKKRR; AYEDGPNQKKRRV;
YEDGPNQKKRRVS; EDGPNQKKRRVSR; DGPNQKKRRVSRG;
GPNQKKRRVSRGS; PNQKKRRVSRGSS; NQKKRRVSRGSSQ;
QKKRRVSRGSSQK; KKRRVSRGSSQKA; KRRVSRGSSQKAK;
RRVSRGSSQKAKG; RVSRGSSQKAKGT; VSRGSSQKAKGTR;
SRGSSQKAKGTRA; RGSSQKAKGTRAS; GSSQKAKGTRASA;
SSQKAKGTRASAK; SQKAKGTRASAKT; QKAKGTRASAKTT;
KAKGTRASAKTTN; AKGTRASAKTTNK; KGTRASAKTTNKR;
GTRASAKTTNKRR; TRASAKTTNKRRS; RASAKTTNKRRSR;
ASAKTTNKRRSRS; SAKTTNKRRSRSS; AKTTNKRRSRSSR;
KTTNKRRSRSSRS; NWGRCYYRGRMLP; WGRCYYRGRMLPK;
GRCYYRGRMLPKP; RCYYRGRMLPKPR; CYYRGRMLPKPRN;
YYRGRMLPKPRNG; YRGRMLPKPRNGG; RGRMLPKPRNGGS;
GRMLPKPRNGGSR; PREKNASLLQHSK; REKNASLLQHSKN;
EKNASLLQHSKNS; KNASLLQHSKNSP; NASLLQHSKNSPP;
ASLLQHSKNSPPQ; SLLQHSKNSPPQF; LLQHSKNSPPQFK;
GPNLWKSTDVGGC; PNLWKSTDVGGCN; NLWKSTDVGGCNC;
LWKSTDVGGCNCT; WKSTDVGGCNCTN; KSTDVGGCNCTNR;
STDVGGCNCTNRG; TDVGGCNCTNRGY; DVGGCNCTNRGYW;
VGGCNCTNRGYWN; GGCNCTNRGYWNN; FPLLCCRWRTLGN;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

PLLCCRWRTLGNA; LLCCRWRTLGNAG; LCCRWRTLGNAGS;
CCRWRTLGNAGSA; CRWRTLGNAGSAN; RWRTLGNAGSANE;
WRTLGNAGSANEL; RTLGNAGSANELQ; TLGNAGSANELQV;
LGNAGSANELQVK; GNAGSANELQVKV; NAGSANELQVKVP;
VFWDFHRRGKCSP; FWDFHRRGKCSPS; WDFHRRGKCSPST;
DFHRRGKCSPSTS; FHRRGKCSPSTSC; HRRGKCSPSTSCD;
RRGKCSPSTSCDQ; RGKCSPSTSCDQH; GKCSPSTSCDQHS;
KCSPSTSCDQHSY; CSPSTSCDQHSYH; SPSTSCDQHSYHS;
PSTSCDQHSYHSV; STSCDQHSYHSVA; TSCDQHSYHSVAR;
QLWNTTVERPCKI; LWNTTVERPCKIF; DPPEKKICKESLP;
PPEKKICKESLPN; PEKKICKESLPNF; EKKICKESLPNFL;
KKICKESLPNFLF; KICKESLPNFLFA; ICKESLPNFLFAK;
PYKQENPESGWAA; YKQENPESGWAAY; KQENPESGWAAYV;
QENPESGWAAYVW; ENPESGWAAYVWY; NPESGWAAYVWYG;
PESGWAAYVWYGI; ESGWAAYVWYGIP; SGWAAYVWYGIPG;
GWAAYVWYGIPGR; WAAYVWYGIPGRR; AAYVWYGIPGRRG;
WHRKTSRGPRYDK; HRKTSRGPRYDKI; RKTSRGPRYDKIY;
QTGTIANQNALNR; TGTIANQNALNRC; GTIANQNALNRCF;
TIANQNALNRCFY; IANQNALNRCFYC; ANQNALNRCFYCT;
NQNALNRCFYCTY; QNALNRCFYCTYT; NALNRCFYCTYTF;
ALNRCFYCTYTFN; LNRCFYCTYTFNK; NRCFYCTYTFNKC;
RCFYCTYTFNKCC; CFYCTYTFNKCCF; FYCTYTFNKCCFC;
YCTYTFNKCCFCI; CTYTFNKCCFCIS; TYTFNKCCFCISH;
YTFNKCCFCISHF; NTESLYTNATLDY; TESLYTNATLDYG;
ESLYTNATLDYGG; SLYTNATLDYGGL; LYTNATLDYGGLT;
YTNATLDYGGLTF; TNATLDYGGLTFG; NATLDYGGLTFGN;
ATLDYGGLTFGNL; TLDYGGLTFGNLQ; LDYGGLTFGNLQQ;
DYGGLTFGNLQQG; YGGLTFGNLQQGL; GGLTFGNLQQGLK;
GLTFGNLQQGLKY; LTFGNLQQGLKYL; TFGNLQQGLKYLR;
FGNLQQGLKYLRL; GNLQQGLKYLRLG; NLQQGLKYLRLGK;
LQQGLKYLRLGKS; QQGLKYLRLGKSI; QGLKYLRLGKSIV;
GLKYLRLGKSIVI; LKYLRLGKSIVIG; KYLRLGKSIVIGI;
YLRLGKSIVIGIQ; LRLGKSIVIGIQC; RLGKSIVIGIQCL;
LGKSIVIGIQCLI; GKSIVIGIQCLIH; KSIVIGIQCLIHV;
SIVIGIQCLIHVQ; IVIGIQCLIHVQS; VIGIQCLIHVQSL;
IGIQCLIHVQSLQ; GIQCLIHVQSLQF; IQCLIHVQSLQFL;
QCLIHVQSLQFLN; CLIHVQSLQFLNP; LIHVQSLQFLNPL;
IHVQSLQFLNPLL; HVQSLQFLNPLLL; YQEYISPCIYYIS;
QEYISPCIYYISS; EYISPCIYYISSL; YISPCIYYISSLK;
ISPCIYYISSLKK; SPCIYYISSLKKY; PCIYYISSLKKYT;
CIYYISSLKKYTY; IYYISSLKKYTYL; YYISSLKKYTYLS;
YISSLKKYTYLSQ; ISSLKKYTYLSQN; SSLKKYTYLSQNP;
SLKKYTYLSQNPA; LKKYTYLSQNPAF; KKYTYLSQNPAFP;
KYTYLSQNPAFPS; YTYLSQNPAFPSI; TYLSQNPAFPSIQ;
YLSQNPAFPSIQQ; LSQNPAFPSIQQF; TKLAVATRSFHFV;
KLAVATRSFHFVK; LAVATRSFHFVKF; AVATRSFHFVKFF;
VATRSFHFVKFFF; ATRSFHFVKFFFQ; TRSFHFVKFFFQV;
RSFHFVKFFFQVR; SFHFVKFFFQVRT; FHFVKFFFQVRTL;
HFVKFFFQVRTLS; FVKFFFQVRTLSF; VKFFFQVRTLSFV;
KFFFQVRTLSFVR; FFFQVRTLSFVRI; FFQVRTLSFVRIF;
FQVRTLSFVRIFL; QVRTLSFVRIFLN; VRTLSFVRIFLNI;
RTLSFVRIFLNIF; TLSFVRIFLNIFW; LSFVRIFLNIFWA;
PSLVEIFGFFCLN; SLVEIFGFFCLNV; LVEIFGFFCLNVS;
VEIFGFFCLNVSF; EIFGFFCLNVSFL; IFGFFCLNVSFLN;
FGFFCLNVSFLNL; GFFCLNVSFLNLP; HFHLNNLSNCLNC;
FHLNNLSNCLNCL; HLNNLSNCLNCLF; LNNLSNCLNCLFH;
NNLSNCLNCLFHV; NLSNCLNCLFHVL; LSNCLNCLFHVLK;
SNCLNCLFHVLKA; NCLNCLFHVLKAN; CLNCLFHVLKANP;
LNCLFHVLKANPL; NCLFHVLKANPLI; CLFHVLKANPLIQ;
LFHVLKANPLIQL; FHVLKANPLIQLL; HVLKANPLIQLLS;
VLKANPLIQLLSL; LKANPLIQLLSLL; KANPLIQLLSLLH;
ANPLIQLLSLLHL; NPLIQLLSLLHLQ; PLIQLLSLLHLQK;
LIQLLSLLHLQKQ; IQLLSLLHLQKQP; QLLSLLHLQKQPC;
LLSLLHLQKQPCT; LSLLHLQKQPCTD; SLLHLQKQPCTDL;
LHLAQRLAFPWVG; HLAQRLAFPWVGL; LAQRLAFPWVGLH;
AQRLAFPWVGLHL; QRLAFPWVGLHLR; RLAFPWVGLHLRL;
LAFPWVGLHLRLY; AFPWVGLHLRLYH; FPWVGLHLRLYHH;
PWVGLHLRLYHHT; WVGLHLRLYHHTN; VGLHLRLYHHTNL;
GLHLRLYHHTNLI; LHLRLYHHTNLIT; HLRLYHHTNLITL;
LRLYHHTNLITLQ; RLYHHTNLITLQL; LYHHTNLITLQLV;
YHHTNLITLQLVL; HHTNLITLQLVLF; HTNLITLQLVLFF;
TNLITLQLVLFFH; NLITLQLVLFFHY; LITLQLVLFFHYQ;
ITLQLVLFFHYQW; TLQLVLFFHYQWD; LQLVLFFHYQWDL;
KQYSAKNQILQNP; QYSAKNQILQNPF; VANSAAKQHLPYI;

ANSAAKQHLPYIV; NSAAKQHLPYIVL; SAAKQHLPYIVLV;
AAKQHLPYIVLVQ; AKQHLPYIVLVQH; KQHLPYIVLVQHF;
QHLPYIVLVQHFH; HLPYIVLVQHFHE; LPYIVLVQHFHEL;
PYIVLVQHFHELQ; YIVLVQHFHELQI; IVLVQHFHELQIL;
VLVQHFHELQILN; LVQHFHELQILNP; VQHFHELQILNPF;
QHFHELQILNPFY; HFHELQILNPFYL; FHELQILNPFYLI;
HELQILNPFYLIY; ELQILNPFYLIYD; IFLLAFLPWSYEG;
FLLAFLPWSYEGY; LLAFLPWSYEGYL; LAFLPWSYEGYLL;
AFLPWSYEGYLLF; FLPWSYEGYLLFF; LKLYLLLADKYFF;
KLYLLLADKYFFD; LYLLLADKYFFDF; YLLLADKYFFDFY;
LLLADKYFFDFYF; LLADKYFFDFYFL; LADKYFFDFYFLQ;
ADKYFFDFYFLQK; SDKAGLFSDTFYT; DKAGLFSDTFYTP;
KAGLFSDTFYTPL; AGLFSDTFYTPLH; GLFSDTFYTPLHC;
LFSDTFYTPLHCI; FSDTFYTPLHCIE; SDTFYTPLHCIEI;
DTFYTPLHCIEIL; TFYTPLHCIEILN; FYTPLHCIEILNT;
YTPLHCIEILNTY; TPLHCIEILNTYL; PLHCIEILNTYLI;
LHCIEILNTYLII; HCIEILNTYLIIK; CIEILNTYLIIKT;
IEILNTYLIIKTH; EILNTYLIIKTHP; ILNTYLIIKTHPH;
LNTYLIIKTHPHT; NTYLIIKTHPHTL; TYLIIKTHPHTLS;
YLIIKTHPHTLSL; LIIKTHPHTLSLL; IIKTHPHTLSLLH;
IKTHPHTLSLLHT; KTHPHTLSLLHTQ; LISKTPALFLQAL;
ISKTPALFLQALL; SKTPALFLQALLG; NHAPLSPLECFLL;
LQKLYVVELKRI; GLLPFFFWVVLS; LLPFFFFWVVLSV;
LPFFFFWVVLSVE; PFFFFWVVLSVEN; FFFFWVVLSVENL;
FFFWVVLSVENLL; FFWVVLSVENLLL; FWVVLSVENLLLL;
WVVLSVENLLLLL; VVLSVENLLLLLH; VLSVENLLLLLHH;
LSVENLLLLLHHW; SVENLLLLLHHWQ; VENLLLLLHHWQT;
ENLLLLLHHWQTY; NLLLLLHHWQTYL; LLLLLHHWQTYLH;
LLLLHHWQTYLHG; LLLHHWQTYLHGK; LLHHWQTYLHGKI;
LHHWQTYLHGKIN; HHWQTYLHGKINL; HWQTYLHGKINLH;
WQTYLHGKINLHP; QTYLHGKINLHPI; TYLHGKINLHPIF;
YLHGKINLHPIFH; RNSTRTPTLLFHR; NSTRTPTLLFHRL;
STRTPTLLFHRLA; TRTPTLLFHRLAP; RTPTLLFHRLAPI;
TPTLLFHRLAPIK; PTLLFHRLAPIKK; TLLFHRLAPIKKI;
LLFHRLAPIKKII; LFHRLAPIKKIIT; GLLIFYYLSKYKL;
LLIFYYLSKYKLV; LIFYYLSKYKLVT; IFYYLSKYKLVTL;
FYYLSKYKLVTLK; YYLSKYKLVTLKL; ISEGSFSNYLDPP;
SEGSFSNYLDPPL; EGSFSNYLDPPLQ; GSFSNYLDPPLQS;
SFSNYLDPPLQSF; FSNYLDPPLQSFF; SNYLDPPLQSFFS;
AKPLCEAVNAVAI; KPLCEAVNAVAIY; PLCEAVNAVAIYP;
LCEAVNAVAIYPN; CEAVNAVAIYPNQ; EAVNAVAIYPNQG;
AVNAVAIYPNQGL; VNAVAIYPNQGLF; NAVAIYPNQGLFS;
HARAVHRRLFGTN; ARAVHRRLFGTNR; RAVHRRLFGTNRP;
AVHRRLFGTNRPF; VHRRLFGTNRPFL; HRRLFGTNRPFLA;
RRLFGTNRPFLAV; RLFGTNRPFLAVQ; LFGTNRPFLAVQG;
FGTNRPFLAVQGI; GTNRPFLAVQGIW; TNRPFLAVQGIWA;
NRPFLAVQGIWAK; RPFLAVQGIWAKR; PFLAVQGIWAKRK;
FLAVQGIWAKRKI; LAVQGIWAKRKIS; AVQGIWAKRKIST;
VQGIWAKRKISTN; QGIWAKRKISTNL; ATPGSKIRLMSYL;
TPGSKIRLMSYLY; PGSKIRLMSYLYI; GSKIRLMSYLYIL;
SKIRLMSYLYILL; KIRLMSYLYILLH; IRLMSYLYILLHF;
RLMSYLYILLHFF; LMSYLYILLHFFI; MSYLYILLHFFIQ;
SYLYILLHFFIQS; YLYILLHFFIQSI; LYILLHFFIQSIH;
YILLHFFIQSIHS; ILLHFFIQSIHSL; LLHFFIQSIHSLH;
LHFFIQSIHSLHF; HFFIQSIHSLHFI; FFIQSIHSLHFIL;
FIQSIHSLHFILV; IQSIHSLHFILVA; QSIHSLHFILVAP;
SIHSLHFILVAPF; IHSLHFILVAPFV; HSLHFILVAPFVR;
SLHFILVAPFVRV; LHFILVAPFVRVK; HFILVAPFVRVKF;
FILVAPFVRVKFL; ILVAPFVRVKFLT 14 mers:

ASEKASTPLLLERK; SEKASTPLLLERKG; EKASTPLLLERKGG;
KASTPLLLERKGGG; ASTPLLLERKGGGR; STPLLLERKGGGRG;
TPLLLERKGGGRGG; PLLLERKGGGRGGL; LLLERKGGGRGGLG;
LLERKGGGRGGLGL; LERKGGGRGGLGLL; ERKGGGRGGLGLLY;
RKGGGRGGLGLLYI; KGGGRGGLGLLYII; GGGRGGLGLLYIIK;
GGRGGLGLLYIIKK; GRGGLGLLYIIKKK; RGGLGLLYIIKKKA;
GGLGLLYIIKKKAT; GLGLLYIIKKKATG; LGLLYIIKKKATGR;
GLLYIIKKKATGRS; LLYIIKKKATGRSC; LYIIKKKATGRSCL;
YIIKKKATGRSCLP; IIKKKATGRSCLPM; IKKKATGRSCLPME;
KKKATGRSCLPMEC; KKATGRSCLPMECS; KATGRSCLPMECSQ;
ATGRSCLPMECSQT; TGRSCLPMECSQTM; GRSCLPMECSQTMT;
RSCLPMECSQTMTS; SCLPMECSQTMTSG; CLPMECSQTMTSGR;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

LPMECSQTMTSGRK; PMECSQTMTSGRKV; MECSQTMTSGRKVH;
ECSQTMTSGRKVHD; CSQTMTSGRKVHDS; SQTMTSGRKVHDSQ;
QTMTSGRKVHDSQG; TMTSGRKVHDSQGN; MTSGRKVHDSQGNA;
TSGRKVHDSQGNAA; SGRKVHDSQGNAAK; GRKVHDSQGNAAKP;
PQEGKCMTHREELL; QEGKCMTHREELLT; EGKCMTHREELLTH;
GKCMTHREELLTHG; KCMTHREELLTHGM; CMTHREELLTHGMQ;
MTHREELLTHGMQP; THREELLTHGMQPN; HREELLTHGMQPNH;
REELLTHGMQPNHD; EELLTHGMQPNHDL; ELLTHGMQPNHDLR;
LLTHGMQPNHDLRK; LTHGMQPNHDLRKE; THGMQPNHDLRKES;
HGMQPNHDLRKESA; QTCFASLGILALSP; TCFASLGILALSPV;
CFASLGILALSPVK; FASLGILALSPVKL; ASLGILALSPVKLD;
SLGILALSPVKLDK; LGILALSPVKLDKG; GILALSPVKLDKGH;
ILALSPVKLDKGHG; LALSPVKLDKGHGS; ALSPVKLDKGHGSA;
LSPVKLDKGHGSAP; SPVKLDKGHGSAPA; PVKLDKGHGSAPAV;
VKLDKGHGSAPAVT; KLDKGHGSAPAVTT; LDKGHGSAPAVTTS;
DKGHGSAPAVTTSF; KGHGSAPAVTTSFS; GHGSAPAVTTSFSE;
HGSAPAVTTSFSES; GSAPAVTTSFSESW; NLDWNKKKSSEDFY;
LDWNKKKSSEDFYF; DWNKKKSSEDFYFY; WNKKKSSEDFYFYF;
NKKKSSEDFYFYFR; KKKSSEDFYFYFRA; KKSSEDFYFYFRAF;
KSSEDFYFYFRAFA; SSEDFYFYFRAFAG; SEDFYFYFRAFAGI;
EDFYFYFRAFAGIL; RQCRREKQKYHCFT; QCRREKQKYHCFTC;
CRREKQKYHCFTCC; RREKQKYHCFTCCK; REKQKYHCFTCCKR;
EKQKYHCFTCCKRL; KQKYHCFTCCKRLC; QKYHCFTCCKRLCK;
KYHCFTCCKRLCKR; YHCFTCCKRLCKRL; HCFTCCKRLCKRLL;
CFTCCKRLCKRLLG; FTCCKRLCKRLLGK; SLFFCISRFMGAAL;
LFFCISRFMGAALA; FFCISRFMGAALAL; FCISRFMGAALALL;
CISRFMGAALALLG; ISRFMGAALALLGD; SRFMGAALALLGDL;
RFMGAALALLGDLV; FMGAALALLGDLVA; MGAALALLGDLVAS;
GAALALLGDLVASV; AALALLGDLVASVS; ALALLGDLVASVSE;
LALLGDLVASVSEA; ALLGDLVASVSEAA; LLGDLVASVSEAAA;
LGDLVASVSEAAAA; GDLVASVSEAAAAT; DLVASVSEAAAATG;
LVASVSEAAAATGF; VASVSEAAAATGFS; ASVSEAAAATGFSV;
SVSEAAAATGFSVA; VSEAAAATGFSVAE; SEAAAATGFSVAEI;
EAAAATGFSVAEIA; AAAATGFSVAEIAA; AAATGFSVAEIAAG;
AATGFSVAEIAAGE; ATGFSVAEIAAGEA; TGFSVAEIAAGEAA;
GFSVAEIAAGEAAA; FSVAEIAAGEAAAA; SVAEIAAGEAAAAI;
VAEIAAGEAAAAIE; AEIAAGEAAAAIEV; EIAAGEAAAAIEVQ;
IAAGEAAAAIEVQI; AAGEAAAAIEVQIA; AGEAAAAIEVQIAS;
GEAAAAIEVQIASL; EAAAAIEVQIASLA; AAAAIEVQIASLAT;
AAAIEVQIASLATV; AAIEVQIASLATVE; AIEVQIASLATVEG;
IEVQIASLATVEGI; EVQIASLATVEGIT; VQIASLATVEGITS;
QIASLATVEGITST; IASLATVEGITSTS; ASLATVEGITSTSE;
SLATVEGITSTSEA; LATVEGITSTSEAI; ATVEGITSTSEAIA;
TVEGITSTSEAIAA; VEGITSTSEAIAAI; EGITSTSEAIAAIG;
GITSTSEAIAAIGL; ITSTSEAIAAIGLT; TSTSEAIAAIGLTP;
STSEAIAAIGLTPQ; TSEAIAAIGLTPQT; SEAIAAIGLTPQTY;
EAIAAIGLTPQTYA; AIAAIGLTPQTYAV; IAAIGLTPQTYAVI;
AAIGLTPQTYAVIA; AIGLTPQTYAVIAG; IGLTPQTYAVIAGA;
GLTPQTYAVIAGAP; LTPQTYAVIAGAPG; TPQTYAVIAGAPGA;
PQTYAVIAGAPGAI; QTYAVIAGAPGAIA; TYAVIAGAPGAIAG;
YAVIAGAPGAIAGF; AVIAGAPGAIAGFA; VIAGAPGAIAGFAA;
IAGAPGAIAGFAAL; AGAPGAIAGFAALI; GAPGAIAGFAALIQ;
APGAIAGFAALIQT; PGAIAGFAALIQTV; GAIAGFAALIQTVS;
AIAGFAALIQTVSG; IAGFAALIQTVSGI; AGFAALIQTVSGIS;
GFAALIQTVSGISS; FAALIQTVSGISSL; AALIQTVSGISSLA;
ALIQTVSGISSLAQ; LIQTVSGISSLAQV; IQTVSGISSLAQVG;
QTVSGISSLAQVGY; TVSGISSLAQVGYK; VSGISSLAQVGYKF;
SGISSLAQVGYKFF; GISSLAQVGYKFFD; ISSLAQVGYKFFDD;
SSLAQVGYKFFDDW; SLAQVGYKFFDDWD; LAQVGYKFFDDWDH;
AQVGYKFFDDWDHK; QVGYKFFDDWDHKV; VGYKFFDDWDHKVS;
GYKFFDDWDHKVST; YKFFDDWDHKVSTV; KFFDDWDHKVSTVG;
FFDDWDHKVSTVGL; FDDWDHKVSTVGLY; DDWDHKVSTVGLYQ;
DWDHKVSTVGLYQQ; WDHKVSTVGLYQQS; DHKVSTVGLYQQSG;
HKVSTVGLYQQSGM; KVSTVGLYQQSGMA; VSTVGLYQQSGMAL;
STVGLYQQSGMALE; TVGLYQQSGMALEL; VGLYQQSGMALELF;
GLYQQSGMALELFN; LYQQSGMALELFNP; YQQSGMALELFNPD;
QQSGMALELFNPDE; QSGMALELFNPDEY; SGMALELFNPDEYY;
GMALELFNPDEYYD; MALELFNPDEYYDI; ALELFNPDEYYDIL;
LELFNPDEYYDILF; ELFNPDEYYDILFP; LFNPDEYYDILFPG;
FNPDEYYDILFPGV; NPDEYYDILFPGVN; PDEYYDILFPGVNT;
DEYYDILFPGVNTF; EYYDILFPGVNTFV; YYDILFPGVNTFVN;
YDILFPGVNTFVNN; DILFPGVNTFVNNI; ILFPGVNTFVNNIQ;
LFPGVNTFVNNIQY; FPGVNTFVNNIQYL; PGVNTFVNNIQYLD;
GVNTFVNNIQYLDP; VNTFVNNIQYLDPR; NTFVNNIQYLDPRH;
TFVNNIQYLDPRHW; FVNNIQYLDPRHWG; VNNIQYLDPRHWGP;
NNIQYLDPRHWGPS; NIQYLDPRHWGPSL; IQYLDPRHWGPSLF;
QYLDPRHWGPSLFA; YLDPRHWGPSLFAT; LDPRHWGPSLFATI;
DPRHWGPSLFATIS; PRHWGPSLFATISQ; RHWGPSLFATISQA;
HWGPSLFATISQAL; WGPSLFATISQALW; GPSLFATISQALWH;
PSLFATISQALWHV; SLFATISQALWHVI; LFATISQALWHVIR;
FATISQALWHVIRD; ATISQALWHVIRDD; TISQALWHVIRDDI;
ISQALWHVIRDDIP; SQALWHVIRDDIPS; QALWHVIRDDIPSI;
ALWHVIRDDIPSIT; LWHVIRDDIPSITS; WHVIRDDIPSITSQ;
HVIRDDIPSITSQE; VIRDDIPSITSQEL; IRDDIPSITSQELQ;
RDDIPSITSQELQR; DDIPSITSQELQRR; DIPSITSQELQRRT;
IPSITSQELQRRTE; PSITSQELQRRTER; SITSQELQRRTERF;
ITSQELQRRTERFF; TSQELQRRTERFFR; SQELQRRTERFFRD;
QELQRRTERFFRDS; ELQRRTERFFRDSL; LQRRTERFFRDSLA;
QRRTERFFRDSLAR; RRTERFFRDSLARF; RTERFFRDSLARFL;
TERFFRDSLARFLE; ERFFRDSLARFLEE; RFFRDSLARFLEET;
FFRDSLARFLEETT; FRDSLARFLEETTW; RDSLARFLEETTWT;
DSLARFLEETTWTI; SLARFLEETTWTIV; LARFLEETTWTIVN;
ARFLEETTWTIVNA; RFLEETTWTIVNAP; FLEETTWTIVNAPI;
LEETTWTIVNAPIN; EETTWTIVNAPINF; ETTWTIVNAPINFY;
TTWTIVNAPINFYN; TWTIVNAPINFYNY; WTIVNAPINFYNYI;
TIVNAPINFYNYIQ; IVNAPINFYNYIQQ; VNAPINFYNYIQQY;
NAPINFYNYIQQYS; APINFYNYIQQYYS; PINFYNYIQQYYSD;
INFYNYIQQYYSDL; NFYNYIQQYYSDLS; FYNYIQQYYSDLSP;
YNYIQQYYSDLSPI; NYIQQYYSDLSPIR; YIQQYYSDLSPIRP;
IQQYYSDLSPIRPS; QQYYSDLSPIRPSM; QYYSDLSPIRPSMV;
YYSDLSPIRPSMVR; YSDLSPIRPSMVRQ; SDLSPIRPSMVRQV;
DLSPIRPSMVRQVA; LSPIRPSMVRQVAE; SPIRPSMVRQVAER;
PIRPSMVRQVAERE; IRPSMVRQVAEREG; RPSMVRQVAEREGT;
PSMVRQVAEREGTR; SMVRQVAEREGTRV; MVRQVAEREGTRVH;
VRQVAEREGTRVHF; RQVAEREGTRVHFG; QVAEREGTRVHFGH;
VAEREGTRVHFGHT; AEREGTRVHFGHTY; EREGTRVHFGHTYS;
REGTRVHFGHTYSI; EGTRVHFGHTYSID; GTRVHFGHTYSIDD;
TRVHFGHTYSIDDA; RVHFGHTYSIDDAD; VHFGHTYSIDDADS;
HFGHTYSIDDADSI; FGHTYSIDDADSIE; GHTYSIDDADSIEE;
HTYSIDDADSIEEV; TYSIDDADSIEEVT; YSIDDADSIEEVTQ;
SIDDADSIEEVTQR; IDDADSIEEVTQRM; DDADSIEEVTQRMD;
DADSIEEVTQRMDL; ADSIEEVTQRMDLR; DSIEEVTQRMDLRN;
SIEEVTQRMDLRNQ; IEEVTQRMDLRNQQ; EEVTQRMDLRNQQS;
EVTQRMDLRNQQSV; VTQRMDLRNQQSVH; TQRMDLRNQQSVHS;
QRMDLRNQQSVHSG; RMDLRNQQSVHSGE; MDLRNQQSVHSGEF;
DLRNQQSVHSGEFI; LRNQQSVHSGEFIE; RNQQSVHSGEFIEK;
NQQSVHSGEFIEKT; QQSVHSGEFIEKTI; QSVHSGEFIEKTIA;
SVHSGEFIEKTIAP; VHSGEFIEKTIAPG; HSGEFIEKTIAPGG;
SGEFIEKTIAPGGA; GEFIEKTIAPGGAN; EFIEKTIAPGGANQ;
FIEKTIAPGGANQR; IEKTIAPGGANQRT; EKTIAPGGANQRTA;
KTIAPGGANQRTAP; TIAPGGANQRTAPQ; IAPGGANQRTAPQW;
APGGANQRTAPQWM; PGGANQRTAPQWML; GGANQRTAPQWMLP;
GANQRTAPQWMLPL; ANQRTAPQWMLPLL; NQRTAPQWMLPLLL;
QRTAPQWMLPLLLG; RTAPQWMLPLLLGL; TAPQWMLPLLLGLY;
APQWMLPLLLGLYG; PQWMLPLLLGLYGT; QWMLPLLLGLYGTV;
WMLPLLLGLYGTVT; MLPLLLGLYGTVTP; LPLLLGLYGTVTPA;
PLLLGLYGTVTPAL; LLLGLYGTVTPALE; LLGLYGTVTPALEA;
LGLYGTVTPALEAY; GLYGTVTPALEAYE; LYGTVTPALEAYED;
YGTVTPALEAYEDG; GTVTPALEAYEDGP; TVTPALEAYEDGPN;
VTPALEAYEDGPNQ; TPALEAYEDGPNQK; PALEAYEDGPNQKK;
ALEAYEDGPNQKKR; LEAYEDGPNQKKRV; EAYEDGPNQKKRRV;
AYEDGPNQKKRRVS; YEDGPNQKKRRVSR; EDGPNQKKRRVSRG;
DGPNQKKRRVSRGS; GPNQKKRRVSRGSS; PNQKKRRVSRGSSQ;
NQKKRRVSRGSSQK; QKKRRVSRGSSQKA; KKRRVSRGSSQKAK;
KRRVSRGSSQKAKG; RRVSRGSSQKAKGT; RVSRGSSQKAKGTR;
VSRGSSQKAKGTRA; SRGSSQKAKGTRAS; RGSSQKAKGTRASA;
GSSQKAKGTRASAK; SSQKAKGTRASAKT; SQKAKGTRASAKTT;
QKAKGTRASAKTTN; KAKGTRASAKTTNK; AKGTRASAKTTNKR;
KGTRASAKTTNKRR; GTRASAKTTNKRRS; TRASAKTTNKRRSS;
RASAKTTNKRRSRS; ASAKTTNKRRSRSS; SAKTTNKRRSRSSR;
AKTTNKRRSRSSRS; NWGRCYYRGRMLPK; WGRCYYRGRMLPKP;
GRCYYRGRMLPKPR; RCYYRGRMLPKPRN; CYYRGRMLPKPRNG;
YYRGRMLPKPRNGG; YRGRMLPKPRNGGS; RGRMLPKPRNGGSR;
PREKNASLLQHSKN; REKNASLLQHSKNS; EKNASLLQHSKNSP;
KNASLLQHSKNSPP; NASLLQHSKNSPPQ; ASLLQHSKNSPPQF;
SLLQHSKNSPPQFK; GPNLWKSTDVGGCN; PNLWKSTDVGGCNC;
NLWKSTDVGGCNCT; LWKSTDVGGCNCTN; WKSTDVGGCNCTNR;
KSTDVGGCNCTNRG; STDVGGCNCTNRGY; TDVGGCNCTNRGYW;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

DVGGCNCTNRGYWN; VGGCNCTNRGYWNN; FPLLCCRWRTLGNA;
PLLCCRWRTLGNAG; LLCCRWRTLGNAGS; LCCRWRTLGNAGSA;
CCRWRTLGNAGSAN; CRWRTLGNAGSANE; RWRTLGNAGSANEL;
WRTLGNAGSANELQ; RTLGNAGSANELQV; TLGNAGSANELQVK;
LGNAGSANELQVKV; GNAGSANELQVKVP; VFWDFHRRGKCSPS;
FWDFHRRGKCSPST; WDFHRRGKCSPSTS; DFHRRGKCSPSTSC;
FHRRGKCSPSTSCD; HRRGKCSPSTSCDQ; RRGKCSPSTSCDQH;
RGKCSPSTSCDQHS; GKCSPSTSCDQHSY; KCSPSTSCDQHSYH;
CSPSTSCDQHSYHS; SPSTSCDQHSYHSV; PSTSCDQHSYHSVA;
STSCDQHSYHSVAR; QLWNTTVERPCKIF; DPPEKKICKESLPN;
PPEKKICKESLPNF; PEKKICKESLPNFL; EKKICKESLPNFLF;
KKICKESLPNFLFA; KICKESLPNFLFAK; PYKQENPESGWAAY;
YKQENPESGWAAYV; KQENPESGWAAYVW; QENPESGWAAYVWY;
ENPESGWAAYVWYG; NPESGWAAYVWYGI; PESGWAAYVWYGIP;
ESGWAAYVWYGIPG; SGWAAYVWYGIPGR; GWAAYVWYGIPGRR;
WAAYVWYGIPGRRG; WHRKTSRGPRYDKI; HRKTSRGPRYDKIY;
QTGTIANQNALNRC; TGTIANQNALNRCF; GTIANQNALNRCFY;
TIANQNALNRCFYC; IANQNALNRCFYCT; ANQNALNRCFYCTY;
NQNALNRCFYCTYT; QNALNRCFYCTYTF; NALNRCFYCTYTFN;
ALNRCFYCTYTFNK; LNRCFYCTYTFNKC; NRCFYCTYTFNKCC;
RCFYCTYTFNKCCF; CFYCTYTFNKCCFC; FYCTYTFNKCCFCI;
YCTYTFNKCCFCIS; CTYTFNKCCFCISH; TYTFNKCCFCISHF;
NTESLYTNATLDYG; TESLYTNATLDYGG; ESLYTNATLDYGGL;
SLYTNATLDYGGLT; LYTNATLDYGGLTF; YTNATLDYGGLTFG;
TNATLDYGGLTFGN; NATLDYGGLTFGNL; ATLDYGGLTFGNLQ;
TLDYGGLTFGNLQQ; LDYGGLTFGNLQQG; DYGGLTFGNLQQGL;
YGGLTFGNLQQGLK; GGLTFGNLQQGLKY; GLTFGNLQQGLKYL;
LTFGNLQQGLKYLR; TFGNLQQGLKYLRL; FGNLQQGLKYLRLG;
GNLQQGLKYLRLGK; NLQQGLKYLRLGKS; LQQGLKYLRLGKSI;
QQGLKYLRLGKSIV; QGLKYLRLGKSIVI; GLKYLRLGKSIVIG;
LKYLRLGKSIVIGI; KYLRLGKSIVIGIQ; YLRLGKSIVIGIQC;
LRLGKSIVIGIQCL; RLGKSIVIGIQCLI; LGKSIVIGIQCLIH;
GKSIVIGIQCLIHV; KSIVIGIQCLIHVQ; SIVIGIQCLIHVQS;
IVIGIQCLIHVQSL; VIGIQCLIHVQSLQ; IGIQCLIHVQSLQF;
GIQCLIHVQSLQFL; IQCLIHVQSLQFLN; QCLIHVQSLQFLNP;
CLIHVQSLQFLNPL; LIHVQSLQFLNPLL; IHVQSLQFLNPLLL;
YQEYISPCIYYISS; QEYISPCIYYISSL; EYISPCIYYISSLK;
YISPCIYYISSLKK; ISPCIYYISSLKKY; SPCIYYISSLKKYT;
PCIYYISSLKKYTY; CIYYISSLKKYTYL; IYYISSLKKYTYLS;
YYISSLKKYTYLSQ; YISSLKKYTYLSQN; ISSLKKYTYLSQNP;
SSLKKYTYLSQNPA; SLKKYTYLSQNPAF; LKKYTYLSQNPAFP;
KKYTYLSQNPAFPS; KYTYLSQNPAFPSI; YTYLSQNPAFPSIQ;
TYLSQNPAFPSIQQ; YLSQNPAFPSIQQF; TKLAVATRSFHFVK;
KLAVATRSFHFVKF; LAVATRSFHFVKFF; AVATRSFHFVKFFF;
VATRSFHFVKFFFQ; ATRSFHFVKFFFQV; TRSFHFVKFFFQVR;
RSFHFVKFFFQVRT; SFHFVKFFFQVRTL; FHFVKFFFQVRTLS;
HFVKFFFQVRTLSF; FVKFFFQVRTLSFV; VKFFFQVRTLSFVR;
KFFFQVRTLSFVRI; FFFQVRTLSFVRIF; FFQVRTLSFVRIFL;
FQVRTLSFVRIFLN; QVRTLSFVRIFLNI; VRTLSFVRIFLNIF;
RTLSFVRIFLNIFW; TLSFVRIFLNIFWA; PSLVEIFGFFCLNV;
SLVEIFGFFCLNVS; LVEIFGFFCLNVSF; VEIFGFFCLNVSFL;
EIFGFFCLNVSFLN; IFGFFCLNVSFLNL; FGFFCLNVSFLNLP;
HFHLNNLSNCLNCL; FHLNNLSNCLNCLF; HLNNLSNCLNCLFH;
LNNLSNCLNCLFHV; NNLSNCLNCLFHVL; NLSNCLNCLFHVLK;
LSNCLNCLFHVLKA; SNCLNCLFHVLKAN; NCLNCLFHVLKANP;
CLNCLFHVLKANPL; LNCLFHVLKANPLI; NCLFHVLKANPLIQ;
CLFHVLKANPLIQL; LFHVLKANPLIQLL; FHVLKANPLIQLLS;
HVLKANPLIQLLSL; VLKANPLIQLLSLL; LKANPLIQLLSLLH;
KANPLIQLLSLLHL; ANPLIQLLSLLHLQ; NPLIQLLSLLHLQK;
PLIQLLSLLHLQKQ; LIQLLSLLHLQKQP; IQLLSLLHLQKQPC;
QLLSLLHLQKQPCT; LLSLLHLQKQPCTD; LSLLHLQKQPCTDL;
LHLAQRLAFPWVGL; HLAQRLAFPWVGLH; LAQRLAFPWVGLHL;
AQRLAFPWVGLHLR; QRLAFPWVGLHLRL; RLAFPWVGLHLRLY;
LAFPWVGLHLRLYH; AFPWVGLHLRLYHH; FPWVGLHLRLYHHT;
PWVGLHLRLYHHTN; WVGLHLRLYHHTNL; VGLHLRLYHHTNLI;
GLHLRLYHHTNLIT; LHLRLYHHTNLITL; HLRLYHHTNLITLQ;
LRLYHHTNLITLQL; RLYHHTNLITLQLV; LYHHTNLITLQLVL;
YHHTNLITLQLVLF; HHTNLITLQLVLFF; HTNLITLQLVLFFH;
TNLITLQLVLFFHY; NLITLQLVLFFHYQ; LITLQLVLFFHYQW;
ITLQLVLFFHYQWD; TLQLVLFFHYQWDL; KQYSAKNQILQNPF;
VANSAAKQHLPYIV; ANSAAKQHLPYIVL; NSAAKQHLPYIVLV;
SAAKQHLPYIVLVQ; AAKQHLPYIVLVQH; AKQHLPYIVLVQHF;
KQHLPYIVLVQHFH; QHLPYIVLVQHFHE; HLPYIVLVQHFHEL;
LPYIVLVQHFHELQ; PYIVLVQHFHELQI; YIVLVQHFHELQIL;

IVLVQHFHELQILN; VLVQHFHELQILNP; LVQHFHELQILNPF;
VQHFHELQILNPFY; QHFHELQILNPFYL; HFHELQILNPFYLI;
FHELQILNPFYLIY; HELQILNPFYLIYD; IFLLAFLPWSYEGY;
FLLAFLPWSYEGYL; LLAFLPWSYEGYLL; LAFLPWSYEGYLLF;
AFLPWSYEGYLLFF; LKLYLLLADKYFFD; KLYLLLADKYFFDF;
LYLLLADKYFFDFY; YLLLADKYFFDFYF; LLLADKYFFDFYFL;
LLADKYFFDFYFLQ; LADKYFFDFYFLQK; SDKAGLFSDTFYTP;
DKAGLFSDTFYTPL; KAGLFSDTFYTPLH; AGLFSDTFYTPLHC;
GLFSDTFYTPLHCI; LFSDTFYTPLHCIE; FSDTFYTPLHCIEI;
SDTFYTPLHCIEIL; DTFYTPLHCIEILN; TFYTPLHCIEILNT;
FYTPLHCIEILNTY; YTPLHCIEILNTYL; TPLHCIEILNTYLI;
PLHCIEILNTYLII; LHCIEILNTYLIIK; HCIEILNTYLIIKT;
CIEILNTYLIIKTH; IEILNTYLIIKTHP; EILNTYLIIKTHPH;
ILNTYLIIKTHPHT; LNTYLIIKTHPHTL; NTYLIIKTHPHTLS;
TYLIIKTHPHTLSL; YLIIKTHPHTLSLL; LIIKTHPHTLSLLH;
IIKTHPHTLSLLHT; IKTHPHTLSLLHTQ; LISKTPALFLQALL;
ISKTPALFLQALLG; GLLPFFFFWVVLSV; LLPFFFFWVVLSVE;
LPFFFFWVVLSVEN; PFFFFWVVLSVENL; FFFFWVVLSVENLL;
FFFWVVLSVENLLL; FFWVVLSVENLLLL; FWVVLSVENLLLLL;
WVVLSVENLLLLLH; VVLSVENLLLLLHH; VLSVENLLLLLHHW;
LSVENLLLLLHHWQ; SVENLLLLLHHWQT; VENLLLLLHHWQTY;
ENLLLLLHHWQTYL; NLLLLLHHWQTYLH; LLLLLHHWQTYLHG;
LLLLHHWQTYLHGK; LLLHHWQTYLHGKI; LLHHWQTYLHGKIN;
LHHWQTYLHGKINL; HHWQTYLHGKINLH; HWQTYLHGKINLHP;
WQTYLHGKINLHPI; QTYLHGKINLHPIF; TYLHGKINLHPIFH;
RNSTRTPTLLFHRL; NSTRTPTLLFHRLA; STRTPTLLFHRLAP;
TRTPTLLFHRLAPI; RTPTLLFHRLAPIK; TPTLLFHRLAPIKK;
PTLLFHRLAPIKKI; TLLFHRLAPIKKII; LLFHRLAPIKKIIT;
GLLIFYYLSKYKLV; LLIFYYLSKYKLVT; LIFYYLSKYKLVTL;
IFYYLSKYKLVTLK; FYYLSKYKLVTLKL; ISEGSFSNYLDPPL;
SEGSFSNYLDPPLQ; EGSFSNYLDPPLQS; GSFSNYLDPPLQSF;
SFSNYLDPPLQSFF; FSNYLDPPLQSFFS; AKPLCEAVNAVAIY;
KPLCEAVNAVAIYP; PLCEAVNAVAIYPN; LCEAVNAVAIYPNQ;
CEAVNAVAIYPNQG; EAVNAVAIYPNQGL; AVNAVAIYPNQGLF;
VNAVAIYPNQGLFS; HARAVHRRLFGTNR; ARAVHRRLFGTNRP;
RAVHRRLFGTNRPF; AVHRRLFGTNRPFL; VHRRLFGTNRPFLA;
HRRLFGTNRPFLAV; RRLFGTNRPFLAVQ; RLFGTNRPFLAVQG;
LFGTNRPFLAVQGI; FGTNRPFLAVQGIW; GTNRPFLAVQGIWA;
TNRPFLAVQGIWAK; NRPFLAVQGIWAKR; RPFLAVQGIWAKRK;
PFLAVQGIWAKRKI; FLAVQGIWAKRKIS; LAVQGIWAKRKIST;
AVQGIWAKRKISTN; VQGIWAKRKISTNL; ATPGSKIRLMSYLY;
TPGSKIRLMSYLYI; PGSKIRLMSYLYIL; GSKIRLMSYLYILL;
SKIRLMSYLYILLH; KIRLMSYLYILLHF; IRLMSYLYILLHFF;
RLMSYLYILLHFFI; LMSYLYILLHFFIQ; MSYLYILLHFFIQS;
SYLYILLHFFIQSI; YLYILLHFFIQSIH; LYILLHFFIQSIHS;
YILLHFFIQSIHSL; ILLHFFIQSIHSLH; LLHFFIQSIHSLHF;
LHFFIQSIHSLHFI; HFFIQSIHSLHFIL; FFIQSIHSLHFILV;
FIQSIHSLHFILVA; IQSIHSLHFILVAP; QSIHSLHFILVAPF;
SIHSLHFILVAPFV; IHSLHFILVAPFVR; HSLHFILVAPFVRV;
SLHFILVAPFVRVK; LHFILVAPFVRVKF; HFILVAPFVRVKFL;
FILVAPFVRVKFLT 15 mers:

ASEKASTPLLLERKG; SEKASTPLLLERKGG; EKASTPLLLERKGGG;
KASTPLLLERKGGGR; ASTPLLLERKGGGRG; STPLLLERKGGGRGG;
TPLLLERKGGGRGGL; PLLLERKGGGRGGLG; LLLERKGGGRGGLGL;
LLERKGGGRGGLGLL; LERKGGGRGGLGLLY; ERKGGGRGGLGLLYI;
RKGGGRGGLGLLYII; KGGGRGGLGLLYIIK; GGGRGGLGLLYIIKK;
GGRGGLGLLYIIKKK; GRGGLGLLYIIKKKA; RGGLGLLYIIKKKAT;
GGLGLLYIIKKKATG; GLGLLYIIKKKATGR; LGLLYIIKKKATGRS;
GLLYIIKKKATGRSC; LLYIIKKKATGRSCL; LYIIKKKATGRSCLP;
YIIKKKATGRSCLPM; IIKKKATGRSCLPME; IKKKATGRSCLPMEC;
KKKATGRSCLPMECS; KKATGRSCLPMECSQ; KATGRSCLPMECSQT;
ATGRSCLPMECSQTM; TGRSCLPMECSQTMT; GRSCLPMECSQTMTS;
RSCLPMECSQTMTSG; SCLPMECSQTMTSGR; CLPMECSQTMTSGRK;
LPMECSQTMTSGRKV; PMECSQTMTSGRKVH; MECSQTMTSGRKVHD;
ECSQTMTSGRKVHDS; CSQTMTSGRKVHDSQ; SQTMTSGRKVHDSQG;
QTMTSGRKVHDSQGN; TMTSGRKVHDSQGNA; MTSGRKVHDSQGNAA;
TSGRKVHDSQGNAAK; SGRKVHDSQGNAAKP; PQEGKCMTHREELLT;
QEGKCMTHREELLTH; EGKCMTHREELLTHG; GKCMTHREELLTHGM;
KCMTHREELLTHGMQ; CMTHREELLTHGMQP; MTHREELLTHGMQPN;
THREELLTHGMQPNH; HREELLTHGMQPNHD; REELLTHGMQPNHDL;
EELLTHGMQPNHDLR; ELLTHGMQPNHDLRK; LLTHGMQPNHDLRKE;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

LTHGMQPNHDLRKES; THGMQPNHDLRKESA; QTCFASLGILALSPV;
TCFASLGILALSPVK; CFASLGILALSPVKL; FASLGILALSPVKLD;
ASLGILALSPVKLDK; SLGILALSPVKLDKG; LGILALSPVKLDKGH;
GILALSPVKLDKGHG; ILALSPVKLDKGHGS; LALSPVKLDKGHGSA;
ALSPVKLDKGHGSAP; LSPVKLDKGHGSAPA; SPVKLDKGHGSAPAV;
PVKLDKGHGSAPAVT; VKLDKGHGSAPAVTT; KLDKGHGSAPAVTTS;
LDKGHGSAPAVTTSF; DKGHGSAPAVTTSFS; KGHGSAPAVTTSFSE;
GHGSAPAVTTSFSES; HGSAPAVTTSFSESW; NLDWNKKKSSEDFYF;
LDWNKKKSSEDFYFY; DWNKKKSSEDFYFYF; WNKKKSSEDFYFYFR;
NKKKSSEDFYFYFRA; KKKSSEDFYFYFRAF; KKSSEDFYFYFRAFA;
KSSEDFYFYFRAFAG; SSEDFYFYFRAFAGI; SEDFYFYFRAFAGIL;
RQCRREKQKYHCFTC; QCRREKQKYHCFTCC; CRREKQKYHCFTCCK;
RREKQKYHCFTCCKR; REKQKYHCFTCCKRL; EKQKYHCFTCCKRLC;
KQKYHCFTCCKRLCK; QKYHCFTCCKRLCKR; KYHCFTCCKRLCKRL;
YHCFTCCKRLCKRLL; HCFTCCKRLCKRLLG; CFTCCKRLCKRLLGD;
SLFFCISRFMGAALA; LFFCISRFMGAALAL; FFCISRFMGAALALL;
FCISRFMGAALALLG; CISRFMGAALALLGD; ISRFMGAALALLGDL;
SRFMGAALALLGDLV; RFMGAALALLGDLVA; FMGAALALLGDLVAS;
MGAALALLGDLVASV; GAALALLGDLVASVS; AALALLGDLVASVSE;
ALALLGDLVASVSEA; LALLGDLVASVSEAA; ALLGDLVASVSEAAA;
LLGDLVASVSEAAAA; LGDLVASVSEAAAAT; GDLVASVSEAAAATG;
DLVASVSEAAAATGF; LVASVSEAAAATGFS; VASVSEAAAATGFSV;
ASVSEAAAATGFSVA; SVSEAAAATGFSVAE; VSEAAAATGFSVAEI;
SEAAAATGFSVAEIA; EAAAATGFSVAEIAA; AAAATGFSVAEIAAG;
AAATGFSVAEIAAGE; AATGFSVAEIAAGEA; ATGFSVAEIAAGEAA;
TGFSVAEIAAGEAAA; GFSVAEIAAGEAAAA; FSVAEIAAGEAAAAI;
SVAEIAAGEAAAAIE; VAEIAAGEAAAAIEV; AEIAAGEAAAAIEVQ;
EIAAGEAAAAIEVQI; IAAGEAAAAIEVQIA; AAGEAAAAIEVQIAS;
AGEAAAAIEVQIASL; GEAAAAIEVQIASLA; EAAAAIEVQIASLAT;
AAAAIEVQIASLATV; AAAIEVQIASLATVE; AAIEVQIASLATVEG;
AIEVQIASLATVEGI; IEVQIASLATVEGIT; EVQIASLATVEGITS;
VQIASLATVEGITST; QIASLATVEGITSTS; IASLATVEGITSTSE;
ASLATVEGITSTSEA; SLATVEGITSTSEAI; LATVEGITSTSEAIA;
ATVEGITSTSEAIAA; TVEGITSTSEAIAAI; VEGITSTSEAIAAIG;
EGITSTSEAIAAIGL; GITSTSEAIAAIGLT; ITSTSEAIAAIGLTP;
TSTSEAIAAIGLTPQ; STSEAIAAIGLTPQT; TSEAIAAIGLTPQTY;
SEAIAAIGLTPQTYA; EAIAAIGLTPQTYAV; AIAAIGLTPQTYAVI;
IAAIGLTPQTYAVIA; AAIGLTPQTYAVIAG; AIGLTPQTYAVIAGA;
IGLTPQTYAVIAGAP; GLTPQTYAVIAGAPG; LTPQTYAVIAGAPGA;
TPQTYAVIAGAPGAI; PQTYAVIAGAPGAIA; QTYAVIAGAPGAIAG;
TYAVIAGAPGAIAGF; YAVIAGAPGAIAGFA; AVIAGAPGAIAGFAA;
VIAGAPGAIAGFAAL; IAGAPGAIAGFAALI; AGAPGAIAGFAALIQ;
GAPGAIAGFAALIQT; APGAIAGFAALIQTV; PGAIAGFAALIQTVS;
GAIAGFAALIQTVSG; AIAGFAALIQTVSGI; IAGFAALIQTVSGIS;
AGFAALIQTVSGISS; GFAALIQTVSGISSL; FAALIQTVSGISSLA;
AALIQTVSGISSLAQ; ALIQTVSGISSLAQV; LIQTVSGISSLAQVG;
IQTVSGISSLAQVGY; QTVSGISSLAQVGYK; TVSGISSLAQVGYKF;
VSGISSLAQVGYKFF; SGISSLAQVGYKFFD; GISSLAQVGYKFFDD;
ISSLAQVGYKFFDDW; SSLAQVGYKFFDDWD; SLAQVGYKFFDDWDH;
LAQVGYKFFDDWDHK; AQVGYKFFDDWDHKV; QVGYKFFDDWDHKVS;
VGYKFFDDWDHKVST; GYKFFDDWDHKVSTV; YKFFDDWDHKVSTVG;
KFFDDWDHKVSTVGL; FFDDWDHKVSTVGLY; FDDWDHKVSTVGLYQ;
DDWDHKVSTVGLYQQ; DWDHKVSTVGLYQQS; WDHKVSTVGLYQQSG;
DHKVSTVGLYQQSGM; HKVSTVGLYQQSGMA; KVSTVGLYQQSGMAL;
VSTVGLYQQSGMALE; STVGLYQQSGMALEL; TVGLYQQSGMALELF;
VGLYQQSGMALELFN; GLYQQSGMALELFNP; LYQQSGMALELFNPD;
YQQSGMALELFNPDE; QQSGMALELFNPDEY; QSGMALELFNPDEYY;
SGMALELFNPDEYYD; GMALELFNPDEYYDI; MALELFNPDEYYDIL;
ALELFNPDEYYDILF; LELFNPDEYYDILFP; ELFNPDEYYDILFPG;
LFNPDEYYDILFPGV; FNPDEYYDILFPGVN; NPDEYYDILFPGVNT;
PDEYYDILFPGVNTF; DEYYDILFPGVNTFV; EYYDILFPGVNTFVN;
YYDILFPGVNTFVNN; YDILFPGVNTFVNNI; DILFPGVNTFVNNIQ;
ILFPGVNTFVNNIQY; LFPGVNTFVNNIQYL; FPGVNTFVNNIQYLD;
PGVNTFVNNIQYLDP; GVNTFVNNIQYLDPR; VNTFVNNIQYLDPRH;
NTFVNNIQYLDPRHW; TFVNNIQYLDPRHWG; FVNNIQYLDPRHWGP;
VNNIQYLDPRHWGPS; NNIQYLDPRHWGPSL; NIQYLDPRHWGPSLF;
IQYLDPRHWGPSLFA; QYLDPRHWGPSLFAT; YLDPRHWGPSLFATI;
LDPRHWGPSLFATIS; DPRHWGPSLFATISQ; PRHWGPSLFATISQA;
RHWGPSLFATISQAL; HWGPSLFATISQALW; WGPSLFATISQALWH;
GPSLFATISQALWHV; PSLFATISQALWHVI; SLFATISQALWHVIR;
LFATISQALWHVIRD; FATISQALWHVIRDD; ATISQALWHVIRDDI;
TISQALWHVIRDDIP; ISQALWHVIRDDIPS; SQALWHVIRDDIPSI;
QALWHVIRDDIPSIT; ALWHVIRDDIPSITS; LWHVIRDDIPSITSQ;
WHVIRDDIPSITSQE; HVIRDDIPSITSQEL; VIRDDIPSITSQELQ;
IRDDIPSITSQELQR; RDDIPSITSQELQRR; DDIPSITSQELQRRT;
DIPSITSQELQRRTE; IPSITSQELQRRTER; PSITSQELQRRTERF;
SITSQELQRRTERFF; ITSQELQRRTERFFR; TSQELQRRTERFFRD;
SQELQRRTERFFRDS; QELQRRTERFFRDSL; ELQRRTERFFRDSLA;
LQRRTERFFRDSLAR; QRRTERFFRDSLARF; RRTERFFRDSLARFL;
RTERFFRDSLARFLE; TERFFRDSLARFLEE; ERFFRDSLARFLEET;
RFFRDSLARFLEETT; FFRDSLARFLEETTW; FRDSLARFLEETTWT;
RDSLARFLEETTWTI; DSLARFLEETTWTIV; SLARFLEETTWTIVN;
LARFLEETTWTIVNA; ARFLEETTWTIVNAP; RFLEETTWTIVNAPI;
FLEETTWTIVNAPIN; LEETTWTIVNAPINF; EETTWTIVNAPINFY;
ETTWTIVNAPINFYN; TTWTIVNAPINFYNY; TWTIVNAPINFYNYI;
WTIVNAPINFYNYIQ; TIVNAPINFYNYIQQ; IVNAPINFYNYIQQY;
VNAPINFYNYIQQYY; NAPINFYNYIQQYYS; APINFYNYIQQYYSD;
PINFYNYIQQYYSDL; INFYNYIQQYYSDLS; NFYNYIQQYYSDLSP;
FYNYIQQYYSDLSPI; YNYIQQYYSDLSPIR; NYIQQYYSDLSPIRP;
YIQQYYSDLSPIRPS; IQQYYSDLSPIRPSM; QQYYSDLSPIRPSMV;
QYYSDLSPIRPSMVR; YYSDLSPIRPSMVRQ; YSDLSPIRPSMVRQV;
SDLSPIRPSMVRQVA; DLSPIRPSMVRQVAE; LSPIRPSMVRQVAER;
SPIRPSMVRQVAERE; PIRPSMVRQVAEREG; IRPSMVRQVAEREGT;
RPSMVRQVAEREGTR; PSMVRQVAEREGTRV; SMVRQVAEREGTRVH;
MVRQVAEREGTRVHF; VRQVAEREGTRVHFG; RQVAEREGTRVHFGH;
QVAEREGTRVHFGHT; VAEREGTRVHFGHTY; AEREGTRVHFGHTYS;
EREGTRVHFGHTYSI; REGTRVHFGHTYSID; EGTRVHFGHTYSIDD;
GTRVHFGHTYSIDDA; TRVHFGHTYSIDDAD; RVHFGHTYSIDDADS;
VHFGHTYSIDDADSI; HFGHTYSIDDADSIE; FGHTYSIDDADSIEE;
GHTYSIDDADSIEEV; HTYSIDDADSIEEVT; TYSIDDADSIEEVTQ;
YSIDDADSIEEVTQR; SIDDADSIEEVTQRM; IDDADSIEEVTQRMD;
DDADSIEEVTQRMDL; DADSIEEVTQRMDLR; ADSIEEVTQRMDLRN;
DSIEEVTQRMDLRNQ; SIEEVTQRMDLRNQQ; IEEVTQRMDLRNQQS;
EEVTQRMDLRNQQSV; EVTQRMDLRNQQSVH; VTQRMDLRNQQSVHS;
TQRMDLRNQQSVHSG; QRMDLRNQQSVHSGE; RMDLRNQQSVHSGEF;
MDLRNQQSVHSGEFI; DLRNQQSVHSGEFIE; LRNQQSVHSGEFIEK;
RNQQSVHSGEFIEKT; NQQSVHSGEFIEKTI; QQSVHSGEFIEKTIA;
QSVHSGEFIEKTIAP; SVHSGEFIEKTIAPG; VHSGEFIEKTIAPGG;
HSGEFIEKTIAPGGA; SGEFIEKTIAPGGAN; GEFIEKTIAPGGANQ;
EFIEKTIAPGGANQR; FIEKTIAPGGANQRT; IEKTIAPGGANQRTA;
EKTIAPGGANQRTAP; KTIAPGGANQRTAPG; TIAPGGANQRTAPGW;
IAPGGANQRTAPQWM; APGGANQRTAPQWML; PGGANQRTAPQWMLP;
GGANQRTAPQWMLPL; GANQRTAPQWMLPLL; ANQRTAPQWMLPLLL;
NQRTAPQWMLPLLLG; QRTAPQWMLPLLLGL; RTAPQWMLPLLLGLY;
TAPQWMLPLLLGLYG; APQWMLPLLLGLYGT; PQWMLPLLLGLYGTV;
QWMLPLLLGLYGTVT; WMLPLLLGLYGTVTP; MLPLLLGLYGTVTPA;
LPLLLGLYGTVTPAL; PLLLGLYGTVTPALE; LLLGLYGTVTPALEA;
LLGLYGTVTPALEAY; LGLYGTVTPALEAYE; GLYGTVTPALEAYED;
LYGTVTPALEAYEDG; YGTVTPALEAYEDGP; GTVTPALEAYEDGPN;
TVTPALEAYEDGPNQ; VTPALEAYEDGPNQK; TPALEAYEDGPNQKK;
PALEAYEDGPNQKKR; ALEAYEDGPNQKKRR; LEAYEDGPNQKKRRV;
EAYEDGPNQKKRRVS; AYEDGPNQKKRRVSR; YEDGPNQKKRRVSRG;
EDGPNQKKRRVSRGS; DGPNQKKRRVSRGSS; GPNQKKRRVSRGSSQ;
PNQKKRRVSRGSSQK; NQKKRRVSRGSSQKA; QKKRRVSRGSSQKAK;
KKRRVSRGSSQKAKG; KRRVSRGSSQKAKGT; RRVSRGSSQKAKGTR;
RVSRGSSQKAKGTRA; VSRGSSQKAKGTRAS; SRGSSQKAKGTRASA;
RGSSQKAKGTRASAK; GSSQKAKGTRASAKT; SSQKAKGTRASAKTT;
SQKAKGTRASAKTTN; QKAKGTRASAKTTNK; KAKGTRASAKTTNKR;
AKGTRASAKTTNKRR; KGTRASAKTTNKRRS; GTRASAKTTNKRRSR;
TRASAKTTNKRRSRS; RASAKTTNKRRSRSS; ASAKTTNKRRSRSSR;
SAKTTNKRRSRSSRS; NWGRCYYRGRMLPKP; WGRCYYRGRMLPKPR;
GRCYYRGRMLPKPRN; RCYYRGRMLPKPRNG; CYYRGRMLPKPRNGG;
YYRGRMLPKPRNGGS; YRGRMLPKPRNGGSR; PREKNASLLQHSKNS;
REKNASLLQHSKNSP; EKNASLLQHSKNSPP; KNASLLQHSKNSPPQ;
NASLLQHSKNSPPQF; ASLLQHSKNSPPQFG; GPNLWKSTDVGGCNC;
PNLWKSTDVGGCNCT; NLWKSTDVGGCNCTN; LWKSTDVGGCNCTNR;
WKSTDVGGCNCTNRG; KSTDVGGCNCTNRGY; STDVGGCNCTNRGYW;
TDVGGCNCTNRGYWN; DVGGCNCTNRGYWNN; FPLLCCRWRTLGNAG;
PLLCCRWRTLGNAGS; LLCCRWRTLGNAGSA; LCCRWRTLGNAGSAN;
CCRWRTLGNAGSANE; CRWRTLGNAGSANEL; RWRTLGNAGSANELQ;
WRTLGNAGSANELQV; RTLGNAGSANELQVK; TLGNAGSANELQVKV;
LGNAGSANELQVKVP; VFWDFHRRGKCSPST; FWDFHRRGKCSPSTS;
WDFHRRGKCSPSTSC; DFHRRGKCSPSTSCD; DFHRRGKCSPSTSCDH;
HRRGKCSPSTSCDQH; RRGKCSPSTSCDQHS; RGKCSPSTSCDQHSY;
GKCSPSTSCDQHSYH; KCSPSTSCDQHSYHS; CSPSTSCDQHSYHSV;
SPSTSCDQHSYHSVA; PSTSCDQHSYHSVAR; DPPEKKICKESLPNF;
PPEKKICKESLPNFL; PEKKICKESLPNFLF; EKKICKESLPNFLFA;
KKICKESLPNFLFAK; PYKQENPESGWAAYV; YKQENPESGWAAYVW;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

KQENPESGWAAYVWY; QENPESGWAAYVWYG; ENPESGWAAYVWYGI;
NPESGWAAYVWYGIP; PESGWAAYVWYGIPG; ESGWAAYVWYGIPGR;
SGWAAYVWYGIPGRR; GWAAYVWYGIPGRRG; WHRKTSRGPRYDKIY;
QTGTIANQNALNRCF; TGTIANQNALNRCFY; GTIANQNALNRCFYC;
TIANQNALNRCFYCT; IANQNALNRCFYCTY; ANQNALNRCFYCTYT;
NQNALNRCFYCTYTF; QNALNRCFYCTYTFN; NALNRCFYCTYTFNK;
ALNRCFYCTYTFNKC; LNRCFYCTYTFNKCC; NRCFYCTYTFNKCCF;
RCFYCTYTFNKCCFC; CFYCTYTFNKCCFCI; FYCTYTFNKCCFCIS;
YCTYTFNKCCFCISH; CTYTFNKCCFCISHF; NTESLYTNATLDYGG;
TESLYTNATLDYGGL; ESLYTNATLDYGGLT; SLYTNATLDYGGLTF;
LYTNATLDYGGLTFG; YTNATLDYGGLTFGN; TNATLDYGGLTFGNL;
NATLDYGGLTFGNLQ; ATLDYGGLTFGNLQQ; TLDYGGLTFGNLQQG;
LDYGGLTFGNLQQGL; DYGGLTFGNLQQGLK; YGGLTFGNLQQGLKY;
GGLTFGNLQQGLKYL; GLTFGNLQQGLKYLR; LTFGNLQQGLKYLRL;
TFGNLQQGLKYLRLG; FGNLQQGLKYLRLGK; GNLQQGLKYLRLGKS;
NLQQGLKYLRLGKSI; LQQGLKYLRLGKSIV; QQGLKYLRLGKSIVI;
QGLKYLRLGKSIVIG; GLKYLRLGKSIVIGI; LKYLRLGKSIVIGIQ;
KYLRLGKSIVIGIQC; YLRLGKSIVIGIQCL; LRLGKSIVIGIQCLI;
RLGKSIVIGIQCLIH; LGKSIVIGIQCLIHV; GKSIVIGIQCLIHVQ;
KSIVIGIQCLIHVQS; SIVIGIQCLIHVQSL; IVIGIQCLIHVQSLQ;
VIGIQCLIHVQSLQF; IGIQCLIHVQSLQFL; GIQCLIHVQSLQFLN;
IQCLIHVQSLQFLNP; QCLIHVQSLQFLNPL; CLIHVQSLQFLNPLL;
LIHVQSLQFLNPLLL; YQEYISPCIYYISSL; QEYISPCIYYISSLK;
EYISPCIYYISSLKK; YISPCIYYISSLKKY; ISPCIYYISSLKKYT;
SPCIYYISSLKKYTY; PCIYYISSLKKYTYL; CIYYISSLKKYTYLS;
IYYISSLKKYTYLSQ; YYISSLKKYTYLSQN; YISSLKKYTYLSQNP;
ISSLKKYTYLSQNPA; SSLKKYTYLSQNPAF; SLKKYTYLSQNPAFP;
LKKYTYLSQNPAFPS; KKYTYLSQNPAFPSI; KYTYLSQNPAFPSIQ;
YTYLSQNPAFPSIQQ; TYLSQNPAFPSIQQF; TKLAVATRSFHFVKF;
KLAVATRSFHFVKFF; LAVATRSFHFVKFFF; AVATRSFHFVKFFFQ;
VATRSFHFVKFFFQV; ATRSFHFVKFFFQVR; TRSFHFVKFFFQVRT;
RSFHFVKFFFQVRTL; SFHFVKFFFQVRTLS; FHFVKFFFQVRTLSF;
HFVKFFFQVRTLSFV; FVKFFFQVRTLSFVR; VKFFFQVRTLSFVRI;
KFFFQVRTLSFVRIF; FFFQVRTLSFVRIFL; FFQVRTLSFVRIFLN;
FQVRTLSFVRIFLNI; QVRTLSFVRIFLNIF; VRTLSFVRIFLNIFW;
RTLSFVRIFLNIFWA; PSLVEIFGFFCLNVS; SLVEIFGFFCLNVSF;
LVEIFGFFCLNVSFL; VEIFGFFCLNVSFLN; EIFGFFCLNVSFLNL;
IFGFFCLNVSFLNLP; HFHLNNLSNCLNCLF; PHLNNLSNCLNCLFH;
HLNNLSNCLNCLFHV; LNNLSNCLNCLFHVL; NNLSNCLNCLFHVLK;
NLSNCLNCLFHVLKA; LSNCLNCLFHVLKAN; SNCLNCLFHVLKANP;
NCLNCLFHVLKANPL; CLNCLFHVLKANPLI; LNCLFHVLKANPLIQ;
NCLFHVLKANPLIQL; CLFHVLKANPLIQLL; LFHVLKANPLIQLLS;
FHVLKANPLIQLLSL; HVLKANPLIQLLSLL; VLKANPLIQLLSLLH;
LKANPLIQLLSLLHL; KANPLIQLLSLLHLQ; ANPLIQLLSLLHLQK;
NPLIQLLSLLHLQKQ; PLIQLLSLLHLQKQP; LIQLLSLLHLQKQPC;
IQLLSLLHLQKQPCT; QLLSLLHLQKQPCTD; LLSLLHLQKQPCTDL;
LHLAQRLAFPWVGLH; HLAQRLAFPWVGLHL; LAQRLAFPWVGLHLR;
AQRLAFPWVGLHLRL; QRLAFPWVGLHLRLY; RLAFPWVGLHLRLYH;
LAFPWVGLHLRLYHH; AFPWVGLHLRLYHHT; FPWVGLHLRLYHHTN;
PWVGLHLRLYHHTNL; WVGLHLRLYHHTNLI; VGLHLRLYHHTNLIT;
GLHLRLYHHTNLITL; LHLRLYHHTNLITLQ; HLRLYHHTNLITLQL;
LRLYHHTNLITLQLV; RLYHHTNLITLQLVL; LYHHTNLITLQLVLF;
YHHTNLITLQLVLFF; HHTNLITLQLVLFFH; HTNLITLQLVLFFHY;
TNLITLQLVLFFHYQ; NLITLQLVLFFHYQW; LITLQLVLFFHYQWD;
ITLQLVLFFHYQWDL; VANSAAKQHLPYIVL; ANSAAKQHLPYIVLV;
NSAAKQHLPYIVLVQ; SAAKQHLPYIVLVQH; AAKQHLPYIVLVQHF;
AKQHLPYIVLVQHFH; KQHLPYIVLVQHFHE; QHLPYIVLVQHFHEL;
HLPYIVLVQHFHELQ; LPYIVLVQHFHELQI; PYIVLVQHFHELQIL;
YIVLVQHFHELQILN; IVLVQHFHELQILNP; VLVQHFHELQILNPF;
LVQHFHELQILNPFY; VQHFHELQILNPFYL; QHFHELQILNPFYLI;
HFHELQILNPFYLIY; FHELQILNPFYLIYD; IFLLAFLPWSYEGYL;
FLLAFLPWSYEGYLL; LLAFLPWSYEGYLLF; LAFLPWSYEGYLLFF;
LKLYLLLADKYFFDF; KLYLLLADKYFFDFY; LYLLLADKYFFDFYF;
YLLLADKYFFDFYFL; LLLADKYFFDFYFLQ; LLADKYFFDFYFLQK;
SDKAGLFSDTFYTPL; DKAGLFSDTFYTPLH; KAGLFSDTFYTPLHC;
AGLFSDTFYTPLHCI; GLFSDTFYTPLHCIE; LFSDTFYTPLHCIEI;
FSDTFYTPLHCIEIL; SDTFYTPLHCIEILN; DTFYTPLHCIEILNT;
TFYTPLHCIEILNTY; FYTPLHCIEILNTYL; YTPLHCIEILNTYLI;
TPLHCIEILNTYLII; PLHCIEILNTYLIIK; LHCIEILNTYLIIKT;
HCIEILNTYLIIKTH; CIEILNTYLIIKTHP; IEILNTYLIIKTHPH;
EILNTYLIIKTHPHT; ILNTYLIIKTHPHTL; LNTYLIIKTHPHTLS;
NTYLIIKTHPHTLSL; TYLIIKTHPHTLSLL; YLIIKTHPHTLSLLH;
LIIKTHPHTLSLLHT; IIKTHPHTLSLLHTQ; LISKTPALFLQALLG;
GLLPFFFFWVVLSVE; LLPFFFFWVVLSVEN; LPFFFFWVVLSVENL;
PFFFFWVVLSVENLL; FFFFWVVLSVENLLL; FFFWVVLSVENLLLL;
FFWVVLSVENLLLLL; FWVVLSVENLLLLLH; WVVLSVENLLLLLHH;
VVLSVENLLLLLHHW; VLSVENLLLLLHHWQ; LSVENLLLLLHHWQT;
SVENLLLLLHHWQTY; VENLLLLLHHWQTYL; ENLLLLLHHWQTYLH;
NLLLLLHHWQTYLHG; LLLLLHHWQTYLHGK; LLLLHHWQTYLHGKI;
LLLHHWQTYLHGKIN; LLHHWQTYLHGKINL; LHHWQTYLHGKINLH;
HHWQTYLHGKINLHP; HWQTYLHGKINLHPI; WQTYLHGKINLHPIF;
QTYLHGKINLHPIFH; RNSTRTPTLLFHRLA; NSTRTPTLLFHRLAP;
STRTPTLLFHRLAPI; TRTPTLLFHRLAPIK; RTPTLLFHRLAPIKK;
TPTLLFHRLAPIKKI; PTLLFHRLAPIKKII; TLLFHRLAPIKKIIT;
GLLIFYYLSKYKLVT; LLIFYYLSKYKLVTL; LIFYYLSKYKLVTLK;
IFYYLSKYKLVTLKL; ISEGSFSNYLDPPLQ; SEGSFSNYLDPPLQS;
EGSFSNYLDPPLQSF; GSFSNYLDPPLQSFF; SFSNYLDPPLQSFFS;
AKPLCEAVNAVAIYP; KPLCEAVNAVAIYPN; PLCEAVNAVAIYPNQ;
LCEAVNAVAIYPNQG; CEAVNAVAIYPNQGL; EAVNAVAIYPNQGLF;
AVNAVAIYPNQGLFS; HARAVHRRLFGTNRP; ARAVHRRLFGTNRPF;
RAVHRRLFGTNRPFL; AVHRRLFGTNRPFLA; VHRRLFGTNRPFLAV;
HRRLFGTNRPFLAVQ; RRLFGTNRPFLAVQG; RLFGTNRPFLAVQGI;
LFGTNRPFLAVQGIW; FGTNRPFLAVQGIWA; GTNRPFLAVQGIWAK;
TNRPFLAVQGIWAKR; NRPFLAVQGIWAKRK; RPFLAVQGIWAKRKI;
PFLAVQGIWAKRKIS; FLAVQGIWAKRKIST; LAVQGIWAKRKISTN;
AVQGIWAKRKISTNL; ATPGSKIRLMSYLYI; TPGSKIRLMSYLYIL;
PGSKIRLMSYLYILL; GSKIRLMSYLYILLH; SKIRLMSYLYILLHF;
KIRLMSYLYILLHFF; IRLMSYLYILLHFFI; RLMSYLYILLHFFIQ;
LMSYLYILLHFFIQS; MSYLYILLHFFIQSI; SYLYILLHFFIQSIH;
YLYILLHFFIQSIHS; LYILLHFFIQSIHSL; YILLHFFIQSIHSLH;
ILLHFFIQSIHSLHF; LLHFFIQSIHSLHFI; LHFFIQSIHSLHFIL;
HFFIQSIHSLHFILV; FFIQSIHSLHFILVA; FIQSIHSLHFILVAP;
IQSIHSLHFILVAPF; QSIHSLHFILVAPFV; SIHSLHFILVAPFVR;
IHSLHFILVAPFVRV; HSLHFILVAPFVRVK; SLHFILVAPFVRVKF;
LHFILVAPFVRVKFL; HFILVAPFVRVKFLT; KVHELHGFFPVKNFI;
VHELHGFFPVKNFIH 16 mers:

ASEKASTPLLLERKGG; SEKASTPLLLERKGGG;
EKASTPLLLERKGGGR; KASTPLLLERKGGGRG;
ASTPLLLERKGGGRGG; STPLLLERKGGGRGGL;
TPLLLERKGGGRGGLG; PLLLERKGGGRGGLGL;
LLLERKGGGRGGLGLL; LLERKGGGRGGLGLLY;
LERKGGGRGGLGLLYI; ERKGGGRGGLGLLYII;
RKGGGRGGLGLLYIIK; KGGGRGGLGLLYIIKK;
GGGRGGLGLLYIIKKK; GGRGGLGLLYIIKKKA;
GRGGLGLLYIIKKKAT; RGGLGLLYIIKKKATG;
GGLGLLYIIKKKATGR; GLGLLYIIKKKATGRS;
LGLLYIIKKKATGRSC; GLLYIIKKKATGRSCL;
LLYIIKKKATGRSCLP; LYIIKKKATGRSCLPM;
YIIKKKATGRSCLPME; IIKKKATGRSCLPMEC;
IKKKATGRSCLPMECS; KKKATGRSCLPMECSQ;
KKATGRSCLPMECSQT; KATGRSCLPMECSQTM;
ATGRSCLPMECSQTMT; TGRSCLPMECSQTMTS;
GRSCLPMECSQTMTSG; RSCLPMECSQTMTSGR;
SCLPMECSQTMTSGRK; CLPMECSQTMTSGRKV;
LPMECSQTMTSGRKVH; PMECSQTMTSGRKVHD;
MECSQTMTSGRKVHDS; ECSQTMTSGRKVHDSQ;
CSQTMTSGRKVHDSQG; SQTMTSGRKVHDSQGN;
QTMTSGRKVHDSQGNA; TMTSGRKVHDSQGNAA;
MTSGRKVHDSQGNAAK; TSGRKVHDSQGNAAKP;
PQEGKCMTHREELLTH; QEGKCMTHREELLTHG;
EGKCMTHREELLTHGM; GKCMTHREELLTHGMQ;
KCMTHREELLTHGMQP; CMTHREELLTHGMQPN;
MTHREELLTHGMQPNH; THREELLTHGMQPNHD;
HREELLTHGMQPNHDL; REELLTHGMQPNHDLR;
EELLTHGMQPNHDLRK; ELLTHGMQPNHDLRKE;
LLTHGMQPNHDLRKES; LTHGMQPNHDLRKESA;
QTCFASLGILALSPVK; TCFASLGILALSPVKL;
CFASLGILALSPVKLD; FASLGILALSPVKLDK;
ASLGILALSPVKLDKG; SLGILALSPVKLDKGH;
LGILALSPVKLDKGHG; GILALSPVKLDKGHGS;
ILALSPVKLDKGHGSA; LALSPVKLDKGHGSAP;
ALSPVKLDKGHGSAPA; LSPVKLDKGHGSAPAV;
SPVKLDKGHGSAPAVT; PVKLDKGHGSAPAVTT;
VKLDKGHGSAPAVTTS; KLDKGHGSAPAVTTSF;
LDKGHGSAPAVTTSFS; DKGHGSAPAVTTSFSE;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

KGHGSAPAVTTSFSES; GHGSAPAVTTSFSESW;
NLDWNKKKSSEDFYFY; LDWNKKKSSEDFYFYF;
DWNKKKSSEDFYFYFR; WNKKKSSEDFYFYFRA;
NKKKSSEDFYFYFRAF; KKKSSEDFYFYFRAFA;
KKSSEDFYFYFRAFAG; KSSEDFYFYFRAFAGI;
SSEDFYFYFRAFAGIL; RQCRREKQKYHCFTCC;
QCRREKQKYHCFTCCK; CRREKQKYHCFTCCKR;
RREKQKYHCFTCCKRL; REKQKYHCFTCCKRLC;
EKQKYHCFTCCKRLCK; KQKYHCFTCCKRLCKR;
QKYHCFTCCKRLCKRL; KYHCFTCCKRLCKRLL;
YHCFTCCKRLCKRLLG; HCFTCCKRLCKRLLGK;
SLFFCISRFMGAALAL; LFFCISRFMGAALALL;
FFCISRFMGAALALLG; FCISRFMGAALALLGD;
CISRFMGAALALLGDL; ISRFMGAALALLGDLV;
SRFMGAALALLGDLVA; RFMGAALALLGDLVAS;
FMGAALALLGDLVASV; MGAALALLGDLVASVS;
GAALALLGDLVASVSE; AALALLGDLVASVSEA;
ALALLGDLVASVSEAA; LALLGDLVASVSEAAA;
ALLGDLVASVSEAAAA; LLGDLVASVSEAAAAT;
LGDLVASVSEAAAATG; GDLVASVSEAAAATGF;
DLVASVSEAAAATGFS; LVASVSEAAAATGFSV;
VASVSEAAAATGFSVA; ASVSEAAAATGFSVAE;
SVSEAAAATGFSVAEI; VSEAAAATGFSVAEIA;
SEAAAATGFSVAEIAA; EAAAATGFSVAEIAAG;
AAAATGFSVAEIAAGE; AAATGFSVAEIAAGEA;
AATGFSVAEIAAGEAA; ATGFSVAEIAAGEAAA;
TGFSVAEIAAGEAAAA; GFSVAEIAAGEAAAAI;
FSVAEIAAGEAAAAIE; SVAEIAAGEAAAAIEV;
VAEIAAGEAAAAIEVQ; AEIAAGEAAAAIEVQI;
EIAAGEAAAAIEVQIA; IAAGEAAAAIEVQIAS;
AAGEAAAAIEVQIASL; AGEAAAAIEVQIASLA;
GEAAAAIEVQIASLAT; EAAAAIEVQIASLATV;
AAAAIEVQIASLATVE; AAAIEVQIASLATVEG;
AAIEVQIASLATVEGI; AIEVQIASLATVEGIT;
IEVQIASLATVEGITS; EVQIASLATVEGITST;
VQIASLATVEGITSTS; QIASLATVEGITSTSE;
IASLATVEGITSTSEA; ASLATVEGITSTSEAI;
SLATVEGITSTSEAIA; LATVEGITSTSEAIAA;
ATVEGITSTSEAIAAI; TVEGITSTSEAIAAIG;
VEGITSTSEAIAAIGL; EGITSTSEAIAAIGLT;
GITSTSEAIAAIGLTP; ITSTSEAIAAIGLTPQ;
TSTSEAIAAIGLTPQT; STSEAIAAIGLTPQTY;
TSEAIAAIGLTPQTYA; SEAIAAIGLTPQTYAV;
EAIAAIGLTPQTYAVI; AIAAIGLTPQTYAVIA;
IAAIGLTPQTYAVIAG; AAIGLTPQTYAVIAGA;
AIGLTPQTYAVIAGAP; IGLTPQTYAVIAGAPG;
GLTPQTYAVIAGAPGA; LTPQTYAVIAGAPGAI;
TPQTYAVIAGAPGAIA; PQTYAVIAGAPGAIAG;
QTYAVIAGAPGAIAGF; TYAVIAGAPGAIAGFA;
YAVIAGAPGAIAGFAA; AVIAGAPGAIAGFAAL;
VIAGAPGAIAGFAALI; IAGAPGAIAGFAALIQ;
AGAPGAIAGFAALIQT; GAPGAIAGFAALIQTV;
APGAIAGFAALIQTVS; PGAIAGFAALIQTVSG;
GAIAGFAALIQTVSGI; AIAGFAALIQTVSGIS;
IAGFAALIQTVSGISS; AGFAALIQTVSGISSL;
GFAALIQTVSGISSLA; FAALIQTVSGISSLAQ;
AALIQTVSGISSLAQV; ALIQTVSGISSLAQVG;
LIQTVSGISSLAQVGY; IQTVSGISSLAQVGYK;
QTVSGISSLAQVGYKF; TVSGISSLAQVGYKFF;
VSGISSLAQVGYKFFD; SGISSLAQVGYKFFDD;
GISSLAQVGYKFFDDW; ISSLAQVGYKFFDDWD;
SSLAQVGYKFFDDWDH; SLAQVGYKFFDDWDHK;
LAQVGYKFFDDWDHKV; AQVGYKFFDDWDHKVS;
QVGYKFFDDWDHKVST; VGYKFFDDWDHKVSTV;
GYKFFDDWDHKVSTVG; YKFFDDWDHKVSTVGL;
KFFDDWDHKVSTVGLY; FFDDWDHKVSTVGLYQ;
FDDWDHKVSTVGLYQQ; DDWDHKVSTVGLYQQS;
DWDHKVSTVGLYQQSG; WDHKVSTVGLYQQSGM;
DHKVSTVGLYQQSGMA; HKVSTVGLYQQSGMAL;
KVSTVGLYQQSGMALE; VSTVGLYQQSGMALEL;
STVGLYQQSGMALELF; TVGLYQQSGMALELFN;
VGLYQQSGMALELFNP; GLYQQSGMALELFNPD;
LYQQSGMALELFNPDE; YQQSGMALELFNPDEY;
QQSGMALELFNPDEYY; QSGMALELFNPDEYYD;

SGMALELFNPDEYYDI; GMALELFNPDEYYDIL;
MALELFNPDEYYDILF; ALELFNPDEYYDILFP;
LELFNPDEYYDILFPG; ELFNPDEYYDILFPGV;
LFNPDEYYDILFPGVN; FNPDEYYDILFPGVNT;
NPDEYYDILFPGVNTF; PDEYYDILFPGVNTFV;
DEYYDILFPGVNTFVN; EYYDILFPGVNTFVNN;
YYDILFPGVNTFVNNI; YDILFPGVNTFVNNIQ;
DILFPGVNTFVNNIQY; ILFPGVNTFVNNIQYL;
LFPGVNTFVNNIQYLD; FPGVNTFVNNIQYLDP;
PGVNTFVNNIQYLDPR; GVNTFVNNIQYLDPRH;
VNTFVNNIQYLDPRHW; NTFVNNIQYLDPRHWG;
TFVNNIQYLDPRHWGP; FVNNIQYLDPRHWGPS;
VNNIQYLDPRHWGPSL; NNIQYLDPRHWGPSLF;
NIQYLDPRHWGPSLFA; IQYLDPRHWGPSLFAT;
QYLDPRHWGPSLFATI; YLDPRHWGPSLFATIS;
LDPRHWGPSLFATISQ; DPRHWGPSLFATISQA;
PRHWGPSLFATISQAL; RHWGPSLFATISQALW;
HWGPSLFATISQALWH; WGPSLFATISQALWHV;
GPSLFATISQALWHVI; PSLFATISQALWHVIR;
SLFATISQALWHVIRD; LFATISQALWHVIRDD;
FATISQALWHVIRDDI; ATISQALWHVIRDDIP;
TISQALWHVIRDDIPS; ISQALWHVIRDDIPSI;
SQALWHVIRDDIPSIT; QALWHVIRDDIPSITS;
ALWHVIRDDIPSITSQ; LWHVIRDDIPSITSQE;
WHVIRDDIPSITSQEL; HVIRDDIPSITSQELQ;
VIRDDIPSITSQELQR; IRDDIPSITSQELQRR;
RDDIPSITSQELQRRT; DDIPSITSQELQRRTE;
DIPSITSQELQRRTER; IPSITSQELQRRTERF;
PSITSQELQRRTERFF; SITSQELQRRTERFFR;
ITSQELQRRTERFFRD; TSQELQRRTERFFRDS;
SQELQRRTERFFRDSL; QELQRRTERFFRDSLA;
ELQRRTERFFRDSLAR; LQRRTERFFRDSLARF;
QRRTERFFRDSLARFL; RRTERFFRDSLARFLE;
RTERFFRDSLARFLEE; TERFFRDSLARFLEET;
ERFFRDSLARFLEETT; RFFRDSLARFLEETTW;
FFRDSLARFLEETTWT; FRDSLARFLEETTWTI;
RDSLARFLEETTWTIV; DSLARFLEETTWTIVN;
SLARFLEETTWTIVNA; LARFLEETTWTIVNAP;
ARFLEETTWTIVNAPI; RFLEETTWTIVNAPIN;
FLEETTWTIVNAPINF; LEETTWTIVNAPINFY;
EETTWTIVNAPINFYN; ETTWTIVNAPINFYNY;
TTWTIVNAPINFYNYI; TWTIVNAPINFYNYIQ;
WTIVNAPINFYNYIQQ; TIVNAPINFYNYIQQY;
IVNAPINFYNYIQQYY; VNAPINFYNYIQQYYS;
NAPINFYNYIQQYYSD; APINFYNYIQQYYSDL;
PINFYNYIQQYYSDLS; INFYNYIQQYYSDLSP;
NFYNYIQQYYSDLSPI; FYNYIQQYYSDLSPIR;
YNYIQQYYSDLSPIRP; NYIQQYYSDLSPIRPS;
YIQQYYSDLSPIRPSM; IQQYYSDLSPIRPSMV;
QQYYSDLSPIRPSMVR; QYYSDLSPIRPSMVRQ;
YYSDLSPIRPSMVRQV; YSDLSPIRPSMVRQVA;
SDLSPIRPSMVRQVAE; DLSPIRPSMVRQVAER;
LSPIRPSMVRQVAERE; SPIRPSMVRQVAEREG;
PIRPSMVRQVAEREGT; IRPSMVRQVAEREGTR;
RPSMVRQVAEREGTRV; PSMVRQVAEREGTRVH;
SMVRQVAEREGTRVHF; MVRQVAEREGTRVHFG;
VRQVAEREGTRVHFGH; RQVAEREGTRVHFGHT;
QVAEREGTRVHFGHTY; VAEREGTRVHFGHTYS;
AEREGTRVHFGHTYSI; EREGTRVHFGHTYSID;
REGTRVHFGHTYSIDD; EGTRVHFGHTYSIDDA;
GTRVHFGHTYSIDDAD; TRVHFGHTYSIDDADS;
RVHFGHTYSIDDADSI; VHFGHTYSIDDADSIE;
HFGHTYSIDDADSIEE; FGHTYSIDDADSIEEV;
GHTYSIDDADSIEEVT; HTYSIDDADSIEEVTQ;
TYSIDDADSIEEVTQR; YSIDDADSIEEVTQRM;
SIDDADSIEEVTQRMD; IDDADSIEEVTQRMDL;
DDADSIEEVTQRMDLR; DADSIEEVTQRMDLRN;
ADSIEEVTQRMDLRNQ; DSIEEVTQRMDLRNQQ;
SIEEVTQRMDLRNQQS; IEEVTQRMDLRNQQSV;
EEVTQRMDLRNQQSVH; EVTQRMDLRNQQSVHS;
VTQRMDLRNQQSVHSG; TQRMDLRNQQSVHSGE;
QRMDLRNQQSVHSGEF; RMDLRNQQSVHSGEFI;
MDLRNQQSVHSGEFIE; DLRNQQSVHSGEFIEK;
LRNQQSVHSGEFIEKT; RNQQSVHSGEFIEKTI;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

NQQSVHSGEFIEKTIA; QQSVHSGEFIEKTIAP;
QSVHSGEFIEKTIAPG; SVHSGEFIEKTIAPGG;
VHSGEFIEKTIAPGGA; HSGEFIEKTIAPGGAN;
SGEFIEKTIAPGGANQ; GEFIEKTIAPGGANQR;
EFIEKTIAPGGANQRT; FIEKTIAPGGANQRTA;
IEKTIAPGGANQRTAP; EKTIAPGGANQRTAPQ;
KTIAPGGANQRTAPQW; TIAPGGANQRTAPQWM;
IAPGGANQRTAPQWML; APGGANQRTAPQWMLP;
PGGANQRTAPQWMLPL; GGANQRTAPQWMLPLL;
GANQRTAPQWMLPLLL; ANQRTAPQWMLPLLLG;
NQRTAPQWMLPLLLGL; QRTAPQWMLPLLLGLY;
RTAPQWMLPLLLGLYG; TAPQWMLPLLLGLYGT;
APQWMLPLLLGLYGTV; PQWMLPLLLGLYGTVT;
QWMLPLLLGLYGTVTP; WMLPLLLGLYGTVTPA;
MLPLLLGLYGTVTPAL; LPLLLGLYGTVTPALE;
PLLLGLYGTVTPALEA; LLLGLYGTVTPALEAY;
LLGLYGTVTPALEAYE; LGLYGTVTPALEAYED;
GLYGTVTPALEAYEDG; LYGTVTPALEAYEDGP;
YGTVTPALEAYEDGPN; GTVTPALEAYEDGPNQ;
TVTPALEAYEDGPNQK; VTPALEAYEDGPNQKK;
TPALEAYEDGPNQKKR; PALEAYEDGPNQKKRR;
ALEAYEDGPNQKKRRV; LEAYEDGPNQKKRRVS;
EAYEDGPNQKKRRVSR; AYEDGPNQKKRRVSRG;
YEDGPNQKKRRVSRGS; EDGPNQKKRRVSRGSS;
DGPNQKKRRVSRGSSQ; GPNQKKRRVSRGSSQK;
PNQKKRRVSRGSSQKA; NQKKRRVSRGSSQKAK;
QKKRRVSRGSSQKAKG; KKRRVSRGSSQKAKGT;
KRRVSRGSSQKAKGTR; RRVSRGSSQKAKGTRA;
RVSRGSSQKAKGTRAS; VSRGSSQKAKGTRASA;
SRGSSQKAKGTRASAK; RGSSQKAKGTRASAKT;
GSSQKAKGTRASAKTT; SSQKAKGTRASAKTTN;
SQKAKGTRASAKTTNK; QKAKGTRASAKTTNKR;
KAKGTRASAKTTNKRR; AKGTRASAKTTNKRRS;
KGTRASAKTTNKRRSR; GTRASAKTTNKRRSRS;
TRASAKTTNKRRSRSS; RASAKTTNKRRSRSSR;
ASAKTTNKRRSRSSRS; NWGRCYYRGRMLPKPR;
WGRCYYRGRMLPKPRN; GRCYYRGRMLPKPRNG;
RCYYRGRMLPKPRNGG; CYYRGRMLPKPRNGGS;
YYRGRMLPKPRNGGSR; PREKNASLLQHSKNSP;
REKNASLLQHSKNSPP; EKNASLLQHSKNSPPQ;
KNASLLQHSKNSPPQF; NASLLQHSKNSPPQFK;
GPNLWKSTDVGGCNCT; PNLWKSTDVGGCNCTN;
NLWKSTDVGGCNCTNR; LWKSTDVGGCNCTNRG;
WKSTDVGGCNCTNRGY; KSTDVGGCNCTNRGYW;
STDVGGCNCTNRGYWN; TDVGGCNCTNRGYWNN;
FPLLCCRWRTLGNAGS; PLLCCRWRTLGNAGSA;
LLCCRWRTLGNAGSAN; LCCRWRTLGNAGSANE;
CCRWRTLGNAGSANEL; CRWRTLGNAGSANELQ;
RWRTLGNAGSANELQV; WRTLGNAGSANELQVK;
RTLGNAGSANELQVKV; TLGNAGSANELQVKVP;
VFWDFHRRGKCSPSTS; FWDFHRRGKCSPSTSC;
WDFHRRGKCSPSTSCD; DFHRRGKCSPSTSCDQ;
FHRRGKCSPSTSCDQH; HRRGKCSPSTSCDQHS;
RRGKCSPSTSCDQHSY; RGKCSPSTSCDQHSYH;
GKCSPSTSCDQHSYHS; KCSPSTSCDQHSYHSV;
CSPSTSCDQHSYHSVA; SPSTSCDQHSYHSVAR;
DPPEKKICKESLPNFL; PPEKKICKESLPNFLF;
PEKKICKESLPNFLFA; EKKICKESLPNFLFAK;
PYKQENPESGWAAYVW; YKQENPESGWAAYVWY;
KQENPESGWAAYVWYG; QENPESGWAAYVWYGI;
ENPESGWAAYVWYGIP; NPESGWAAYVWYGIPG;
PESGWAAYVWYGIPGR; ESGWAAYVWYGIPGRR;
SGWAAYVWYGIPGRRG; QTGTIANQNALNRCFY;
TGTIANQNALNRCFYC; GTIANQNALNRCFYCT;
TIANQNALNRCFYCTY; IANQNALNRCFYCTYT;
ANQNALNRCFYCTYTF; NQNALNRCFYCTYTFN;
QNALNRCFYCTYTFNK; NALNRCFYCTYTFNKC;
ALNRCFYCTYTFNKCC; LNRCFYCTYTFNKCCF;
NRCFYCTYTFNKCCFC; RCFYCTYTFNKCCFCI;
CFYCTYTFNKCCFCIS; FYCTYTFNKCCFCISH;
YCTYTFNKCCFCISHF; NTESLYTNATLDYGGL;
TESLYTNATLDYGGLT; ESLYTNATLDYGGLTF;
SLYTNATLDYGGLTFG; LYTNATLDYGGLTFGN;
YTNATLDYGGLTFGNL; TNATLDYGGLTFGNLQ;

NATLDYGGLTFGNLQQ; ATLDYGGLTFGNLQQG;
TLDYGGLTFGNLQQGL; LDYGGLTFGNLQQGLK;
DYGGLTFGNLQQGLKY; YGGLTFGNLQQGLKYL;
GGLTFGNLQQGLKYLR; GLTFGNLQQGLKYLRL;
LTFGNLQQGLKYLRLG; TFGNLQQGLKYLRLGK;
FGNLQQGLKYLRLGKS; GNLQQGLKYLRLGKSI;
NLQQGLKYLRLGKSIV; LQQGLKYLRLGKSIVI;
QQGLKYLRLGKSIVIG; QGLKYLRLGKSIVIGI;
GLKYLRLGKSIVIGIQ; LKYLRLGKSIVIGIQC;
KYLRLGKSIVIGIQCL; YLRLGKSIVIGIQCLI;
LRLGKSIVIGIQCLIH; RLGKSIVIGIQCLIHV;
LGKSIVIGIQCLIHVQ; GKSIVIGIQCLIHVQS;
KSIVIGIQCLIHVQSL; SIVIGIQCLIHVQSLQ;
IVIGIQCLIHVQSLQF; VIGIQCLIHVQSLQFL;
IGIQCLIHVQSLQFLN; GIQCLIHVQSLQFLNP;
IQCLIHVQSLQFLNPL; QCLIHVQSLQFLNPLL;
CLIHVQSLQFLNPLLL; YQEYISPCIYYISSLK;
QEYISPCIYYISSLKK; EYISPCIYYISSLKKY;
YISPCIYYISSLKKYT; ISPCIYYISSLKKYTY;
SPCIYYISSLKKYTYL; PCIYYISSLKKYTYLS;
CIYYISSLKKYTYLSQ; IYYISSLKKYTYLSQN;
YYISSLKKYTYLSQNP; YISSLKKYTYLSQNPA;
ISSLKKYTYLSQNPAF; SSLKKYTYLSQNPAFP;
SLKKYTYLSQNPAFPS; LKKYTYLSQNPAFPSI;
KKYTYLSQNPAFPSIQ; KYTYLSQNPAFPSIQQ;
YTYLSQNPAFPSIQQF; TKLAVATRSFHFVKFF;
KLAVATRSFHFVKFFF; LAVATRSFHFVKFFFQ;
AVATRSFHFVKFFFQV; VATRSFHFVKFFFQVR;
ATRSFHFVKFFFQVRT; TRSFHFVKFFFQVRTL;
RSFHFVKFFFQVRTLS; SFHFVKFFFQVRTLSF;
FHFVKFFFQVRTLSFV; HFVKFFFQVRTLSFVR;
FVKFFFQVRTLSFVRI; VKFFFQVRTLSFVRIF;
KFFFQVRTLSFVRIFL; FFFQVRTLSFVRIFLN;
FFQVRTLSFVRIFLNI; FQVRTLSFVRIFLNIF;
QVRTLSFVRIFLNIFW; VRTLSFVRIFLNIFWA;
PSLVEIFGFFCLNVSF; SLVEIFGFFCLNVSFL;
LVEIFGFFCLNVSFLN; VEIFGFFCLNVSFLNL;
EIFGFFCLNVSFLNLP; HFHLNNLSNCLNCLFH;
FHLNNLSNCLNCLFHV; HLNNLSNCLNCLFHVL;
LNNLSNCLNCLFHVLK; NNLSNCLNCLFHVLKA;
NLSNCLNCLFHVLKAN; LSNCLNCLFHVLKANP;
SNCLNCLFHVLKANPL; NCLNCLFHVLKANPLI;
CLNCLFHVLKANPLIQ; LNCLFHVLKANPLIQL;
NCLFHVLKANPLIQLL; CLFHVLKANPLIQLLS;
LFHVLKANPLIQLLSL; FHVLKANPLIQLLSLL;
HVLKANPLIQLLSLLH; VLKANPLIQLLSLLHL;
LKANPLIQLLSLLHLQ; KANPLIQLLSLLHLQK;
ANPLIQLLSLLHLQKQ; NPLIQLLSLLHLQKQP;
PLIQLLSLLHLQKQPC; LIQLLSLLHLQKQPCT;
IQLLSLLHLQKQPCTD; QLLSLLHLQKQPCTDL;
LHLAQRLAFPWVGLHL; HLAQRLAFPWVGLHLR;
LAQRLAFPWVGLHLRL; AQRLAFPWVGLHLRLY;
QRLAFPWVGLHLRLYH; RLAFPWVGLHLRLYHH;
LAFPWVGLHLRLYHHT; AFPWVGLHLRLYHHTN;
FPWVGLHLRLYHHTNL; PWVGLHLRLYHHTNLI;
WVGLHLRLYHHTNLIT; VGLHLRLYHHTNLITL;
GLHLRLYHHTNLITLQ; LHLRLYHHTNLITLQL;
HLRLYHHTNLITLQLV; LRLYHHTNLITLQLVL;
RLYHHTNLITLQLVLF; LYHHTNLITLQLVLFF;
YHHTNLITLQLVLFFH; HHTNLITLQLVLFFHY;
HTNLITLQLVLFFHYQ; TNLITLQLVLFFHYQW;
NLITLQLVLFFHYQWD; LITLQLVLFFHYQWDL;
VANSAAKQHLPYIVLV; ANSAAKQHLPYIVLVQ;
NSAAKQHLPYIVLVQH; SAAKQHLPYIVLVQHF;
AAKQHLPYIVLVQHFH; AKQHLPYIVLVQHFHE;
KQHLPYIVLVQHFHEL; QHLPYIVLVQHFHELQ;
HLPYIVLVQHFHELQI; LPYIVLVQHFHELQIL;
PYIVLVQHFHELQILN; YIVLVQHFHELQILNP;
IVLVQHFHELQILNPF; VLVQHFHELQILNPFY;
LVQHFHELQILNPFYL; VQHFHELQILNPFYLI;
QHFHELQILNPFYLIY; HFHELQILNPFYLIYD;
IFLLAFLPWSYEGYLL; FLLAFLPWSYEGYLLF;
LLAFLPWSYEGYLLFF; LKLYLLLADKYFFDFY;
KLYLLLADKYFFDFYF; LYLLLADKYFFDFYFL;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

YLLLADKYFFDFYFLQ; LLLADKYFFDFYFLQK;
SDKAGLFSDTFYTPLH; DKAGLFSDTFYTPLHC;
KAGLFSDTFYTPLHCI; AGLFSDTFYTPLHCIE;
GLFSDTFYTPLHCIEI; LFSDTFYTPLHCIEIL;
FSDTFYTPLHCIEILN; SDTFYTPLHCIEILNT;
DTFYTPLHCIEILNTY; TFYTPLHCIEILNTYL;
FYTPLHCIEILNTYLI; YTPLHCIEILNTYLII;
TPLHCIEILNTYLIIK; PLHCIEILNTYLIIKT;
LHCIEILNTYLIIKTH; HCIEILNTYLIIKTHP;
CIEILNTYLIIKTHPH; IEILNTYLIIKTHPHT;
EILNTYLIIKTHPHTL; ILNTYLIIKTHPHTLS;
LNTYLIIKTHPHTLSL; NTYLIIKTHPHTLSLL;
TYLIIKTHPHTLSLLH; YLIIKTHPHTLSLLHT;
LIIKTHPHTLSLLHTQ; GLLPFFFFWVVLSVEN;
LLPFFFFWVVLSVENL; LPFFFFWVVLSVENLL;
PFFFFWVVLSVENLLL; FFFFWVVLSVENLLLL;
FFFWVVLSVENLLLLL; FFWVVLSVENLLLLLH;
FWVVLSVENLLLLLHH; WVVLSVENLLLLLHHW;
VVLSVENLLLLLHHWQ; VLSVENLLLLLHHWQT;
LSVENLLLLLHHWQTY; SVENLLLLLHHWQTYL;
VENLLLLLHHWQTYLH; ENLLLLLHHWQTYLHG;
NLLLLLHHWQTYLHGK; LLLLLHHWQTYLHGKI;
LLLLHHWQTYLHGKIN; LLLHHWQTYLHGKINL;
LLHHWQTYLHGKINLH; LHHWQTYLHGKINLHP;
HHWQTYLHGKINLHPI; HWQTYLHGKINLHPIF;
WQTYLHGKINLHPIFH; RNSTRTPTLLFHRLAP;
NSTRTPTLLFHRLAPI; STRTPTLLFHRLAPIK;
TRTPTLLFHRLAPIKK; RTPTLLFHRLAPIKKI;
TPTLLFHRLAPIKKII; PTLLFHRLAPIKKIIT;
GLLIFYYLSKYKLVTL; LLIFYYLSKYKLVTLK;
LIFYYLSKYKLVTLKL; ISEGSFSNYLDPPLQS;
SEGSFSNYLDPPLQSF; EGSFSNYLDPPLQSFF;
GSFSNYLDPPLQSFFS; AKPLCEAVNAVAIYPN;
KPLCEAVNAVAIYPNQ; PLCEAVNAVAIYPNQG;
LCEAVNAVAIYPNQGL; CEAVNAVAIYPNQGLF;
EAVNAVAIYPNQGLFS; HARAVHRRLFGTNRPF;
ARAVHRRLFGTNRPFL; RAVHRRLFGTNRPFLA;
AVHRRLFGTNRPFLAV; VHRRLFGTNRPFLAVQ;
HRRLFGTNRPFLAVQG; RRLFGTNRPFLAVQGI;
RLFGTNRPFLAVQGIW; LFGTNRPFLAVQGIWA;
FGTNRPFLAVQGIWAK; GTNRPFLAVQGIWAKR;
TNRPFLAVQGIWAKRK; NRPFLAVQGIWAKRKI;
RPFLAVQGIWAKRKIS; PFLAVQGIWAKRKIST;
FLAVQGIWAKRKISTN; LAVQGIWAKRKISTNL;
ATPGSKIRLMSYLYIL; TPGSKIRLMSYLYILL;
PGSKIRLMSYLYILLH; GSKIRLMSYLYILLHF;
SKIRLMSYLYILLHFF; KIRLMSYLYILLHFFI;
IRLMSYLYILLHFFIQ; RLMSYLYILLHFFIQS;
LMSYLYILLHFFIQSI; MSYLYILLHFFIQSIH;
SYLYILLHFFIQSIHS; YLYILLHFFIQSIHSL;
LYILLHFFIQSIHSLH; YILLHFFIQSIHSLHF;
ILLHFFIQSIHSLHFI; LLHFFIQSIHSLHFIL;
LHFFIQSIHSLHFILV; HFFIQSIHSLHFILVA;
FFIQSIHSLHFILVAP; FIQSIHSLHFILVAPF;
IQSIHSLHFILVAPFV; QSIHSLHFILVAPFVR;
SIHSLHFILVAPFVRV; IHSLHFILVAPFVRVK;
HSLHFILVAPFVRVKF; SLHFILVAPFVRVKFL;
LHFILVAPFVRVKFLT; HFILVAPFVRVKFLT

---

BK virus reverse reading frame 1

13 mers:

MDKVLNREESMEL; DKVLNREESMELM; KVLNREESMELMD;
VLNREESMELMDL; LNREESMELMDLL; NREESMELMDLLG;
REESMELMDLLGL; EESMELMDLLGLE; ESMELMDLLGLER;
SMELMDLLGLERA; MELMDLLGLERAA; ELMDLLGLERAAW;
LMDLLGLERAAWG; MDLLGLERAAWGN; DLLGLERAAWGNL;
LLGLERAAWGNLP; LGLERAAWGNLPL; GLERAAWGNLPLM;
LERAAWGNLPLMR; ERAAWGNLPLMRK; RAAWGNLPLMRKA;
AAWGNLPLMRKAY; AWGNLPLMRKAYL; WGNLPLMRKAYLR;
GNLPLMRKAYLRK; NLPLMRKAYLRKC; LPLMRKAYLRKCK;
PLMRKAYLRKCKE; LMRKAYLRKCKEF; MRKAYLRKCKEFH;

RKAYLRKCKEFHP; KAYLRKCKEFHPD; AYLRKCKEFHPDK;
YLRKCKEFHPDKG; LRKCKEFHPDKGG; RKCKEFHPDKGGD;
KCKEFHPDKGGDE; CKEFHPDKGGDED; KEFHPDKGGDEDK;
EFHPDKGGDEDKM; FHPDKGGDEDKMK; HPDKGGDEDKMKR;
PDKGGDEDKMKRM; DKGGDEDKMKRMN; KGGDEDKMKRMNT;
GGDEDKMKRMNTL; GDEDKMKRMNTLY; DEDKMKRMNTLYK;
EDKMKRMNTLYKK; DKMKRMNTLYKKM; KMKRMNTLYKKME;
MKRMNTLYKKMEQ; KRMNTLYKKMEQD; RMNTLYKKMEQDV;
MNTLYKKMEQDVK; NTLYKKMEQDVKV; TLYKKMEQDVKVA;
LYKKMEQDVKVAH; YKKMEQDVKVAHQ; KKMEQDVKVAHQP;
KMEQDVKVAHQPD; MEQDVKVAHQPDF; EQDVKVAHQPDFG;
QDVKVAHQPDFGT; DVKVAHQPDFGTW; VKVAHQPDFGTWS;
KVAHQPDFGTWSS; VAHQPDFGTWSSS; AHQPDFGTWSSSE;
HQPDFGTWSSSEV; QPDFGTWSSSEVC; PDFGTWSSSEVCA;
DFGTWSSSEVCAD; FGTWSSSEVCADF; GTWSSSEVCADFP;
TWSSSEVCADFPL; WSSSEVCADFPLC; SSSEVCADFPLCP;
SSEVCADFPLCPD; SEVCADFPLCPDT; EVCADFPLCPDTL;
VCADFPLCPDTLY; CADFPLCPDTLYC; ADFPLCPDTLYCK;
DFPLCPDTLYCKE; FPLCPDTLYCKEW; PLCPDTLYCKEWP;
LCPDTLYCKEWPI; CPDTLYCKEWPIC; PDTLYCKEWPICS;
DTLYCKEWPICSK; TLYCKEWPICSKK; LYCKEWPICSKKP;
YCKEWPICSKKPS; CKEWPICSKKPSV; KEWPICSKKPSVH;
EWPICSKKPSVHC; WPICSKKPSVHCP; PICSKKPSVHCPC;
ICSKKPSVHCPCM; CSKKPSVHCPCML; SKKPSVHCPCMLC;
KKPSVHCPCMLCQ; KPSVHCPCMLCQL; PSVHCPCMLCQLR;
SVHCPCMLCQLRL; VHCPCMLCQLRLR; HCPCMLCQLRLRH;
CPCMLCQLRLRHL; PCMLCQLRLRHLN; CMLCQLRLRHLNR;
MLCQLRLRHLNRK; LCQLRLRHLNRKF; CQLRLRHLNRKFL;
QLRLRHLNRKFLR; LRLRHLNRKFLRK; RLRHLNRKFLRKE;
LRHLNRKFLRKEP; RHLNRKFLRKEPL; HLNRKFLRKEPLV;
LNRKFLRKEPLVW; NRKFLRKEPLVWI; RKFLRKEPLVWID;
KFLRKEPLVWIDC; FLRKEPLVWIDCY; LRKEPLVWIDCYC;
RKEPLVWIDCYCI; KEPLVWIDCYCID; EPLVWIDCYCIDC;
PLVWIDCYCIDCF; LVWIDCYCIDCFT; VWIDCYCIDCFTQ;
WIDCYCIDCFTQW; IDCYCIDCFTQWF; DCYCIDCFTQWFG;
CYCIDCFTQWFGL; YCIDCFTQWFGLD; CIDCFTQWFGLDL;
IDCFTQWFGLDLT; DCFTQWFGLDLTE; CFTQWFGLDLTEE;
FTQWFGLDLTEET; TQWFGLDLTEETL; QWFGLDLTEETLQ;
WFGLDLTEETLQW; FGLDLTEETLQWW; GLDLTEETLQWWV;
LDLTEETLQWWVQ; DLTEETLQWWVQI; LTEETLQWWVQII;
TEETLQWWVQIIG; EETLQWWVQIIGE; ETLQWWVQIIGET;
TLQWWVQIIGETP; LQWWVQIIGETPF; QWWVQIIGETPFR;
WWVQIIGETPFRD; WVQIIGETPFRDL; VQIIGETPFRDLK;
QIIGETPFRDLKL; KALSNYFFYRCQP; ALSNYFFYRCQPM;
LSNYFFYRCQPME; SNYFFYRCQPMEQ; NYFFYRCQPMEQK;
YFFYRCQPMEQKS; FFYRCQPMEQKSG; FYRCQPMEQKSGS;
YRCQPMEQKSGSP; RCQPMEQKSGSPG; CQPMEQKSGSPGG;
QPMEQKSGSPGGV; PMEQKSGSPGGVP; MEQKSGSPGGVPL;
EQKSGSPGGVPLM; QKSGSPGGVPLMK; KSGSPGGVPLMKN;
SGSPGGVPLMKNG; GSPGGVPLMKNGM; SPGGVPLMKNGMK;
PGGVPLMKNGMKI; GGVPLMKNGMKIY; GVPLMKNGMKIYF;
VPLMKNGMKIYFA; PLMKNGMKIYFAM; LMKNGMKIYFAMK;
MKNGMKIYFAMKI; KNGMKIYFAMKIC; NGMKIYFAMKICL;
GMKIYFAMKICLP; MKIYFAMKICLPV; KIYFAMKICLPVM;
IYFAMKICLPVMK; YFAMKICLPVMKK; FAMKICLPVMKKQ;
AMKICLPVMKKQQ; MKICLPVMKKQQQ; KICLPVMKKQQQI;
ICLPVMKKQQQIL; CLPVMKKQQQILN; LPVMKKQQQILNT;
PVMKKQQQILNTQ; VMKKQQQILNTQH; MKKQQQILNTQHH;
KKQQQILNTQHHP; KQQQILNTQHHPK; QQQILNTQHHPKK;
QQILNTQHHPKKK; QILNTQHHPKKKE; ILNTQHHPKKKER;
KTLKTFPLIYTSF; TLKTFPLIYTSFL; LKTFPLIYTSFLV;
KTFPLIYTSFLVK; TFPLIYTSFLVKL; FPLIYTSFLVKLY;
PLIYTSFLVKLYL; LIYTSFLVKLYLV; IYTSFLVKLYLVI;
YTSFLVKLYLVIE; TSFLVKLYLVIEP; SFLVKLYLVIEPL;
FLVKLYLVIEPLP; LVKLYLVIEPLPA; VKLYLVIEPLPAL;
KLYLVIEPLPALL; LYLVIEPLPALLC; YLVIEPLPALLCI;
LVIEPLPALLCIL; VIEPLPALLCILL; IEPLPALLCILLK;
EPLPALLCILLKK; PLPALLCILLKKK; LPALLCILLKKKL;
PALLCILLKKKLK; ALLCILLKKKLKF; LLCILLKKKLKFC;
LCILLKKKLKFCI; CILLKKKLKFCIK; ILLKKKLKFCIKN;
LLKKKLKFCIKNL; LKKKLKFCIKNLW; KKKLKFCIKNLWK;
KKLKFCIKNLWKN; KLKFCIKNLWKNI; LKFCIKNLWKNIL;
LLLVDTCVLGIIL; LLVDTCVLGIILY; LVDTCVLGIILYS;
VDTCVLGIILYSF; LHIDIEFLQLIIS; HIDIEFLQLIISV;

TABLE O-continued

Predicted MHC class 2 BK virus peptide sequences. Prediction of 13-, 14-, 15-, 16-mers from all 6 reading frames of the genome (access no #V01108) obtained using the program displayed in FIG. 2.

IDIEFLQLIISVK; DIEFLQLIISVKS; IEFLQLIISVKSC;
EFLQLIISVKSCV; FLQLIISVKSCVP; LQLIISVKSCVPL;
QLIISVKSCVPLV; LIISVKSCVPLVF; FVRVLIRNTYYIV;
VRVLIRNTYYIVP; RSMILAQKSLKKQ; SMILAQKSLKKQS;
MILAQKSLKKQSR; ILAQKSLKKQSRC; LAQKSLKKQSRCL;
AQKSLKKQSRCLG; QKSLKKQSRCLGN; RSVKSVRKKTSLI;
SVKSVRKKTSLIT; VKSVRKKTSLITL; KSVRKKTSLITLS;
SVRKKTSLITLSI; VRKKTSLITLSIM; RKKTSLITLSIMK;
KKTSLITLSIMKS; KTSLITLSIMKST; TSLITLSIMKSTL;
SLITLSIMKSTLQ; LITLSIMKSTLQM; ITLSIMKSTLQML;
TLSIMKSTLQMLL; LSIMKSTLQMLLF; SIMKSTLQMLLFL;
IMKSTLQMLLFLQ; MKSTLQMLLFLQK; KSTLQMLLFLQKV;
STLQMLLFLQKVK; TLQMLLFLQKVKI; LQMLLFLQKVKIK;
QMLLFLQKVKIKK; MLLFLQKVKIKKV; LLFLQKVKIKKVF;
LFLQKVKIKKVFV; FLQKVKIKKVFVS; LQKVKIKKVFVSK;
QKVKIKKVFVSKQ; NNIWQVLLGCTVC; NIWQVLLGCTVCY;
IWQVLLGCTVCYL; WQVLLGCTVCYLK; QVLLGCTVCYLKW;
VLLGCTVCYLKWI; LLGCTVCYLKWIL; YLIFCTVLFSMYL;
LIFCTVLFSMYLK; IFCTVLFSMYLKE; FCTVLFSMYLKED;
CTVLFSMYLKEDT; TVLFSMYLKEDTG; VLFSMYLKEDTGY;
LFSMYLKEDTGYL; FSMYLKEDTGYLK; SMYLKEDTGYLKV;
MYLKEDTGYLKVP; YLKEDTGYLKVPL; LKEDTGYLKVPLI;
KEDTGYLKVPLIV; EDTGYLKVPLIVE; DTGYLKVPLIVEK;
TGYLKVPLIVEKQ; GYLKVPLIVEKQH; KGQELNQRICLQD;
GQELNQRICLQDM; QELNQRICLQDME; TKEPKYFHQAWLQ;
MSILSLKPCKLDL; ENPYKTQSSYLKK; NPYKTQSSYLKKE;
PYKTQSSYLKKEF; YKTQSSYLKKEFY; KTQSSYLKKEFYK;
TQSSYLKKEFYKV; QSSYLKKEFYKVE; LILQLIYNLELLN;
ILQLIYNLELLNG; LQLIYNLELLNGR; QLIYNLELLNGRK;
LIYNLELLNGRKG; IYNLELLNGRKGW; YNLELLNGRKGWI;
NLELLNGRKGWIL; LELLNGRKGWILR; NIIYAWGNVFLIL;
IIYAWGNVFLILQ; IYAWGNVFLILQE; YAWGNVFLILQEK;
AWGNVFLILQEKR; WGNVFLILQEKRI; GNVFLILQEKRIQ;
NVFLILQEKRIQK; VFLILQEKRIQKL; FLILQEKRIQKLK;
LILQEKRIQKLKT; ILQEKRIQKLKTL; LQEKRIQKLKTLD;
QEKRIQKLKTLDM; EKRIQKLKTLDMD; KRIQKLKTLDMDQ;
RIQKLKTLDMDQA; IQKLKTLDMDQAL; QKLKTLDMDQALN;
KLKTLDMDQALNP; LKTLDMDQALNPN; KTLDMDQALNPNH;
TLDMDQALNPNHN; LDMDQALNPNHNA; DMDQALNPNHNAL;
MDQALNPNHNALP; DQALNPNHNALPK; QALNPNHNALPKS;
ALNPNHNALPKSQ; LNPNHNALPKSQI; NPNHNALPKSQIL;
PNHNALPKSQILQ; NHNALPKSQILQP; HNALPKSQILQPL;
NALPKSQILQPLL; ALPKSQILQPLLK; LPKSQILQPLLKI;
PKSQILQPLLKIP; KSQILQPLLKIPK; SQILQPLLKIPKG;
QILQPLLKIPKGQ; ILQPLLKIPKGQT; LQPLLKIPKGQTP;
QPLLKIPKGQTPI; PLLKIPKGQTPIV; LLKIPKGQTPIVK;
LKIPKGQTPIVKS; KIPKGQTPIVKSC; IPKGQTPIVKSCI;
PKGQTPIVKSCIC; KGQTPIVKSCICV; GQTPIVKSCICVK;
QTPIVKSCICVKA; TPIVKSCICVKAF; PIVKSCICVKAFS;
IVKSCICVKAFSV; VKSCICVKAFSVL; KSCICVKAFSVLK;
SCICVKAFSVLKG; CICVKAFSVLKGL; ICVKAFSVLKGLK;
CVKAFSVLKGLKH; VKAFSVLKGLKHH; KAFSVLKGLKHHP;
AFSVLKGLKHHPQ; FSVLKGLKHHPQN; SVLKGLKHHPQNN;
VLKGLKHHPQNNT; LKGLKHHPQNNTS; KGLKHHPQNNTSL;
GLKHHPQNNTSLK; LKHHPQNNTSLKV; KHHPQNNTSLKVA;
HHPQNNTSLKVAY; HPQNNTSLKVAYT; PQNNTSLKVAYTK;
QNNTSLKVAYTKA; NNTSLKVAYTKAA; NTSLKVAYTKAAF;
TSLKVAYTKAAFI; SLKVAYTKAAFIK; LKVAYTKAAFIKC;
KVAYTKAAFIKCI; VAYTKAAFIKCIC; AYTKAAFIKCICT;
YTKAAFIKCICTI; TKAAFIKCICTIK; KAAFIKCICTIKA;
AAFIKCICTIKAP; AFIKCICTIKAPV; SILVCNCPCLSIY;
ILVCNCPCLSIYL; LVCNCPCLSIYLI; VCNCPCLSIYLII;
CNCPCLSIYLIIS; NCPCLSIYLIISG; CPCLSIYLIISGS;
PCLSIYLIISGSP; CLSIYLIISGSPG; LSIYLIISGSPGS;
SIYLIISGSPGSL; IYLIISGSPGSLS; YLIISGSPGSLSV;
LIISGSPGSLSVP; IISGSPGSLSVPS; ISGSPGSLSVPSN;
SGSPGSLSVPSNT; GSPGSLSVPSNTL; SPGSLSVPSNTLT;
PGSLSVPSNTLTS; GSLSVPSNTLTSS; SLSVPSNTLTSST;
LSVPSNTLTSSTW; SVPSNTLTSSTWD; PSNTLTSSTWDSI;
SNTLTSSTWDSIP; NTLTSSTWDSIPY; TLTSSTWDSIPYI;
LTSSTWDSIPYIG; TSSTWDSIPYIGC; SSTWDSIPYIGCP;
STWDSIPYIGCPS; TWDSIPYIGCPST;
WDSIPYIGCPSTL; DSIPYIGCPSTLW; SIPYIGCPSTLWV;
IPYIGCPSTLWVL; PYIGCPSTLWVLL; YIGCPSTLWVLLF;
IGCPSTLWVLLFI; GCPSTLWVLLFIR; CPSTLWVLLFIRS;
PSTLWVLLFIRSL; STLWVLLFIRSLS; TLWVLLFIRSLSK;
LWVLLFIRSLSKK; WVLLFIRSLSKKE; VLLFIRSLSKKEI;
LLFIRSLSKKEIG; GFFTDLFLRRILK; FFTDLFLRRILKY;
FTDLFLRRILKYL; TDLFLRRILKYLA; DLFLRRILKYLAR;
LFLRRILKYLARP; FLRRILKYLARPL; LRRILKYLARPLH;
RRILKYLARPLHC; RILKYLARPLHCC; ILKYLARPLHCCV;
LKYLARPLHCCVP; KYLARPLHCCVPE; YLARPLHCCVPEL;
LARPLHCCVPELL; ARPLHCCVPELLV; RPLHCCVPELLVN;
PLHCCVPELLVNR; LHCCVPELLVNRP; HCCVPELLVNRPQ;
CCVPELLVNRPQI; CVPELLVNRPQIS; VPELLVNRPQISA;
PELLVNRPQISAA; ELLVNRPQISAAE; LLVNRPQISAAET;
LVNRPQISAAETY; VNRPQISAAETYR; NRPQISAAETYRL;
RPQISAAETYRLS; PQISAAETYRLSA; QISAAETYRLSAL;
ISAAETYRLSALQ; SAAETYRLSALQR; AAETYRLSALQRG;
AETYRLSALQRGP; ETYRLSALQRGPT; TYRLSALQRGPTP;
YRLSALQRGPTPC; RLSALQRGPTPCS; LSALQRGPTPCSS;
SALQRGPTPCSSS; ALQRGPTPCSSSN; LQRGPTPCSSSNT;
QRGPTPCSSSNTV; RGPTPCSSSNTVV; GPTPCSSSNTVVA;
PTPCSSSNTVVAV; TPCSSSNTVVAVL; PCSSSNTVVAVLV;
CSSSNTVVAVLVT; STGGTFSPPVKVP; TGGTFSPPVKVPK;
GGTFSPPVKVPKY; GTFSPPVKVPKYL; TFSPPVKVPKYLA;
FSPPVKVPKYLAF; SPPVKVPKYLAFS; PPVKVPKYLAFSF;
PVKVPKYLAFSFL; VKVPKYLAFSFLL; KVPKYLAFSFLLG;
VPKYLAFSFLLGS; PKYLAFSFLLGSG; KYLAFSFLLGSGT;
YLAFSFLLGSGTQ; LAFSFLLGSGTQH; AFSFLLGSGTQHS;
FSFLLGSGTQHST; SFLLGSGTQHSTG; ALWSVFITWDWAV;
LWSVFITWDWAVG; WSVFITWDWAVGF; SVFITWDWAVGFL;
VFITWDWAVGFLG; FITWDWAVGFLGV; ITWDWAVGFLGVI;
TWDWAVGFLGVIV; WDWAVGFLGVIVP; DWAVGFLGVIVPS;
WAVGFLGVIVPSG; AVGFLGVIVPSGY; VGFLGVIVPSGYF;
GFLGVIVPSGYFD; FLGVIVPSGYFDL; FISTPCISKGSPP;
ISTPCISKGSPPT; STPCISKGSPPTA; TPCISKGSPPTAK;
PCISKGSPPTAKK; CISKGSPPTAKKW; ISKGSPPTAKKWK;
SKGSPPTAKKWKL; KGSPPTAKKWKLL; GSPPTAKKWKLLP;
IGFPPPCSCTFCD; GFPPPCSCTFCDP; FPPPCSCTFCDPA;
RLSMLVIPITSVC; LSMLVIPITSVCT; SMLVIPITSVCTV;
MLVIPITSVCTVT; LVIPITSVCTVTA; VIPITSVCTVTAS;
IPITSVCTVTASH; PITSVCTVTASHI; ITSVCTVTASHIS;
TSVCTVTASHISR; SVCTVTASHISRF; VCTVTASHISRFP;
CTVTASHISRFPQ; TVTASHISRFPQV; VTASHISRFPQVR;
TASHISRFPQVRS; ASHISRFPQVRSS; SHISRFPQVRSSF;
HISRFPQVRSSFK; ISRFPQVRSSFKL; SRFPQVRSSFKLG;
RFPQVRSSFKLGR; FPQVRSSFKLGRG; PQVRSSFKLGRGI;
QVRSSFKLGRGIL; VRSSFKLGRGILA; RSSFKLGRGILAV;
SSFKLGRGILAVL; QGSIFLSGLSLLK; GSIFLSGLSLLKS;
SIFLSGLSLLKSF; IFLSGLSLLKSFS; FLSGLSLLKSFSA;
LSGLSLLKSFSAL; SGLSLLKSFSALS; GLSLLKSFSALSF;
LSLLKSFSALSFR; SLLKSFSALSFRL; LLKSFSALSFRLK;
LKSFSALSFRLKP; KSFSALSFRLKPL; SFSALSFRLKPLR;
FSALSFRLKPLRF; SALSFRLKPLRFS; ALSFRLKPLRFSS;
LSFRLKPLRFSSG; SFRLKPLRFSSGS; FRLKPLRFSSGSP;
RLKPLRFSSGSPI; LKPLRFSSGSPIS; KPLRFSSGSPISG;
PLRFSSGSPISGF; LRFSSGSPISGFR; RFSSGSPISGFRK;
FSSGSPISGFRKH; SSGSPISGFRKHS; SGSPISGFRKHST;
GSPISGFRKHSTS; SPISGFRKHSTSV; PISGFRKHSTSVI;
ISGFRKHSTSVIA; SGFRKHSTSVIAS; GFRKHSTSVIAST;
FRKHSTSVIASTP; RKHSTSVIASTPV; KHSTSVIASTPVL;
HSTSVIASTPVLT; STSVIASTPVLTS; TSVIASTPVLTSR;
SVIASTPVLTSRT; VIASTPVLTSRTS; IASTPVLTSRTST;
ASTPVLTSRTSTP; STPVLTSRTSTPP; TPVLTSRTSTPPF;
PVLTSRTSTPPFI; VLTSRTSTPPFIS; LTSRTSTPPFISS;
TSRTSTPPFISSF; SRTSTPPFISSFG; RTSTPPFISSFGT;
TSTPPFISSFGTC; STPPFISSFGTCT; TPPFISSFGTCTG;
PPFISSFGTCTGS; PFISSFGTCTGSF; FISSFGTCTGSFG;
ISSFGTCTGSFGF; SSFGTCTGSFGFL; SFGTCTGSFGFLG;
FGTCTGSFGFLGA; GTCTGSFGFLGAA; TCTGSFGFLGAAP;
CTGSFGFLGAAPG; TGSFGFLGAAPGH; GSFGFLGAAPGHS;
SFGFLGAAPGHSP; FGFLGAAPGHSPF; GFLGAAPGHSPFL;
FLGAAPGHSPFLL; LGAAPGHSPFLLV; GAAPGHSPFLLVG;
AAPGHSPFLLVGA; APGHSPFLLVGAI; PGHSPFLLVGAIF;
GHSPFLLVGAIFI; HSPFLLVGAIFIC; SPFLLVGAIFICF;
PFLLVGAIFICFK; FLLVGAIFICFKS; LLVGAIFICFKSR;
LVGAIFICFKSRC; VGAIFICFKSRCY; GAIFICFKSRCYS;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

AIFICFKSRCYSP; IFICFKSRCYSPV; FICFKSRCYSPVQ;
ICFKSRCYSPVQA; RQHPLRSSSLIST; QHPLRSSSLISTS;
HPLRSSSLISTSW; PLRSSSLISTSWG; LRSSSLISTSWGN;
RSSSLISTSWGNS; SSSLISTSWGNSF; SSLISTSWGNSFF;
SLISTSWGNSFFY; LISTSWGNSFFYK; ISTSWGNSFFYKL;
STSWGNSFFYKLS; VHSLCNFFYTVSI; HSLCNFFYTVSII;
SLCNFFYTVSIIY; LCNFFYTVSIIYT; CNFFYTVSIIYTI;
NFFYTVSIIYTIS; FFYTVSIIYTISM; FYTVSIIYTISMA;
YTVSIIYTISMAK; TVSIIYTISMAKM; VSIIYTISMAKMY;
SIIYTISMAKMYT; IIYTISMAKMYTG; IYTISMAKMYTGT;
YTISMAKMYTGTF; TISMAKMYTGTFP; ISMAKMYTGTFPF;
SMAKMYTGTFPFS; MAKMYTGTFPFSY; AKMYTGTFPFSYL;
KMYTGTFPFSYLS; MYTGTFPFSYLSN; YTGTFPFSYLSNH;
GPNRGKIRIILLN; PNRGKIRIILLNI; NRGKIRIILLNII;
RGKIRIILLNIII; GKIRIILLNIIIK; KIRIILLNIIIKV;
IRIILLNIIIKVY; RIILLNIIIKVYR; IILLNIIIKVYRG;
ILLNIIIKVYRGI; LLNIIIKVYRGIY; LNIIIKVYRGIYN;
NIIIKVYRGIYNC; IIIKVYRGIYNCP; IIKVYRGIYNCPG;
IKVYRGIYNCPGS; KVYRGIYNCPGSF; VYRGIYNCPGSFL;
YRGIYNCPGSFLQ; RGIYNCPGSFLQK; GIYNCPGSFLQKS;
IYNCPGSFLQKSS; YNCPGSFLQKSSQ; NCPGSFLQKSSQG;
CPGSFLQKSSQGV; PGSFLQKSSQGVS; GSFLQKSSQGVSK;
SFLQKSSQGVSKK; FLQKSSQGVSKKS; LQKSSQGVSKKSF;
QKSSQGVSKKSFC; KSSQGVSKKSFCS; SSQGVSKKSFCSS;
SQGVSKKSFCSSL; QGVSKKSFCSSLQ; GVSKKSFCSSLQF;
VSKKSFCSSLQFL; GYRRYIIPNNMPQ; YRRYIIPNNMPQS;
RRYIIPNNMPQSL; RYIIPNNMPQSLG; YIIPNNMPQSLGN;
IIPNNMPQSLGNS; IPNNMPQSLGNSS; PNNMPQSLGNSSK;
NNMPQSLGNSSKQ; NMPQSLGNSSKQR; MPQSLGNSSKQRR;
PQSLGNSSKQRRT; QSLGNSSKQRRTP; SLGNSSKQRRTPM;
LGNSSKQRRTPMP; GNSSKQRRTPMPR; NSSKQRRTPMPRI;
SSKQRRTPMPRIK; SKQRRTPMPRIKV; KQRRTPMPRIKVL;
QRRTPMPRIKVLN; RRTPMPRIKVLNI; RTPMPRIKVLNII;
TPMPRIKVLNIIN; PMPRIKVLNIINK; MPRIKVLNIINKS;
PRIKVLNIINKSI; RIKVLNIINKSIY; IKVLNIINKSIYT;
KVLNIINKSIYTR; VLNIINKSIYTRK; LNIINKSIYTRKQ;
NIINKSIYTRKQN; IINKSIYTRKQNI; INKSIYTRKQNII;
NKSIYTRKQNIIV; KSIYTRKQNIIVL; SIYTRKQNIIVLI;
IYTRKQNIIVLIW; YTRKQNIIVLIWV; TRKQNIIVLIWVK;
RKQNIIVLIWVKQ; KQNIIVLIWVKQF; QNIIVLIWVKQFQ;
NIIVLIWVKQFQS; IIVLIWVKQFQSH; IVLIWVKQFQSHA;
LLIEAYSGNFVIP; LIEAYSGNFVIPI; IEAYSGNFVIPII;
EAYSGNFVIPIIK; AYSGNFVIPIIKE; YSGNFVIPIIKEL;
SGNFVIPIIKELI; GNFVIPIIKELIP; NFVIPIIKELIPY;
FVIPIIKELIPYL; VIPIIKELIPYLS; SSKPSNSPRSTSN;
SKPSNSPRSTSNY; KPSNSPRSTSNYS; PSNSPRSTSNYSI;
SNSPRSTSNYSIC; NSPRSTSNYSICL; SPRSTSNYSICLR;
PRSTSNYSICLRS; GTCYALYSSKGCN; TCYALYSSKGCNL;
CYALYSSKGCNLN; YALYSSKGCNLNF; ALYSSKGCNLNFY;
LYSSKGCNLNFYS; YSSKGCNLNFYSS; SSKGCNLNFYSSS;
SKGCNLNFYSSSS; KGCNLNFYSSSSL; GCNLNFYSSSSLP;
CNLNFYSSSSLPS; NLNFYSSSSLPSS; LNFYSSSSLPSSS;
NFYSSSSLPSSNF; FYSSSSLPSSNFS; YSSSSLPSSNFSH;
KSCGSSSLRYTGN; SSTHEPGNTKKKG; STHEPGNTKKKGL;
THEPGNTKKKGLL; HEPGNTKKKGLLT; ESFTESFTAGKAV;
SPTESFTAGKAVV; FTESFTAGKAVVL; TESFTAGKAVVLL;
ESFTAGKAVVLLF; SFTAGKAVVLLFF; FTAGKAVVLLFFP;
TAGKAVVLLFFPS; AGKAVVLLFFPST; GKAVVLLFFPSTL;
KAVVLLFFPSTLS; AVVLLFFPSTLSS; VVLLFFPSTLSSP;
VLLFFPSTLSSPL; LLFFPSTLSSPLQ; LFFPSTLSSPLQN;
FFPSTLSSPLQNS; FPSTLSSPLQNSS; PSTLSSPLQNSSK;
STLSSPLQNSSKS; TLSSPLQNSSKSS; LSSPLQNSSKSSK;
SSPLQNSSKSSKI; SPLQNSSKSSKIK; PLQNSSKSSKIKI;
LQNSSKSSKIKIK; QNSSKSSKIKIKI; NSSKSSKIKIKIL;
ALFFVPVQVLPTF; LFFVPVQVLPTFT; FFVPVQVLPTFTE;
FVPVQVLPTFTEA; VPVQVLPTFTEAC; PVQVLPTFTEACR;
VQVLPTFTEACRD; QVLPTFTEACRDS; VLPTFTEACRDSW;
LPTFTEACRDSWR; PTFTEACRDSWRR; TFTEACRDSWRRT;
FTEACRDSWRRTM; TEACRDSWRRTMA; EACRDSWRRTMAF;
ACRDSWRRTMAFV; CRDSWRRTMAFVQ; RDSWRRTMAFVQF;
DSWRRTMAFVQFN; SWRRTMAFVQFNW; WRRTMAFVQFNWG;
RRTMAFVQFNWGQ; RTMAFVQFNWGQG; TMAFVQFNWGQGQ;
MAFVQFNWGQGQD; AFVQFNWGQGQDS; ARKTCLSCTFLPE;
RKTCLSCTFLPEV; KTCLSCTFLPEVM; TCLSCTFLPEVMV;
CLSCTFLPEVMVW; LSCTFLPEVMVWL; SCTFLPEVMVWLH;
CTFLPEVMVWLHS; TFLPEVMVWLHSM; FLPEVMVWLHSMG;
LPEVMVWLHSMGK; PEVMVWLHSMGKQ; EVMVWLHSMGKQL;
VMVWLHSMGKQLL; MVWLHSMGKQLLP; VWLHSMGKQLLPV;
WLHSMGKQLLPVS; LHSMGKQLLPVSH; HSMGKQLLPVSHA;
SMGKQLLPVSHAL; MGKQLLPVSHALS; GKQLLPVSHALSF;
KQLLPVSHALSFL; QLLPVSHALSFLR; LLPVSHALSFLRS;
LPVSHALSFLRSW; PVSHALSFLRSWF; VSHALSFLRSWFG;
SHALSFLRSWFGC; HALSFLRSWFGCI; ALSFLRSWFGCIP;
LSFLRSWFGCIPL; EAEAASASTLSLK; GLAKLFGEIPILL;
LAKLFGEIPILLQ; AKLFGEIPILLQF; KLFGEIPILLQFL;
LFGEIPILLQFLQ 14 mers:

MDKVLNREESMELM; DKVLNREESMELMD; KVLNREESMELMDL;
VLNREESMELMDLL; LNREESMELMDLLG; NREESMELMDLLGL;
REESMELMDLLGLE; EESMELMDLLGLER; ESMELMDLLGLERA;
SMELMDLLGLERAA; MELMDLLGLERAAW; ELMDLLGLERAAWG;
LMDLLGLERAAWGN; MDLLGLERAAWGNL; DLLGLERAAWGNLP;
LLGLERAAWGNLPL; LGLERAAWGNLPLM; GLERAAWGNLPLMR;
LERAAWGNLPLMRK; ERAAWGNLPLMRKA; RAAWGNLPLMRKAY;
AAWGNLPLMRKAYL; AWGNLPLMRKAYLR; WGNLPLMRKAYLRK;
GNLPLMRKAYLRKC; NLPLMRKAYLRKCK; LPLMRKAYLRKCKE;
PLMRKAYLRKCKEF; LMRKAYLRKCKEFH; MRKAYLRKCKEFHP;
RKAYLRKCKEFHPD; KAYLRKCKEFHPDK; AYLRKCKEFHPDKG;
YLRKCKEFHPDKGG; LRKCKEFHPDKGGD; RKCKEFHPDKGGDE;
KCKEFHPDKGGDED; CKEFHPDKGGDEDK; KEFHPDKGGDEDKM;
EFHPDKGGDEDKMK; FHPDKGGDEDKMKR; HPDKGGDEDKMKRM;
PDKGGDEDKMKRMN; DKGGDEDKMKRMNT; KGGDEDKMKRMNTL;
GGDEDKMKRMNTLY; GDEDKMKRMNTLYK; DEDKMKRMNTLYKK;
EDKMKRMNTLYKKM; DKMKRMNTLYKKME; KMKRMNTLYKKMEQ;
MKRMNTLYKKMEQD; KRMNTLYKKMEQDV; RMNTLYKKMEQDVK;
MNTLYKKMEQDVKV; NTLYKKMEQDVKVA; TLYKKMEQDVKVAH;
LYKKMEQDVKVAHQ; YKKMEQDVKVAHQP; KKMEQDVKVAHQPD;
KMEQDVKVAHQPDF; MEQDVKVAHQPDFG; EQDVKVAHQPDFGT;
QDVKVAHQPDFGTW; DVKVAHQPDFGTWS; VKVAHQPDFGTWSS;
KVAHQPDFGTWSSS; VAHQPDFGTWSSSE; AHQPDFGTWSSSEV;
HQPDFGTWSSSEVC; QPDFGTWSSSEVCA; PDFGTWSSSEVCAD;
DFGTWSSSEVCADF; FGTWSSSEVCADFP; GTWSSSEVCADFPL;
TWSSSEVCADFPLC; WSSSEVCADFPLCP; SSSEVCADFPLCPD;
SSEVCADFPLCPDT; SEVCADFPLCPDTL; EVCADFPLCPDTLY;
VCADFPLCPDTLYC; CADFPLCPDTLYCK; ADFPLCPDTLYCKE;
DFPLCPDTLYCKEW; FPLCPDTLYCKEWP; PLCPDTLYCKEWPI;
LCPDTLYCKEWPIC; CPDTLYCKEWPICS; PDTLYCKEWPICSK;
DTLYCKEWPICSKK; TLYCKEWPICSKKP; LYCKEWPICSKKPS;
YCKEWPICSKKPSV; CKEWPICSKKPSVH; KEWPICSKKPSVHC;
EWPICSKKPSVHCP; WPICSKKPSVHCPC; PICSKKPSVHCPCM;
ICSKKPSVHCPCML; CSKKPSVHCPCMLC; SKKPSVHCPCMLCQ;
KKPSVHCPCMLCQL; KPSVHCPCMLCQLR; PSVHCPCMLCQLRL;
SVHCPCMLCQLRLR; VHCPCMLCQLRLRH; HCPCMLCQLRLRHL;
CPCMLCQLRLRHLN; PCMLCQLRLRHLNR; CMLCQLRLRHLNRK;
MLCQLRLRHLNRKF; LCQLRLRHLNRKFL; CQLRLRHLNRKFLR;
QLRLRHLNRKFLRK; LRLRHLNRKFLRKE; RLRHLNRKFLRKEP;
LRHLNRKFLRKEPL; RHLNRKFLRKEPLV; HLNRKFLRKEPLVW;
LNRKFLRKEPLVWI; NRKFLRKEPLVWID; RKFLRKEPLVWIDC;
KFLRKEPLVWIDCY; FLRKEPLVWIDCYC; LRKEPLVWIDCYCI;
RKEPLVWIDCYCID; KEPLVWIDCYCIDC; EPLVWIDCYCIDCF;
PLVWIDCYCIDCFT; LVWIDCYCIDCFTQ; VWIDCYCIDCFTQW;
WIDCYCIDCFTQWF; IDCYCIDCFTQWFG; DCYCIDCFTQWFGL;
CYCIDCFTQWFGLD; YCIDCFTQWFGLDL; CIDCFTQWFGLDLT;
IDCFTQWFGLDLTE; DCFTQWFGLDLTEE; CFTQWFGLDLTEET;
FTQWFGLDLTEETL; TQWFGLDLTEETLQ; QWFGLDLTEETLQW;
WFGLDLTEETLQWW; FGLDLTEETLQWWV; GLDLTEETLQWWVQ;
LDLTEETLQWWVQI; DLTEETLQWWVQII; LTEETLQWWVQIIG;
TEETLQWWVQIIGE; EETLQWWVQIIGET; ETLQWWVQIIGETP;
TLQWWVQIIGETPF; LQWWVQIIGETPFR; QWWVQIIGETPFRD;
WWVQIIGETPFRDL; WVQIIGETPFRDLK; VQIIGETPFRDLKL;
KALSNYFFYRCQPM; ALSNYFFYRCQPME; LSNYFFYRCQPMEQ;
SNYFFYRCQPMEQK; NYFFYRCQPMEQKS; YFFYRCQPMEQKSG;
FFYRCQPMEQKSGS; FYRCQPMEQKSGSP; YRCQPMEQKSGSPG;
RCQPMEQKSGSPGG; CQPMEQKSGSPGGV; QPMEQKSGSPGGVP;
PMEQKSGSPGGVPL; MEQKSGSPGGVPLM; EQKSGSPGGVPLMK;
QKSGSPGGVPLMKN; KSGSPGGVPLMKNG; SGSPGGVPLMKNGM;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GSPGGVPLMKNGMK; SPGGVPLMKNGMKI; PGGVPLMKNGMKIY;
GGVPLMKNGMKIYF; GVPLMKNGMKIYFA; VPLMKNGMKIYFAM;
PLMKNGMKIYFAMK; LMKNGMKIYFAMKI; MKNGMKIYFAMKIC;
KNGMKIYFAMKICL; NGMKIYFAMKICLP; GMKIYFAMKICLPV;
MKIYFAMKICLPVM; KIYFAMKICLPVMK; IYFAMKICLPVMKK;
YFAMKICLPVMKKQ; FAMKICLPVMKKQQ; AMKICLPVMKKQQQ;
MKICLPVMKKQQQI; KICLPVMKKQQQIL; ICLPVMKKQQQILN;
CLPVMKKQQQILNT; LPVMKKQQQILNTQ; PVMKKQQQILNTQH;
VMKKQQQILNTQHH; MKKQQQILNTQHHP; KKQQQILNTQHHPK;
KQQQILNTQHHPKK; QQQILNTQHHPKKK; QQILNTQHHPKKKE;
QILNTQHHPKKKER; KTLKTFPLIYTSFL; TLKTFPLIYTSFLV;
LKTFPLIYTSFLVK; KTFPLIYTSFLVKL; TFPLIYTSFLVKLY;
FPLIYTSFLVKLYL; PLIYTSFLVKLYLV; LIYTSFLVKLYLVI;
IYTSFLVKLYLVIE; YTSFLVKLYLVIEP; TSFLVKLYLVIEPL;
SFLVKLYLVIEPLA; FLVKLYLVIEPLPA; LVKLYLVIEPLPAL;
VKLYLVIEPLPALL; KLYLVIEPLPALLC; LYLVIEPLPALLCI;
YLVIEPLPALLCIL; LVIEPLPALLCILL; VIEPLPALLCILLK;
IEPLPALLCILLKK; EPLPALLCILLKKK; PLPALLCILLKKKL;
LPALLCILLKKKLK; PALLCILLKKKLKF; ALLCILLKKKLKFC;
LLCILLKKKLKFCI; LCILLKKKLKFCIK; CILLKKKLKFCIKN;
ILLKKKLKFCIKNL; LLKKKLKFCIKNLW; LKKKLKFCIKNLWK;
KKKLKFCIKNLWKN; KKLKFCIKNLWKNI; KLKFCIKNLWKNIL;
LLLVDTCVLGIILY; LLVDTCVLGIILYS; LVDTCVLGIILYSF;
LHIDIEFLQLIISV; HIDIEFLQLIISVK; IDIEFLQLIISVKS;
DIEFLQLIISVKSC; IEFLQLIISVKSCV; EFLQLIISVKSCVP;
FLQLIISVKSCVPL; LQLIISVKSCVPLV; QLIISVKSCVPLVF;
FVRVLIRNTYYIVP; RSMILAQKSLKKQS; SMILAQKSLKKQSR;
MILAQKSLKKQSRC; ILAQKSLKKQSRCL; LAQKSLKKQSRCLG;
AQKSLKKQSRCLGN; RSVKSVRKKTSLIT; SVKSVRKKTSLITL;
VKSVRKKTSLITLS; KSVRKKTSLITLSI; SVRKKTSLITLSIM;
VRKKTSLITLSIMK; RKKTSLITLSIMKS; KKTSLITLSIMKST;
KTSLITLSIMKSTL; TSLITLSIMKSTLQ; SLITLSIMKSTLQM;
LITLSIMKSTLQML; ITLSIMKSTLQMLL; TLSIMKSTLQMLLF;
LSIMKSTLQMLLFL; SIMKSTLQMLLFLQ; IMKSTLQMLLFLQK;
MKSTLQMLLFLQKV; KSTLQMLLFLQKVK; STLQMLLFLQKVKI;
TLQMLLFLQKVKIK; LQMLLFLQKVKIKK; QMLLFLQKVKIKKV;
MLLFLQKVKIKKVF; LLFLQKVKIKKVFV; LFLQKVKIKKVFVS;
FLQKVKIKKVFVSK; LQKVKIKKVFVSKQ; NNIWQVLLGCTVCY;
NIWQVLLGCTVCYL; IWQVLLGCTVCYLK; WQVLLGCTVCYLKW;
QVLLGCTVCYLKWI; VLLGCTVCYLKWIK; LLGCTVCYLKWIKE;
LIFCTVLFSMYLKE; IFCTVLFSMYLKED; FCTVLFSMYLKEDT;
CTVLFSMYLKEDTG; TVLFSMYLKEDTGY; VLFSMYLKEDTGYL;
LFSMYLKEDTGYLK; FSMYLKEDTGYLKV; SMYLKEDTGYLKVP;
MYLKEDTGYLKVPL; YLKEDTGYLKVPLI; LKEDTGYLKVPLIV;
KEDTGYLKVPLIVE; EDTGYLKVPLIVEK; DTGYLKVPLIVEKQ;
TGYLKVPLIVEKQH; KGQELNQRICLQDM; GQELNQRICLQDME;
ENPYKTQSSYLKKE; NPYKTQSSYLKKEF; PYKTQSSYLKKEFY;
YKTQSSYLKKEFYK; KTQSSYLKKEFYKE; TQSSYLKKEFYKEP;
LILQLIYNLELLNG; ILQLIYNLELLNGR; LQLIYNLELLNGRK;
QLIYNLELLNGRKG; LIYNLELLNGRKGW; IYNLELLNGRKGWI;
YNLELLNGRKGWIL; NLELLNGRKGWILR; NIIYAWGNVFLILQ;
IIYAWGNVFLILQE; IYAWGNVFLILQEK; YAWGNVFLILQEKR;
AWGNVFLILQEKRI; WGNVFLILQEKRIQ; GNVFLILQEKRIQK;
NVFLILQEKRIQKL; VFLILQEKRIQKLK; FLILQEKRIQKLKT;
LILQEKRIQKLKTL; ILQEKRIQKLKTLD; LQEKRIQKLKTLDM;
QEKRIQKLKTLDMD; EKRIQKLKTLDMDQ; KRIQKLKTLDMDQA;
RIQKLKTLDMDQAL; IQKLKTLDMDQALN; QKLKTLDMDQALNP;
KLKTLDMDQALNPN; LKTLDMDQALNPNH; KTLDMDQALNPNHN;
TLDMDQALNPNHNA; LDMDQALNPNHNAL; DMDQALNPNHNALP;
MDQALNPNHNALPK; DQALNPNHNALPKS; QALNPNHNALPKSQ;
ALNPNHNALPKSQI; LNPNHNALPKSQIL; NPNHNALPKSQILQ;
PNHNALPKSQILQP; NHNALPKSQILQPL; HNALPKSQILQPLL;
NALPKSQILQPLLK; ALPKSQILQPLLKI; LPKSQILQPLLKIP;
PKSQILQPLLKIPK; KSQILQPLLKIPKG; SQILQPLLKIPKGQ;
QILQPLLKIPKGQT; ILQPLLKIPKGQTP; LQPLLKIPKGQTPI;
QPLLKIPKGQTPIV; PLLKIPKGQTPIVK; LLKIPKGQTPIVKS;
LKIPKGQTPIVKSC; KIPKGQTPIVKSCI; IPKGQTPIVKSCIC;
PKGQTPIVKSCICV; KGQTPIVKSCICVK; GQTPIVKSCICVKA;
QTPIVKSCICVKAF; TPIVKSCICVKAFS; PIVKSCICVKAFSV;
IVKSCICVKAFSVL; VKSCICVKAFSVLK; KSCICVKAFSVLKG;
SCICVKAFSVLKGL; CICVKAFSVLKGLK; ICVKAFSVLKGLKH;
CVKAFSVLKGLKHH; VKAFSVLKGLKHHP; KAFSVLKGLKHHPQ;
AFSVLKGLKHHPQN; FSVLKGLKHHPQNN; SVLKGLKHHPQNNT;
VLKGLKHHPQNNTS; LKGLKHHPQNNTSL; KGLKHHPQNNTSLK;
GLKHHPQNNTSLKV; LKHHPQNNTSLKVA; KHHPQNNTSLKVAY;
HHPQNNTSLKVAYT; HPQNNTSLKVAYTK; PQNNTSLKVAYTKA;
QNNTSLKVAYTKAA; NNTSLKVAYTKAAF; NTSLKVAYTKAAFI;
TSLKVAYTKAAFIK; SLKVAYTKAAFIKC; LKVAYTKAAFIKCI;
KVAYTKAAFIKCIC; VAYTKAAFIKCICT; AYTKAAFIKCICTI;
YTKAAFIKCICTIK; TKAAFIKCICTIKA; KAAFIKCICTIKAP;
AAFIKCICTIKAPV; SILVCNCPCLSIYL; ILVCNCPCLSIYLI;
LVCNCPCLSIYLII; VCNCPCLSIYLIIS; CNCPCLSIYLIISG;
NCPCLSIYLIISGS; CPCLSIYLIISGSP; PCLSIYLIISGSPG;
CLSIYLIISGSPGS; LSIYLIISGSPGSL; SIYLIISGSPGSLS;
IYLIISGSPGSLSV; YLIISGSPGSLSVP; LIISGSPGSLSVPS;
IISGSPGSLSVPSN; ISGSPGSLSVPSNT; SGSPGSLSVPSNTL;
GSPGSLSVPSNTLT; SPGSLSVPSNTLTS; PGSLSVPSNTLTSS;
GSLSVPSNTLTSST; SLSVPSNTLTSSTW; LSVPSNTLTSSTWD;
SVPSNTLTSSTWDS; VPSNTLTSSTWDSI; PSNTLTSSTWDSIP;
SNTLTSSTWDSIPY; NTLTSSTWDSIPYI; TLTSSTWDSIPYIG;
LTSSTWDSIPYIGC; TSSTWDSIPYIGCP; SSTWDSIPYIGCPS;
STWDSIPYIGCPST; TWDSIPYIGCPSTL; WDSIPYIGCPSTLW;
DSIPYIGCPSTLWV; SIPYIGCPSTLWVL; IPYIGCPSTLWVLL;
PYIGCPSTLWVLLF; YIGCPSTLWVLLFI; IGCPSTLWVLLFIR;
GCPSTLWVLLFIRS; CPSTLWVLLFIRSL; PSTLWVLLFIRSLS;
STLWVLLFIRSLSK; TLWVLLFIRSLSKK; LWVLLFIRSLSKKE;
WVLLFIRSLSKKEI; VLLFIRSLSKKEIG; GFFTDLFLRRILKY;
FFTDLFLRRILKYL; FTDLFLRRILKYLA; TDLFLRRILKYLAR;
DLFLRRILKYLARP; LFLRRILKYLARPL; FLRRILKYLARPLH;
LRRILKYLARPLHC; RRILKYLARPLHCC; RILKYLARPLHCCV;
ILKYLARPLHCCVP; LKYLARPLHCCVPE; KYLARPLHCCVPEL;
YLARPLHCCVPELL; LARPLHCCVPELLV; ARPLHCCVPELLVN;
RPLHCCVPELLVNR; PLHCCVPELLVNRP; LHCCVPELLVNRPQ;
HCCVPELLVNRPQI; CCVPELLVNRPQIS; CVPELLVNRPQISA;
VPELLVNRPQISAA; PELLVNRPQISAAE; ELLVNRPQISAAET;
LLVNRPQISAAETY; LVNRPQISAAETYR; VNRPQISAAETYRL;
NRPQISAAETYRLS; RPQISAAETYRLSA; PQISAAETYRLSAL;
QISAAETYRLSALQ; ISAAETYRLSALQR; SAAETYRLSALQRG;
AAETYRLSALQRGP; AETYRLSALQRGPT; ETYRLSALQRGPTP;
TYRLSALQRGPTPC; YRLSALQRGPTPCS; RLSALQRGPTPCSS;
LSALQRGPTPCSSS; SALQRGPTPCSSSN; ALQRGPTPCSSSNT;
LQRGPTPCSSSNTV; QRGPTPCSSSNTVV; RGPTPCSSSNTVVA;
GPTPCSSSNTVVAV; PTPCSSSNTVVAVL; TPCSSSNTVVAVLV;
PCSSSNTVVAVLVT; STGGTFSPPVKVPK; TGGTFSPPVKVPKY;
GGTFSPPVKVPKYL; GTFSPPVKVPKYLA; TFSPPVKVPKYLAF;
FSPPVKVPKYLAFS; SPPVKVPKYLAFSF; PPVKVPKYLAFSFL;
PVKVPKYLAFSFLL; VKVPKYLAFSFLLG; KVPKYLAFSFLLGS;
VPKYLAFSFLLGSG; PKYLAFSFLLGSGT; KYLAFSFLLGSGTQ;
YLAFSFLLGSGTQH; LAFSFLLGSGTQHS; AFSFLLGSGTQHST;
FSFLLGSGTQHSTG; ALWSVFITWDWAVG; LWSVFITWDWAVGF;
WSVFITWDWAVGFL; SVFITWDWAVGFLG; VFITWDWAVGFLGV;
FITWDWAVGFLGVI; ITWDWAVGFLGVIV; TWDWAVGFLGVIVP;
WDWAVGFLGVIVPS; DWAVGFLGVIVPSG; WAVGFLGVIVPSGY;
AVGFLGVIVPSGYF; VGFLGVIVPSGYFD; GFLGVIVPSGYFDL;
FISTPCISKGSPPT; ISTPCISKGSPPTA; STPCISKGSPPTAK;
TPCISKGSPPTAKK; PCISKGSPPTAKKW; CISKGSPPTAKKWK;
ISKGSPPTAKKWKL; SKGSPPTAKKWKLL; KGSPPTAKKWKLLP;
IGFPPPCSCTFCDP; GFPPPCSCTFCDPA; RLSMLVIPITSVCT;
LSMLVIPITSVCTV; SMLVIPITSVCTVT; MLVIPITSVCTVTA;
LVIPITSVCTVTAS; VIPITSVCTVTASH; IPITSVCTVTASHI;
PITSVCTVTASHIS; ITSVCTVTASHISR; TSVCTVTASHISRF;
SVCTVTASHISRFP; VCTVTASHISRFPQ; CTVTASHISRFPQV;
TVTASHISRFPQVR; VTASHISRFPQVRS; TASHISRFPQVRSS;
ASHISRFPQVRSSF; SHISRFPQVRSSFK; HISRFPQVRSSFKL;
ISRFPQVRSSFKLG; SRFPQVRSSFKLGR; RFPQVRSSFKLGRG;
FPQVRSSFKLGRGI; PQVRSSFKLGRGIL; QVRSSFKLGRGILA;
VRSSFKLGRGILAV; RSSFKLGRGILAVL; QGSIFLSGLSLLKS;
GSIFLSGLSLLKSF; SIFLSGLSLLKSFS; IFLSGLSLLKSFSA;
FLSGLSLLKSFSAL; LSGLSLLKSFSALS; SGLSLLKSFSALSF;
GLSLLKSFSALSFR; LSLLKSFSALSFRL; SLLKSFSALSFRLK;
LLKSFSALSFRLKP; LKSFSALSFRLKPL; KSFSALSFRLKPLR;
SFSALSFRLKPLRF; FSALSFRLKPLRFS; SALSFRLKPLRFSS;
ALSFRLKPLRFSSG; LSFRLKPLRFSSGS; SFRLKPLRFSSGSP;
FRLKPLRFSSGSPI; RLKPLRFSSGSPIS; LKPLRFSSGSPISG;
KPLRFSSGSPISGF; PLRFSSGSPISGFR; LRFSSGSPISGFRK;
RFSSGSPISGFRKH; FSSGSPISGFRKHS; SSGSPISGFRKHST;
SGSPISGFRKHSTS; GSPISGFRKHSTSV; SPISGFRKHSTSVI;
PISGFRKHSTSVIA; ISGFRKHSTSVIAS; SGFRKHSTSVIAST;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GFRKHSTSVIASTP; FRKHSTSVIASTPV; RKHSTSVIASTPVL;
KHSTSVIASTPVLT; HSTSVIASTPVLTS; STSVIASTPVLTSR;
TSVIASTPVLTSRT; SVIASTPVLTSRTS; VIASTPVLTSRTST;
IASTPVLTSRTSTP; ASTPVLTSRTSTPP; STPVLTSRTSTPPF;
TPVLTSRTSTPPFI; PVLTSRTSTPPFIS; VLTSRTSTPPFISS;
LTSRTSTPPFISSF; TSRTSTPPFISSFG; SRTSTPPFISSFGT;
RTSTPPFISSFGTC; TSTPPFISSFGTCT; STPPFISSFGTCTG;
TPPFISSFGTCTGS; PPFISSFGTCTGSF; PFISSFGTCTGSFG;
FISSFGTCTGSFGF; ISSFGTCTGSFGFL; SSFGTCTGSFGFLG;
SFGTCTGSFGFLGA; FGTCTGSFGFLGAA; GTCTGSFGFLGAAP;
TCTGSFGFLGAAPG; CTGSFGFLGAAPGH; TGSFGFLGAAPGHS;
GSFGFLGAAPGHSP; SFGFLGAAPGHSPF; FGFLGAAPGHSPFL;
GFLGAAPGHSPFLL; FLGAAPGHSPFLLV; LGAAPGHSPFLLVG;
GAAPGHSPFLLVGA; AAPGHSPFLLVGAI; APGHSPFLLVGAIF;
PGHSPFLLVGAIFI; GHSPFLLVGAIFIC; HSPFLLVGAIFICF;
SPFLLVGAIFICFK; PFLLVGAIFICFKS; FLLVGAIFICFKSR;
LLVGAIFICFKSRC; LVGAIFICFKSRCY; VGAIFICFKSRCYS;
GAIFICFKSRCYSP; AIFICFKSRCYSPV; IFICFKSRCYSPVQ;
FICFKSRCYSPVQA; RQHPLRSSSLISTS; QHPLRSSSLISTSW;
HPLRSSSLISTSWG; PLRSSSLISTSWGN; LRSSSLISTSWGNS;
RSSSLISTSWGNSF; SSSLISTSWGNSFF; SSLISTSWGNSFFY;
SLISTSWGNSFFYK; LISTSWGNSFFYKL; ISTSWGNSFFYKLS;
VHSLCNFFYTVSII; HSLCNFFYTVSIIY; SLCNFFYTVSIIYT;
LCNFFYTVSIIYTI; CNFFYTVSIIYTIS; NFFYTVSIIYTISM;
FFYTVSIIYTISMA; FYTVSIIYTISMAK; YTVSIIYTISMAKM;
TVSIIYTISMAKMY; VSIIYTISMAKMYT; SIIYTISMAKMYTG;
IIYTISMAKMYTGT; IYTISMAKMYTGTF; YTISMAKMYTGTFP;
TISMAKMYTGTFPP; ISMAKMYTGTFPPS; SMAKMYTGTFPPSY;
MAKMYTGTFPPSYL; AKMYTGTFPPSYLS; KMYTGTFPPSYLSN;
MYTGTFPPSYLSNH; GPNRGKIRIILLNI; PNRGKIRIILLNII;
NRGKIRIILLNIII; RGKIRIILLNIIIK; GKIRIILLNIIIKV;
KIRIILLNIIIKVY; IRIILLNIIIKVYR; RIILLNIIIKVYRG;
IILLNIIIKVYRGI; ILLNIIIKVYRGIY; LLNIIIKVYRGIYN;
LNIIIKVYRGIYNC; NIIIKVYRGIYNCP; IIIKVYRGIYNCPG;
IIKVYRGIYNCPGS; IKVYRGIYNCPGSF; KVYRGIYNCPGSFL;
VYRGIYNCPGSFLQ; YRGIYNCPGSFLQK; RGIYNCPGSFLQKS;
GIYNCPGSFLQKSS; IYNCPGSFLQKSSQ; YNCPGSFLQKSSQG;
NCPGSFLQKSSQGV; CPGSFLQKSSQGVS; PGSFLQKSSQGVSK;
GSFLQKSSQGVSKK; SFLQKSSQGVSKKS; FLQKSSQGVSKKSF;
LQKSSQGVSKKSFC; QKSSQGVSKKSFCS; KSSQGVSKKSFCSS;
SSQGVSKKSFCSSL; SQGVSKKSFCSSLQ; QGVSKKSFCSSLQF;
GVSKKSFCSSLQFL; GYRRYIIPNNMPQS; YRRYIIPNNMPQSL;
RRYIIPNNMPQSLG; RYIIPNNMPQSLGN; YIIPNNMPQSLGNS;
IIPNNMPQSLGNSS; IPNNMPQSLGNSSK; PNNMPQSLGNSSKQ;
NNMPQSLGNSSKQR; NMPQSLGNSSKQRR; MPQSLGNSSKQRRT;
PQSLGNSSKQRRTP; QSLGNSSKQRRTPM; SLGNSSKQRRTPMP;
LGNSSKQRRTPMPR; GNSSKQRRTPMPRI; NSSKQRRTPMPRIK;
SSKQRRTPMPRIKV; SKQRRTPMPRIKVL; KQRRTPMPRIKVLN;
QRRTPMPRIKVLNI; RRTPMPRIKVLNII; RTPMPRIKVLNIIN;
TPMPRIKVLNIIIK; PMPRIKVLNIINKS; MPRIKVLNIINKSI;
PRIKVLNIINKSIY; RIKVLNIINKSIYT; IKVLNIINKSIYTR;
KVLNIINKSIYTRK; VLNIINKSIYTRKQ; LNIINKSIYTRKQN;
NIINKSIYTRKQNI; IINKSIYTRKQNII; INKSIYTRKQNIIV;
NKSIYTRKQNIIVL; KSIYTRKQNIIVLI; SIYTRKQNIIVLIW;
IYTRKQNIIVLIWV; YTRKQNIIVLIWVK; TRKQNIIVLIWVKQ;
RKQNIIVLIWVKQF; KQNIIVLIWVKQFQ; QNIIVLIWVKQFQS;
NIIVLIWVKQFQSH; IIVLIWVKQFQSHA; LLIEAYSGNFVIPI;
LIEAYSGNFVIPII; IEAYSGNFVIPIIK; EAYSGNFVIPIIKE;
AYSGNFVIPIIKEL; YSGNFVIPIIKELI; SGNFVIPIIKELIP;
GNFVIPIIKELIPY; NFVIPIIKELIPYL; FVIPIIKELIPYLS;
SSKPSNSPRSTSNY; SKPSNSPRSTSNYS; KPSNSPRSTSNYSI;
PSNSPRSTSNYSIC; SNSPRSTSNYSICL; NSPRSTSNYSICLR;
SPRSTSNYSICLRS; GTCYALYSSKGCNL; TCYALYSSKGCNLN;
CYALYSSKGCNLNF; YALYSSKGCNLNFY; ALYSSKGCNLNFYS;
LYSSKGCNLNFYSS; YSSKGCNLNFYSSS; SSKGCNLNFYSSSS;
SKGCNLNFYSSSSL; KGCNLNFYSSSSLP; GCNLNFYSSSSLPS;
CNLNFYSSSSLPSS; NLNFYSSSLPSSN; LNFYSSSLPSSNF;
NFYSSSLPSSNFS; FYSSSSLPSSNFSH; SSTHEPGNTKKKGL;
STHEPGNTKKKGLL; THEPGNTKKKGLLT; ESFTESFTAGKAVV;
SFTESFTAGKAVVL; FTESFTAGKAVVLL; TESFTAGKAVVLLF;
ESFTAGKAVVLLFF; SFTAGKAVVLLFFP; FTAGKAVVLLFFPS;
TAGKAVVLLFFPST; AGKAVVLLFFPSTL; GKAVVLLFFPSTLS;
KAVVLLFFPSTLSS; AVVLLFFPSTLSSP; VVLLFFPSTLSSPL;
VLLFFPSTLSSPLQ; LLFFPSTLSSPLQN; LFFPSTLSSPLQNS;
FFPSTLSSPLQNSS; FPSTLSSPLQNSSK; PSTLSSPLQNSSKS;
STLSSPLQNSSKSS; TLSSPLQNSSKSSK; LSSPLQNSSKSSKI;
SSPLQNSSKSSKIK; SPLQNSSKSSKIKI; PLQNSSKSSKIKIK;
LQNSSKSSKIKIKI; QNSSKSSKIKIKIL; ALFFVPVQVLPTFT;
LFFVPVQVLPTFTE; FFVPVQVLPTFTEA; FVPVQVLPTFTEAC;
VPVQVLPTFTEACR; PVQVLPTFTEACRD; VQVLPTFTEACRDS;
QVLPTFTEACRDSW; VLPTFTEACRDSWR; LPTFTEACRDSWRR;
PTFTEACRDSWRRT; TFTEACRDSWRRTM; FTEACRDSWRRTMA;
TEACRDSWRRTMAF; EACRDSWRRTMAFV; ACRDSWRRTMAFVQ;
CRDSWRRTMAFVQF; RDSWRRTMAFVQFN; DSWRRTMAFVQFNW;
SWRRTMAFVQFNWG; WRRTMAFVQFNWGQ; RRTMAFVQFNWGQG;
RTMAFVQFNWGQGQ; TMAFVQFNWGQGQD; MAFVQFNWGQGQDS;
ARKTCLSCTFLPEV; RKTCLSCTFLPEVM; KTCLSCTFLPEVMV;
TCLSCTFLPEVMVW; CLSCTFLPEVMVWL; LSCTFLPEVMVWLH;
SCTFLPEVMVWLHS; CTFLPEVMVWLHSM; TFLPEVMVWLHSMG;
FLPEVMVWLHSMGK; LPEVMVWLHSMGKQ; PEVMVWLHSMGKQL;
EVMVWLHSMGKQLL; VMVWLHSMGKQLLP; MVWLHSMGKQLLPV;
VWLHSMGKQLLPVS; WLHSMGKQLLPVSH; LHSMGKQLLPVSHA;
HSMGKQLLPVSHAL; SMGKQLLPVSHALS; MGKQLLPVSHALSF;
GKQLLPVSHALSFL; KQLLPVSHALSFLR; QLLPVSHALSFLRS;
LLPVSHALSFLRSW; LPVSHALSFLRSWF; PVSHALSFLRSWFG;
VSHALSFLRSWFGC; SHALSFLRSWFGCI; HALSFLRSWFGCIP;
ALSFLRSWFGCIPL; GLAKLFGEIPILLQ; LAKLFGEIPILLQF;
AKLFGEIPILLQFL; KLFGEIPILLQFLQ 15 mers:

MDKVLNREESMELMD; DKVLNREESMELMDL; KVLNREESMELMDLL;
VLNREESMELMDLLG; LNREESMELMDLLGL; NREESMELMDLLGLE;
REESMELMDLLGLER; EESMELMDLLGLERA; ESMELMDLLGLERAA;
SMELMDLLGLERAAW; MELMDLLGLERAAWG; ELMDLLGLERAAWGN;
LMDLLGLERAAWGNL; MDLLGLERAAWGNLP; DLLGLERAAWGNLPL;
LLGLERAAWGNLPLM; LGLERAAWGNLPLMR; GLERAAWGNLPLMRK;
LERAAWGNLPLMRKA; ERAAWGNLPLMRKAY; RAAWGNLPLMRKAYL;
AAWGNLPLMRKAYLR; AWGNLPLMRKAYLRK; WGNLPLMRKAYLRKC;
GNLPLMRKAYLRKCK; NLPLMRKAYLRKCKE; LPLMRKAYLRKCKEF;
PLMRKAYLRKCKEFH; LMRKAYLRKCKEFHP; MRKAYLRKCKEFHPD;
RKAYLRKCKEFHPDK; KAYLRKCKEFHPDKG; AYLRKCKEFHPDKGG;
YLRKCKEFHPDKGGD; LRKCKEFHPDKGGDE; RKCKEFHPDKGGDED;
KCKEFHPDKGGDEDK; CKEFHPDKGGDEDKM; KEFHPDKGGDEDKMK;
EFHPDKGGDEDKMKR; FHPDKGGDEDKMKRM; HPDKGGDEDKMKRMN;
PDKGGDEDKMKRMNT; DKGGDEDKMKRMNTL; KGGDEDKMKRMNTLY;
GGDEDKMKRMNTLYK; GDEDKMKRMNTLYKK; DEDKMKRMNTLYKKM;
EDKMKRMNTLYKKME; DKMKRMNTLYKKMEQ; KMKRMNTLYKKMEQD;
MKRMNTLYKKMEQDV; KRMNTLYKKMEQDVK; RMNTLYKKMEQDVKV;
MNTLYKKMEQDVKVA; NTLYKKMEQDVKVAH; TLYKKMEQDVKVAHQ;
LYKKMEQDVKVAHQP; YKKMEQDVKVAHQPD; KKMEQDVKVAHQPDF;
KMEQDVKVAHQPDFG; MEQDVKVAHQPDFGT; EQDVKVAHQPDFGTW;
QDVKVAHQPDFGTWS; DVKVAHQPDFGTWSS; VKVAHQPDFGTWSSS;
KVAHQPDFGTWSSSE; VAHQPDFGTWSSSEV; AHQPDFGTWSSSEVC;
HQPDFGTWSSSEVCA; QPDFGTWSSSEVCAD; PDFGTWSSSEVCADF;
DFGTWSSSEVCADFP; FGTWSSSEVCADFPL; GTWSSSEVCADFPLC;
TWSSSEVCADFPLCP; WSSSEVCADFPLCPD; SSSEVCADFPLCPDT;
SSEVCADFPLCPDTL; SEVCADFPLCPDTLY; EVCADFPLCPDTLYC;
VCADFPLCPDTLYCK; CADFPLCPDTLYCKE; ADFPLCPDTLYCKEW;
DFPLCPDTLYCKEWP; FPLCPDTLYCKEWPI; PLCPDTLYCKEWPIC;
LCPDTLYCKEWPICS; CPDTLYCKEWPICSK; PDTLYCKEWPICSKK;
DTLYCKEWPICSKKP; TLYCKEWPICSKKPS; LYCKEWPICSKKPSV;
YCKEWPICSKKPSVH; CKEWPICSKKPSVHC; KEWPICSKKPSVHCP;
EWPICSKKPSVHCPC; WPICSKKPSVHCPCM; PICSKKPSVHCPCML;
ICSKKPSVHCPCMLC; CSKKPSVHCPCMLCQ; SKKPSVHCPCMLCQL;
KKPSVHCPCMLCQLR; KPSVHCPCMLCQLRL; PSVHCPCMLCQLRLR;
SVHCPCMLCQLRLRH; VHCPCMLCQLRLRHL; HCPCMLCQLRLRHLN;
CPCMLCQLRLRHLNR; PCMLCQLRLRHLNRK; CMLCQLRLRHLNRKF;
MLCQLRLRHLNRKFL; LCQLRLRHLNRKFLR; CQLRLRHLNRKFLRK;
QLRLRHLNRKFLRKE; LRLRHLNRKFLRKEP; RLRHLNRKFLRKEPL;
LRHLNRKFLRKEPLV; RHLNRKFLRKEPLVW; HLNRKFLRKEPLVWI;
LNRKFLRKEPLVWID; NRKFLRKEPLVWIDC; RKFLRKEPLVWIDCY;
KFLRKEPLVWIDCYC; FLRKEPLVWIDCYCI; LRKEPLVWIDCYCID;
RKEPLVWIDCYCIDC; KEPLVWIDCYCIDCF; EPLVWIDCYCIDCFT;
PLVWIDCYCIDCFTQ; LVWIDCYCIDCFTQW; VWIDCYCIDCFTQWF;
WIDCYCIDCFTQWFG; IDCYCIDCFTQWFGL; DCYCIDCFTQWFGLD;
CYCIDCFTQWFGLDL; YCIDCFTQWFGLDLT; CIDCFTQWFGLDLTE;
IDCFTQWFGLDLTEE; DCFTQWFGLDLTEET; CFTQWFGLDLTEETL;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

FTQWFGLDLTEETLQ; TQWFGLDLTEETLQW; QWFGLDLTEETLQWW;
WFGLDLTEETLQWWV; FGLDLTEETLQWWVQ; GLDLTEETLQWWVQI;
LDLTEETLQWWVQII; DLTEETLQWWVQIIG; LTEETLQWWVQIIGE;
TEETLQWWVQIIGET; EETLQWWVQIIGETP; ETLQWWVQIIGETPF;
TLQWWVQIIGETPFR; LQWWVQIIGETPFRD; QWWVQIIGETPFRDL;
WWVQIIGETPFRDLK; WVQIIGETPFRDLKL; KALSNYFFYRCQPME;
ALSNYFFYRCQPMEQ; LSNYFFYRCQPMEQK; SNYFFYRCQPMEQKS;
NYFFYRCQPMEQKSG; YFFYRCQPMEQKSGS; FFYRCQPMEQKSGSP;
FYRCQPMEQKSGSPG; YRCQPMEQKSGSPGG; RCQPMEQKSGSPGGV;
CQPMEQKSGSPGGVP; QPMEQKSGSPGGVPL; PMEQKSGSPGGVPLM;
MEQKSGSPGGVPLMK; EQKSGSPGGVPLMKN; QKSGSPGGVPLMKNG;
KSGSPGGVPLMKNGM; SGSPGGVPLMKNGMK; GSPGGVPLMKNGMKI;
SPGGVPLMKNGMKIY; PGGVPLMKNGMKIYF; GGVPLMKNGMKIYFA;
GVPLMKNGMKIYFAM; VPLMKNGMKIYFAMK; PLMKNGMKIYFAMKI;
LMKNGMKIYFAMKIC; MKNGMKIYFAMKICL; KNGMKIYFAMKICLP;
NGMKIYFAMKICLPV; GMKIYFAMKICLPVM; MKIYFAMKICLPVMK;
KIYFAMKICLPVMKK; IYFAMKICLPVMKKQ; YFAMKICLPVMKKQQ;
FAMKICLPVMKKQQQ; AMKICLPVMKKQQQI; MKICLPVMKKQQQIL;
KICLPVMKKQQQILN; ICLPVMKKQQQILNT; CLPVMKKQQQILNTQ;
LPVMKKQQQILNTQH; PVMKKQQQILNTQHH; VMKKQQQILNTQHHP;
MKKQQQILNTQHHPK; KKQQQILNTQHHPKK; KQQQILNTQHHPKKK;
QQQILNTQHHPKKKE; QQILNTQHHPKKKER; KTLKTFPLIYTSFLV;
TLKTFPLIYTSFLVK; LKTFPLIYTSFLVKL; KTFPLIYTSFLVKLY;
TFPLIYTSFLVKLYL; FPLIYTSFLVKLYLV; PLIYTSFLVKLYLVI;
LIYTSFLVKLYLVIE; IYTSFLVKLYLVIEP; YTSFLVKLYLVIEPL;
TSFLVKLYLVIEPLP; SFLVKLYLVIEPLPA; FLVKLYLVIEPLPAL;
LVKLYLVIEPLPALL; VKLYLVIEPLPALLC; KLYLVIEPLPALLCI;
LYLVIEPLPALLCIL; YLVIEPLPALLCILL; LVIEPLPALLCILLK;
VIEPLPALLCILLKK; IEPLPALLCILLKKK; EPLPALLCILLKKKL;
PLPALLCILLKKKLK; LPALLCILLKKKLKF; PALLCILLKKKLKFC;
ALLCILLKKKLKFCI; LLCILLKKKLKFCIK; LCILLKKKLKFCIKN;
CILLKKKLKFCIKNL; ILLKKKLKFCIKNLW; LLKKKLKFCIKNLWK;
LKKKLKFCIKNLWKN; KKKLKFCIKNLWKNI; KKLKFCIKNLWKNIL;
LLLVDTCVLGIILYS; LLVDTCVLGIILYSF; LHIDIEFLQLIISVK;
HIDIEFLQLIISVKS; IDIEFLQLIISVKSC; DIEFLQLIISVKSCV;
IEFLQLIISVKSCVP; EFLQLIISVKSCVPL; FLQLIISVKSCVPLV;
LQLIISVKSCVPLVF; RSMILAQKSLKKQSR; SMILAQKSLKKQSRC;
MILAQKSLKKQSRCL; ILAQKSLKKQSRCLG; LAQKSLKKQSRCLGN;
RSVKSVRKKTSLITL; SVKSVRKKTSLITLS; VKSVRKKTSLITLSI;
KSVRKKTSLITLSIM; SVRKKTSLITLSIMK; VRKKTSLITLSIMKS;
RKKTSLITLSIMKST; KKTSLITLSIMKSTL; KTSLITLSIMKSTLQ;
TSLITLSIMKSTLQM; SLITLSIMKSTLQML; LITLSIMKSTLQMLL;
ITLSIMKSTLQMLLF; TLSIMKSTLQMLLFL; LSIMKSTLQMLLFLQ;
SIMKSTLQMLLFLQK; IMKSTLQMLLFLQKV; MKSTLQMLLFLQKVK;
KSTLQMLLFLQKVKI; STLQMLLFLQKVKIK; TLQMLLFLQKVKIKK;
LQMLLFLQKVKIKKV; QMLLFLQKVKIKKVF; MLLFLQKVKIKKVFV;
LLFLQKVKIKKVFVS; LFLQKVKIKKVFVSK; FLQKVKIKKVFVSKQ;
NNIWQVLLGCTVCYL; NIWQVLLGCTVCYLK; IWQVLLGCTVCYLKI;
WQVLLGCTVCYLKWI; QVLLGCTVCYLKWIL; YLIFCTVLFSMYLKE;
LIFCTVLFSMYLKED; IFCTVLFSMYLKEDT; FCTVLFSMYLKEDTG;
CTVLFSMYLKEDTGY; TVLFSMYLKEDTGYL; VLFSMYLKEDTGYLK;
LFSMYLKEDTGYLKV; FSMYLKEDTGYLKVP; SMYLKEDTGYLKVPL;
MYLKEDTGYLKVPLI; YLKEDTGYLKVPLIV; LKEDTGYLKVPLIVE;
KEDTGYLKVPLIVEK; EDTGYLKVPLIVEKQ; DTGYLKVPLIVEKQH;
KGQELNQRICLQDME; ENPYKTQSSYLKKEF; NPYKTQSSYLKKEFY;
PYKTQSSYLKKEFYK; YKTQSSYLKKEFYKV; KTQSSYLKKEFYKVE;
LILQLIYNLELLNGR; ILQLIYNLELLNGRK; LQLIYNLELLNGRKG;
QLIYNLELLNGRKGW; LIYNLELLNGRKGWI; IYNLELLNGRKGWIL;
YNLELLNGRKGWILR; NIIYAWGNVFLILQE; IIYAWGNVFLILQEK;
IYAWGNVFLILQEKR; YAWGNVFLILQEKRI; AWGNVFLILQEKRIQ;
WGNVFLILQEKRIQK; GNVFLILQEKRIQKL; NVFLILQEKRIQKLK;
VFLILQEKRIQKLKT; FLILQEKRIQKLKTL; LILQEKRIQKLKTLD;
ILQEKRIQKLKTLDM; LQEKRIQKLKTLDMD; QEKRIQKLKTLDMDQ;
EKRIQKLKTLDMDQA; KRIQKLKTLDMDQAL; RIQKLKTLDMDQALN;
IQKLKTLDMDQALNP; QKLKTLDMDQALNPN; KLKTLDMDQALNPNH;
LKTLDMDQALNPNHN; KTLDMDQALNPNHNA; TLDMDQALNPNHNAL;
LDMDQALNPNHNALP; DMDQALNPNHNALPK; MDQALNPNHNALPKS;
DQALNPNHNALPKSQ; QALNPNHNALPKSQI; ALNPNHNALPKSQIL;
LNPNHNALPKSQILQ; NPNHNALPKSQILQP; PNHNALPKSQILQPL;
NHNALPKSQILQPLL; HNALPKSQILQPLLK; NALPKSQILQPLLKI;
ALPKSQILQPLLKIP; LPKSQILQPLLKIPK; PKSQILQPLLKIPKG;
KSQILQPLLKIPKGQ; SQILQPLLKIPKGQT; QILQPLLKIPKGQTP;
ILQPLLKIPKGQTPI; LQPLLKIPKGQTPIV; QPLLKIPKGQTPIVK;
PLLKIPKGQTPIVKS; LLKIPKGQTPIVKSC; LKIPKGQTPIVKSCI;
KIPKGQTPIVKSCIC; IPKGQTPIVKSCICV; PKGQTPIVKSCICVK;
KGQTPIVKSCICVKA; GQTPIVKSCICVKAF; QTPIVKSCICVKAFS;
TPIVKSCICVKAFSV; PIVKSCICVKAFSVL; IVKSCICVKAFSVLK;
VKSCICVKAFSVLKG; KSCICVKAFSVLKGL; SCICVKAFSVLKGLK;
CICVKAFSVLKGLKH; ICVKAFSVLKGLKHH; CVKAFSVLKGLKHHP;
VKAFSVLKGLKHHPQ; KAFSVLKGLKHHPQN; AFSVLKGLKHHPQNN;
FSVLKGLKHHPQNNT; SVLKGLKHHPQNNTS; VLKGLKHHPQNNTSL;
LKGLKHHPQNNTSLK; KGLKHHPQNNTSLKV; GLKHHPQNNTSLKVA;
LKHHPQNNTSLKVAY; KHHPQNNTSLKVAYT; HHPQNNTSLKVAYTK;
HPQNNTSLKVAYTKA; PQNNTSLKVAYTKAA; QNNTSLKVAYTKAAF;
NNTSLKVAYTKAAFI; NTSLKVAYTKAAFIK; TSLKVAYTKAAFIKC;
SLKVAYTKAAFIKCI; LKVAYTKAAFIKCIC; KVAYTKAAFIKCICT;
VAYTKAAFIKCICTI; AYTKAAFIKCICTIK; YTKAAFIKCICTIKA;
TKAAFIKCICTIKAP; KAAFIKCICTIKAPV; SILVCNCPCLSIYLI;
ILVCNCPCLSIYLII; LVCNCPCLSIYLIIS; VCNCPCLSIYLIISG;
CNCPCLSIYLIISGS; NCPCLSIYLIISGSP; CPCLSIYLIISGSPG;
PCLSIYLIISGSPGS; CLSIYLIISGSPGSL; LSIYLIISGSPGSLS;
SIYLIISGSPGSLSV; IYLIISGSPGSLSVP; YLIISGSPGSLSVPS;
LIISGSPGSLSVPSN; IISGSPGSLSVPSNT; ISGSPGSLSVPSNTL;
SGSPGSLSVPSNTLT; GSPGSLSVPSNTLTS; SPGSLSVPSNTLTSS;
PGSLSVPSNTLTSST; GSLSVPSNTLTSSTW; SLSVPSNTLTSSTWD;
LSVPSNTLTSSTWDS; SVPSNTLTSSTWDSI; VPSNTLTSSTWDSIP;
PSNTLTSSTWDSIPY; SNTLTSSTWDSIPYI; NTLTSSTWDSIPYIG;
TLTSSTWDSIPYIGC; LTSSTWDSIPYIGCP; TSSTWDSIPYIGCPS;
SSTWDSIPYIGCPST; STWDSIPYIGCPSTL; TWDSIPYIGCPSTLW;
WDSIPYIGCPSTLWV; DSIPYIGCPSTLWVL; SIPYIGCPSTLWVLL;
IPYIGCPSTLWVLLF; PYIGCPSTLWVLLFI; YIGCPSTLWVLLFIR;
IGCPSTLWVLLFIRS; GCPSTLWVLLFIRSL; CPSTLWVLLFIRSLS;
PSTLWVLLFIRSLSK; STLWVLLFIRSLSKK; TLWVLLFIRSLSKKE;
LWVLLFIRSLSKKEI; WVLLFIRSLSKKEIG; GFFTDLFLRRILKYL;
FFTDLFLRRILKYLA; FTDLFLRRILKYLAR; TDLFLRRILKYLARP;
DLFLRRILKYLARPL; LFLRRILKYLARPLH; FLRRILKYLARPLHC;
LRRILKYLARPLHCC; RRILKYLARPLHCCV; RILKYLARPLHCCVP;
ILKYLARPLHCCVPE; LKYLARPLHCCVPEL; KYLARPLHCCVPELL;
YLARPLHCCVPELLV; LARPLHCCVPELLVN; ARPLHCCVPELLVNR;
RPLHCCVPELLVNRP; PLHCCVPELLVNRPQ; LHCCVPELLVNRPQI;
HCCVPELLVNRPQIS; CCVPELLVNRPQISA; CVPELLVNRPQISAA;
VPELLVNRPQISAAE; PELLVNRPQISAAET; ELLVNRPQISAAETY;
LLVNRPQISAAETYR; LVNRPQISAAETYRL; VNRPQISAAETYRLS;
NRPQISAAETYRLSA; RPQISAAETYRLSAL; PQISAAETYRLSALQ;
QISAAETYRLSALQR; ISAAETYRLSALQRG; SAAETYRLSALQRGP;
AAETYRLSALQRGPT; AETYRLSALQRGPTP; ETYRLSALQRGPTPC;
TYRLSALQRGPTPCS; YRLSALQRGPTPCSS; RLSALQRGPTPCSSS;
LSALQRGPTPCSSSN; SALQRGPTPCSSSNT; ALQRGPTPCSSSNTV;
LQRGPTPCSSSNTVV; QRGPTPCSSSNTVVA; RGPTPCSSSNTVVAV;
GPTPCSSSNTVVAVL; PTPCSSSNTVVAVLV; TPCSSSNTVVAVLVT;
STGGTFSPPVKVPKY; TGGTFSPPVKVPKYL; GGTFSPPVKVPKYLA;
GTFSPPVKVPKYLAF; TFSPPVKVPKYLAFS; FSPPVKVPKYLAFSF;
SPPVKVPKYLAFSFL; PPVKVPKYLAFSFLL; PVKVPKYLAFSFLLG;
VKVPKYLAFSFLLGS; KVPKYLAFSFLLGSG; VPKYLAFSFLLGSGT;
PKYLAFSFLLGSGTQ; KYLAFSFLLGSGTQH; YLAFSFLLGSGTQHS;
LAFSFLLGSGTQHST; AFSFLLGSGTQHSTG; ALWSVFITWDWAVGF;
LWSVFITWDWAVGFL; WSVFITWDWAVGFLG; SVFITWDWAVGFLGV;
VFITWDWAVGFLGVI; FITWDWAVGFLGVIV; ITWDWAVGFLGVIVP;
TWDWAVGFLGVIVPS; WDWAVGFLGVIVPSG; DWAVGFLGVIVPSGY;
WAVGFLGVIVPSGYF; AVGFLGVIVPSGYFD; VGFLGVIVPSGYFDL;
FISTPCISKGSPPTA; ISTPCISKGSPPTAK; STPCISKGSPPTAKK;
TPCISKGSPPTAKKW; PCISKGSPPTAKKWK; CISKGSPPTAKKWKL;
ISKGSPPTAKKWKLL; SKGSPPTAKKWKLLP; IGFPPPCSCTFCDPA;
RLSMLVIPITSVCTV; LSMLVIPITSVCTVT; SMLVIPITSVCTVTA;
MLVIPITSVCTVTAS; LVIPITSVCTVTASH; VIPITSVCTVTASHI;
IPITSVCTVTASHIS; PITSVCTVTASHISR; ITSVCTVTASHISRF;
TSVCTVTASHISRFP; SVCTVTASHISRFPQ; VCTVTASHISRFPQV;
CTVTASHISRFPQVR; TVTASHISRFPQVRS; VTASHISRFPQVRSS;
TASHISRFPQVRSSF; ASHISRFPQVRSSFK; SHISRFPQVRSSFKL;
HISRFPQVRSSFKLG; ISRFPQVRSSFKLGR; SRFPQVRSSFKLGRG;
RFPQVRSSFKLGRGI; FPQVRSSFKLGRGIL; PQVRSSFKLGRGILA;
QVRSSFKLGRGILAV; VRSSFKLGRGILAVL; QGSIFLSGLSLLKSF;
GSIFLSGLSLLKSFS; SIFLSGLSLLKSFSA; IFLSGLSLLKSFSAL;
FLSGLSLLKSFSALS; LSGLSLLKSFSALSF; SGLSLLKSFSALSFR;
GLSLLKSFSALSFRL; LSLLKSFSALSFRLK; SLLKSFSALSFRLKP;
LLKSFSALSFRLKPL; LKSFSALSFRLKPLR; KSFSALSFRLKPLRF;
SFSALSFRLKPLRFS; FSALSFRLKPLRFSS; SALSFRLKPLRFSSG;
ALSFRLKPLRFSSGS; LSFRLKPLRFSSGSP; SFRLKPLRFSSGSPI;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

FRLKPLRFSSGSPIS; RLKPLRFSSGSPISG; LKPLRFSSGSPISGF;
KPLRFSSGSPISGFR; PLRFSSGSPISGFRK; LRFSSGSPISGFRKH;
RFSSGSPISGFRKHS; FSSGSPISGFRKHST; SSGSPISGFRKHSTS;
SGSPISGFRKHSTSV; GSPISGFRKHSTSVI; SPISGFRKHSTSVIA;
PISGFRKHSTSVIAS; ISGFRKHSTSVIAST; SGFRKHSTSVIASTP;
GFRKHSTSVIASTPV; FRKHSTSVIASTPVL; RKHSTSVIASTPVLT;
KHSTSVIASTPVLTS; HSTSVIASTPVLTSR; STSVIASTPVLTSRT;
TSVIASTPVLTSRTS; SVIASTPVLTSRTST; VIASTPVLTSRTSTP;
IASTPVLTSRTSTPP; ASTPVLTSRTSTPPF; STPVLTSRTSTPPFI;
TPVLTSRTSTPPFIS; PVLTSRTSTPPFISS; VLTSRTSTPPFISSF;
LTSRTSTPPFISSFG; TSRTSTPPFISSFGT; SRTSTPPFISSFGTC;
RTSTPPFISSFGTCT; TSTPPFISSFGTCTG; STPPFISSFGTCTGS;
TPPFISSFGTCTGSF; PPFISSFGTCTGSFG; PFISSFGTCTGSFGF;
FISSFGTCTGSFGFL; ISSFGTCTGSFGFLG; SSFGTCTGSFGFLGA;
SFGTCTGSFGFLGAA; FGTCTGSFGFLGAAP; GTCTGSFGFLGAAPG;
TCTGSFGFLGAAPGH; CTGSFGFLGAAPGHS; TGSFGFLGAAPGHSP;
GSFGFLGAAPGHSPF; SFGFLGAAPGHSPFL; FGFLGAAPGHSPFLL;
GFLGAAPGHSPFLLV; FLGAAPGHSPFLLVG; LGAAPGHSPFLLVGA;
GAAPGHSPFLLVGAI; AAPGHSPFLLVGAIF; APGHSPFLLVGAIFI;
PGHSPFLLVGAIFIC; GHSPFLLVGAIFICF; HSPFLLVGAIFICFK;
SPFLLVGAIFICFKS; PFLLVGAIFICFKSR; FLLVGAIFICFKSRC;
LLVGAIFICFKSRCY; LVGAIFICFKSRCYS; VGAIFICFKSRCYSP;
GAIFICFKSRCYSPV; AIFICFKSRCYSPVQ; IFICFKSRCYSPVQA;
RQHPLRSSSLISTSW; QHPLRSSSLISTSWG; HPLRSSSLISTSWGN;
PLRSSSLISTSWGNS; LRSSSLISTSWGNSF; RSSSLISTSWGNSFF;
SSSLISTSWGNSFFY; SSLISTSWGNSFFYK; SLISTSWGNSFFYKL;
LISTSWGNSFFYKLS; VHSLCNFFYTVSIIY; HSLCNFFYTVSIIYT;
SLCNFFYTVSIIYTI; LCNFFYTVSIIYTIS; CNFFYTVSIIYTISM;
NFFYTVSIIYTISMA; FFYTVSIIYTISMAK; FYTVSIIYTISMAKM;
YTVSIIYTISMAKMY; TVSIIYTISMAKMYT; VSIIYTISMAKMYTG;
SIIYTISMAKMYTGT; IIYTISMAKMYTGTF; IYTISMAKMYTGTFP;
YTISMAKMYTGTFPF; TISMAKMYTGTFPFS; ISMAKMYTGTFPFSY;
SMAKMYTGTFPFSYL; MAKMYTGTFPFSYLS; AKMYTGTFPFSYLSN;
KMYTGTFPFSYLSNH; GPNRGKIRIILLNII; PNRGKIRIILLNIII;
NRGKIRIILLNIIIK; RGKIRIILLNIIIKV; GKIRIILLNIIIKVY;
KIRIILLNIIIKVYR; IRIILLNIIIKVYRG; RIILLNIIIKVYRGI;
IILLNIIIKVYRGIY; ILLNIIIKVYRGIYN; LLNIIIKVYRGIYNC;
LNIIIKVYRGIYNCP; NIIIKVYRGIYNCPG; IIIKVYRGIYNCPGS;
IIKVYRGIYNCPGSF; IKVYRGIYNCPGSFL; KVYRGIYNCPGSFLQ;
VYRGIYNCPGSFLQK; YRGIYNCPGSFLQKS; RGIYNCPGSFLQKSS;
GIYNCPGSFLQKSSQ; IYNCPGSFLQKSSQG; YNCPGSFLQKSSQGV;
NCPGSFLQKSSQGVS; CPGSFLQKSSQGVSK; PGSFLQKSSQGVSKK;
GSFLQKSSQGVSKKS; SFLQKSSQGVSKKSF; FLQKSSQGVSKKSFC;
LQKSSQGVSKKSFCS; QKSSQGVSKKSFCSS; KSSQGVSKKSFCSSL;
SSQGVSKKSFCSSLQ; SQGVSKKSFCSSLQF; QGVSKKSFCSSLQFL;
GYRRYIIPNNMPQSL; YRRYIIPNNMPQSLG; RRYIIPNNMPQSLGN;
RYIIPNNMPQSLGNS; YIIPNNMPQSLGNSS; IIPNNMPQSLGNSSK;
IPNNMPQSLGNSSKQ; PNNMPQSLGNSSKQR; NNMPQSLGNSSKQRR;
NMPQSLGNSSKQRRT; MPQSLGNSSKQRRTP; PQSLGNSSKQRRTPM;
QSLGNSSKQRRTPMP; SLGNSSKQRRTPMPR; LGNSSKQRRTPMPRI;
GNSSKQRRTPMPRIK; NSSKQRRTPMPRIKV; SSKQRRTPMPRIKVL;
SKQRRTPMPRIKVLN; KQRRTPMPRIKVLNI; QRRTPMPRIKVLNII;
RRTPMPRIKVLNIIN; RTPMPRIKVLNIINK; TPMPRIKVLNIINKS;
PMPRIKVLNIINKSI; MPRIKVLNIINKSIY; PRIKVLNIINKSIYT;
RIKVLNIINKSIYTR; IKVLNIINKSIYTRK; KVLNIINKSIYTRKQ;
VLNIINKSIYTRKQN; LNIINKSIYTRKQNI; NIINKSIYTRKQNII;
IINKSIYTRKQNIIV; INKSIYTRKQNIIVL; NKSIYTRKQNIIVLI;
KSIYTRKQNIIVLIW; SIYTRKQNIIVLIWV; IYTRKQNIIVLIWVK;
YTRKQNIIVLIWVKQ; TRKQNIIVLIWVKQF; RKQNIIVLIWVKQFQ;
KQNIIVLIWVKQFQS; QNIIVLIWVKQFQSH; NIIVLIWVKQFQSHA;
LLIEAYSGNFVIPII; LIEAYSGNFVIPIIK; IEAYSGNFVIPIIKE;
EAYSGNFVIPIIKEL; AYSGNFVIPIIKELI; YSGNFVIPIIKELIP;
SGNFVIPIIKELIPY; GNFVIPIIKELIPYL; NFVIPIIKELIPYLS;
SSKPSNSPRSTSNYS; SKPSNSPRSTSNYSI; KPSNSPRSTSNYSIC;
PSNSPRSTSNYSICL; SNSPRSTSNYSICLR; NSPRSTSNYSICLRS;
GTCYALYSSKGCNLN; TCYALYSSKGCNLNF; CYALYSSKGCNLNFY;
YALYSSKGCNLNFYS; ALYSSKGCNLNFYSS; LYSSKGCNLNFYSSS;
YSSKGCNLNFYSSSS; SSKGCNLNFYSSSSL; SKGCNLNFYSSSSLP;
KGCNLNFYSSSSLPS; GCNLNFYSSSSLPSS; CNLNFYSSSSLPSSN;
NLNFYSSSSLPSSNF; LNFYSSSSLPSSNFS; NFYSSSSLPSSNFSH;
SSTHEPGNTKKKGLL; STHEPGNTKKKGLLT; ESFTESFTAGKAVVL;
SFTESFTAGKAVVLL; FTESFTAGKAVVLLF; TESFTAGKAVVLLFF;
ESFTAGKAVVLLFFP; SFTAGKAVVLLFFPS; FTAGKAVVLLFFPST;
TAGKAVVLLFFPSTL; AGKAVVLLFFPSTLS; GKAVVLLFFPSTLSS;
KAVVLLFFPSTLSSP; AVVLLFFPSTLSSPL; VVLLFFPSTLSSPLQ;
VLLFFPSTLSSPLQN; LLFFPSTLSSPLQNS; LFFPSTLSSPLQNSS;
FFPSTLSSPLQNSSK; FPSTLSSPLQNSSKS; PSTLSSPLQNSSKSS;
STLSSPLQNSSKSSK; TLSSPLQNSSKSSKI; LSSPLQNSSKSSKIK;
SSPLQNSSKSSKIKI; SPLQNSSKSSKIKIK; PLQNSSKSSKIKIKI;
LQNSSKSSKIKIKIL; ALFFVPVQVLPTFTE; LFFVPVQVLPTFTEA;
FFVPVQVLPTFTEAC; FVPVQVLPTFTEACR; VPVQVLPTFTEACRD;
PVQVLPTFTEACRDS; VQVLPTFTEACRDSW; QVLPTFTEACRDSWR;
VLPTFTEACRDSWRR; LPTFTEACRDSWRRT; PTFTEACRDSWRRTM;
TFTEACRDSWRRTMA; FTEACRDSWRRTMAF; TEACRDSWRRTMAFV;
EACRDSWRRTMAFVQ; ACRDSWRRTMAFVQF; CRDSWRRTMAFVQFN;
RDSWRRTMAFVQFNW; DSWRRTMAFVQFNWG; SWRRTMAFVQFNWGQ;
WRRTMAFVQFNWGQG; RRTMAFVQFNWGQGQ; RTMAFVQFNWGQGQD;
TMAFVQFNWGQGQDS; ARKTCLSCTFLPEVM; RKTCLSCTFLPEVMV;
KTCLSCTFLPEVMVW; TCLSCTFLPEVMVWL; CLSCTFLPEVMVWLH;
LSCTFLPEVMVWLHS; SCTFLPEVMVWLHSM; CTFLPEVMVWLHSMG;
TFLPEVMVWLHSMGK; FLPEVMVWLHSMGKQ; LPEVMVWLHSMGKQL;
PEVMVWLHSMGKQLL; EVMVWLHSMGKQLLP; VMVWLHSMGKQLLPV;
MVWLHSMGKQLLPVS; VWLHSMGKQLLPVSH; WLHSMGKQLLPVSHA;
LHSMGKQLLPVSHAL; HSMGKQLLPVSHALS; SMGKQLLPVSHALSF;
MGKQLLPVSHALSFL; GKQLLPVSHALSFLR; KQLLPVSHALSFLRS;
QLLPVSHALSFLRSW; LLPVSHALSFLRSWF; LPVSHALSFLRSWFG;
PVSHALSFLRSWFGC; VSHALSFLRSWFGCI; SHALSFLRSWFGCIP;
HALSFLRSWFGCIPL; GLAKLFGEIPILLQF; LAKLFGEIPILLQFL;
AKLFGEIPILLQFLQ 16 mers:

MDKVLNREESMELMDL; DKVLNREESMELMDLL;
KVLNREESMELMDLLG; VLNREESMELMDLLGL;
LNREESMELMDLLGLE; NREESMELMDLLGLER;
REESMELMDLLGLERA; EESMELMDLLGLERAA;
ESMELMDLLGLERAAW; SMELMDLLGLERAAWG;
MELMDLLGLERAAWGN; ELMDLLGLERAAWGNL;
LMDLLGLERAAWGNLP; MDLLGLERAAWGNLPL;
DLLGLERAAWGNLPLM; LLGLERAAWGNLPLMR;
LGLERAAWGNLPLMRK; GLERAAWGNLPLMRKA;
LERAAWGNLPLMRKAY; ERAAWGNLPLMRKAYL;
RAAWGNLPLMRKAYLR; AAWGNLPLMRKAYLRK;
AWGNLPLMRKAYLRKC; WGNLPLMRKAYLRKCK;
GNLPLMRKAYLRKCKE; NLPLMRKAYLRKCKEF;
LPLMRKAYLRKCKEFH; PLMRKAYLRKCKEFHP;
LMRKAYLRKCKEFHPD; MRKAYLRKCKEFHPDK;
RKAYLRKCKEFHPDKG; KAYLRKCKEFHPDKGG;
AYLRKCKEFHPDKGGD; YLRKCKEFHPDKGGDE;
LRKCKEFHPDKGGDED; RKCKEFHPDKGGDEDK;
KCKEFHPDKGGDEDKM; CKEFHPDKGGDEDKMK;
KEFHPDKGGDEDKMKR; EFHPDKGGDEDKMKRM;
FHPDKGGDEDKMKRMN; HPDKGGDEDKMKRMNT;
PDKGGDEDKMKRMNTL; DKGGDEDKMKRMNTLY;
KGGDEDKMKRMNTLYK; GGDEDKMKRMNTLYKK;
GDEDKMKRMNTLYKKM; DEDKMKRMNTLYKKME;
EDKMKRMNTLYKKMEQ; DKMKRMNTLYKKMEQD;
KMKRMNTLYKKMEQDV; MKRMNTLYKKMEQDVK;
KRMNTLYKKMEQDVKV; RMNTLYKKMEQDVKVA;
MNTLYKKMEQDVKVAH; NTLYKKMEQDVKVAHQ;
TLYKKMEQDVKVAHQP; LYKKMEQDVKVAHQPD;
YKKMEQDVKVAHQPDF; KKMEQDVKVAHQPDFG;
KMEQDVKVAHQPDFGT; MEQDVKVAHQPDFGTW;
EQDVKVAHQPDFGTWS; QDVKVAHQPDFGTWSS;
DVKVAHQPDFGTWSSS; VKVAHQPDFGTWSSSE;
KVAHQPDFGTWSSSEV; VAHQPDFGTWSSSEVC;
AHQPDFGTWSSSEVCA; HQPDFGTWSSSEVCAD;
QPDFGTWSSSEVCADF; PDFGTWSSSEVCADFP;
DFGTWSSSEVCADFPL; FGTWSSSEVCADFPLC;
GTWSSSEVCADFPLCP; TWSSSEVCADFPLCPD;
WSSSEVCADFPLCPDT; SSSEVCADFPLCPDTL;
SSEVCADFPLCPDTLY; SEVCADFPLCPDTLYC;
EVCADFPLCPDTLYCK; VCADFPLCPDTLYCKE;
CADFPLCPDTLYCKEW; ADFPLCPDTLYCKEWP;
DFPLCPDTLYCKEWPI; FPLCPDTLYCKEWPIC;
PLCPDTLYCKEWPICS; LCPDTLYCKEWPICSK;
CPDTLYCKEWPICSKK; PDTLYCKEWPICSKKP;
DTLYCKEWPICSKKPS; TLYCKEWPICSKKPSV;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

LYCKEWPICSKKPSVH; YCKEWPICSKKPSVHC;
CKEWPICSKKPSVHCP; KEWPICSKKPSVHCPC;
EWPICSKKPSVHCPCM; WPICSKKPSVHCPCML;
PICSKKPSVHCPCMLC; ICSKKPSVHCPCMLCQ;
CSKKPSVHCPCMLCQL; SKKPSVHCPCMLCQLR;
KKPSVHCPCMLCQLRL; KPSVHCPCMLCQLRLR;
PSVHCPCMLCQLRLRH; SVHCPCMLCQLRLRHL;
VHCPCMLCQLRLRHLN; HCPCMLCQLRLRHLNR;
CPCMLCQLRLRHLNRK; PCMLCQLRLRHLNRKF;
CMLCQLRLRHLNRKFL; MLCQLRLRHLNRKFLR;
LCQLRLRHLNRKFLRK; CQLRLRHLNRKFLRKE;
QLRLRHLNRKFLRKEP; LRLRHLNRKFLRKEPL;
RLRHLNRKFLRKEPLV; LRHLNRKFLRKEPLVW;
RHLNRKFLRKEPLVWI; HLNRKFLRKEPLVWID;
LNRKFLRKEPLVWIDC; NRKFLRKEPLVWIDCY;
RKFLRKEPLVWIDCYC; KFLRKEPLVWIDCYCI;
FLRKEPLVWIDCYCID; LRKEPLVWIDCYCIDC;
RKEPLVWIDCYCIDCF; KEPLVWIDCYCIDCFT;
EPLVWIDCYCIDCFTQ; PLVWIDCYCIDCFTQW;
LVWIDCYCIDCFTQWF; VWIDCYCIDCFTQWFG;
WIDCYCIDCFTQWFGL; IDCYCIDCFTQWFGLD;
DCYCIDCFTQWFGLDL; CYCIDCFTQWFGLDLT;
YCIDCFTQWFGLDLTE; CIDCFTQWFGLDLTEE;
IDCFTQWFGLDLTEET; DCFTQWFGLDLTEETL;
CFTQWFGLDLTEETLQ; FTQWFGLDLTEETLQW;
TQWFGLDLTEETLQWW; QWFGLDLTEETLQWWV;
WFGLDLTEETLQWWVQ; FGLDLTEETLQWWVQI;
GLDLTEETLQWWVQII; LDLTEETLQWWVQIIG;
DLTEETLQWWVQIIGE; LTEETLQWWVQIIGET;
TEETLQWWVQIIGETP; EETLQWWVQIIGETPF;
ETLQWWVQIIGETPFR; TLQWWVQIIGETPFRD;
LQWWVQIIGETPFRDL; QWWVQIIGETPFRDLK;
WWVQIIGETPFRDLKL; KALSNYFFYRCQPMEQ;
ALSNYFFYRCQPMEQK; LSNYFFYRCQPMEQKS;
SNYFFYRCQPMEQKSG; NYFFYRCQPMEQKSGS;
YFFYRCQPMEQKSGSP; FFYRCQPMEQKSGSPG;
FYRCQPMEQKSGSPGG; YRCQPMEQKSGSPGGV;
RCQPMEQKSGSPGGVP; CQPMEQKSGSPGGVPL;
QPMEQKSGSPGGVPLM; PMEQKSGSPGGVPLMK;
MEQKSGSPGGVPLMKN; EQKSGSPGGVPLMKNG;
QKSGSPGGVPLMKNGM; KSGSPGGVPLMKNGMK;
SGSPGGVPLMKNGMKI; GSPGGVPLMKNGMKIY;
SPGGVPLMKNGMKIYF; PGGVPLMKNGMKIYFA;
GGVPLMKNGMKIYFAM; GVPLMKNGMKIYFAMK;
VPLMKNGMKIYFAMKI; PLMKNGMKIYFAMKIC;
LMKNGMKIYFAMKICL; MKNGMKIYFAMKICLP;
KNGMKIYFAMKICLPV; NGMKIYFAMKICLPVM;
GMKIYFAMKICLPVMK; MKIYFAMKICLPVMKK;
KIYFAMKICLPVMKKQ; IYFAMKICLPVMKKQQ;
YFAMKICLPVMKKQQQ; FAMKICLPVMKKQQQI;
AMKICLPVMKKQQQIL; MKICLPVMKKQQQILN;
KICLPVMKKQQQILNT; ICLPVMKKQQQILNTQ;
CLPVMKKQQQILNTQH; LPVMKKQQQILNTQHH;
PVMKKQQQILNTQHHP; VMKKQQQILNTQHHPK;
MKKQQQILNTQHHPKK; KKQQQILNTQHHPKKK;
KQQQILNTQHHPKKKE; QQQILNTQHHPKKKER;
KTLKTFPLIYTSFLVK; TLKTFPLIYTSFLVKL;
LKTFPLIYTSFLVKLY; KTFPLIYTSFLVKLYL;
TFPLIYTSFLVKLYLV; FPLIYTSFLVKLYLVI;
PLIYTSFLVKLYLVIE; LIYTSFLVKLYLVIEP;
IYTSFLVKLYLVIEPL; YTSFLVKLYLVIEPLP;
TSFLVKLYLVIEPLPA; SFLVKLYLVIEPLPAL;
FLVKLYLVIEPLPALL; LVKLYLVIEPLPALLC;
VKLYLVIEPLPALLCI; KLYLVIEPLPALLCIL;
LYLVIEPLPALLCILL; YLVIEPLPALLCILLK;
LVIEPLPALLCILLKK; VIEPLPALLCILLKKK;
IEPLPALLCILLKKKL; EPLPALLCILLKKKLK;
PLPALLCILLKKKLKF; LPALLCILLKKKLKFC;
PALLCILLKKKLKFCI; ALLCILLKKKLKFCIK;
LLCILLKKKLKFCIKN; LCILLKKKLKFCIKNL;
CILLKKKLKFCIKNLW; ILLKKKLKFCIKNLWK;
LLKKKLKFCIKNLWKN; LKKKLKFCIKNLWKNI;
KKKLKFCIKNLWKNIL; LLLVDTCVLGIILYSF;
LHIDIEFLQLIISVKS; HIDIEFLQLIISVKSC;
IDIEFLQLIISVKSCV; DIEFLQLIISVKSCVP;
IEFLQLIISVKSCVPL; EFLQLIISVKSCVPLV;
FLQLIISVKSCVPLVF; RSMILAQKSLKKQSRC;
SMILAQKSLKKQSRCL; MILAQKSLKKQSRCLG;
ILAQKSLKKQSRCLGN; RSVKSVRKKTSLITLS;
SVKSVRKKTSLITLSI; VKSVRKKTSLITLSIM;
KSVRKKTSLITLSIMK; SVRKKTSLITLSIMKS;
VRKKTSLITLSIMKST; RKKTSLITLSIMKSTL;
KKTSLITLSIMKSTLQ; KTSLITLSIMKSTLQM;
TSLITLSIMKSTLQML; SLITLSIMKSTLQMLL;
LITLSIMKSTLQMLLF; ITLSIMKSTLQMLLFL;
TLSIMKSTLQMLLFLQ; LSIMKSTLQMLLFLQK;
SIMKSTLQMLLFLQKV; IMKSTLQMLLFLQKVK;
MKSTLQMLLFLQKVKI; KSTLQMLLFLQKVKIK;
STLQMLLFLQKVKIKV; TLQMLLFLQKVKIKKV;
LQMLLFLQKVKIKKVF; QMLLFLQKVKIKKVFV;
MLLFLQKVKIKKVFVS; LLFLQKVKIKKVFVSK;
LFLQKVKIKKVFVSKQ; NNIWQVLLGCTVCYLK;
NIWQVLLGCTVCYLKI; IWQVLLGCTVCYLKWI;
WQVLLGCTVCYLKWIL; YLIFCTVLFSMYLKED;
LIFCTVLFSMYLKEDT; IFCTVLFSMYLKEDTG;
FCTVLFSMYLKEDTGY; CTVLFSMYLKEDTGYL;
TVLFSMYLKEDTGYLK; VLFSMYLKEDTGYLKV;
LFSMYLKEDTGYLKVP; FSMYLKEDTGYLKVPL;
SMYLKEDTGYLKVPLI; MYLKEDTGYLKVPLIV;
YLKEDTGYLKVPLIVE; LKEDTGYLKVPLIVEK;
KEDTGYLKVPLIVEKQ; EDTGYLKVPLIVEKQH;
ENPYKTQSSYLKKEFY; NPYKTQSSYLKKEFYK;
PYKTQSSYLKKEFYKV; YKTQSSYLKKEFYKVE;
LILQLIYNLELLNGRK; ILQLIYNLELLNGRKG;
LQLIYNLELLNGRKGW; QLIYNLELLNGRKGWI;
LIYNLELLNGRKGWIL; IYNLELLNGRKGWILR;
NIIYAWGNVFLILQEK; IIYAWGNVFLILQEKR;
IYAWGNVFLILQEKRI; YAWGNVFLILQEKRIQ;
AWGNVFLILQEKRIQK; WGNVFLILQEKRIQKL;
GNVFLILQEKRIQKLK; NVFLILQEKRIQKLKT;
VFLILQEKRIQKLKTL; FLILQEKRIQKLKTLD;
LILQEKRIQKLKTLDM; ILQEKRIQKLKTLDMD;
LQEKRIQKLKTLDMDQ; QEKRIQKLKTLDMDQA;
EKRIQKLKTLDMDQAL; KRIQKLKTLDMDQALN;
RIQKLKTLDMDQALNP; IQKLKTLDMDQALNPN;
QKLKTLDMDQALNPNH; KLKTLDMDQALNPNHN;
LKTLDMDQALNPNHNA; KTLDMDQALNPNHNAL;
TLDMDQALNPNHNALP; LDMDQALNPNHNALPK;
DMDQALNPNHNALPKS; MDQALNPNHNALPKSQ;
DQALNPNHNALPKSQI; QALNPNHNALPKSQIL;
ALNPNHNALPKSQILQ; LNPNHNALPKSQILQP;
NPNHNALPKSQILQPL; PNHNALPKSQILQPLL;
NHNALPKSQILQPLLK; HNALPKSQILQPLLKI;
NALPKSQILQPLLKIP; ALPKSQILQPLLKIPK;
LPKSQILQPLLKIPKG; PKSQILQPLLKIPKGQ;
KSQILQPLLKIPKGQT; SQILQPLLKIPKGQTP;
QILQPLLKIPKGQTPI; ILQPLLKIPKGQTPIV;
LQPLLKIPKGQTPIVK; QPLLKIPKGQTPIVKS;
PLLKIPKGQTPIVKSC; LLKIPKGQTPIVKSCI;
LKIPKGQTPIVKSCIC; KIPKGQTPIVKSCICV;
IPKGQTPIVKSCICVK; PKGQTPIVKSCICVKA;
KGQTPIVKSCICVKAF; GQTPIVKSCICVKAFS;
QTPIVKSCICVKAFSV; TPIVKSCICVKAFSVL;
PIVKSCICVKAFSVLK; IVKSCICVKAFSVLKG;
VKSCICVKAFSVLKGL; KSCICVKAFSVLKGLK;
SCICVKAFSVLKGLKH; CICVKAFSVLKGLKHH;
ICVKAFSVLKGLKHHP; CVKAFSVLKGLKHHPQ;
VKAFSVLKGLKHHPQN; KAFSVLKGLKHHPQNN;
AFSVLKGLKHHPQNNT; FSVLKGLKHHPQNNTS;
SVLKGLKHHPQNNTSL; VLKGLKHHPQNNTSLK;
LKGLKHHPQNNTSLKV; KGLKHHPQNNTSLKVA;
GLKHHPQNNTSLKVAY; LKHHPQNNTSLKVAYT;
KHHPQNNTSLKVAYTK; HHPQNNTSLKVAYTKA;
HPQNNTSLKVAYTKAA; PQNNTSLKVAYTKAAF;
QNNTSLKVAYTKAAFI; NNTSLKVAYTKAAFIK;
NTSLKVAYTKAAFIKC; TSLKVAYTKAAFIKCI;
SLKVAYTKAAFIKCIC; LKVAYTKAAFIKCICT;
KVAYTKAAFIKCICTI; VAYTKAAFIKCICTIK;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

AYTKAAFIKCICTIKA; YTKAAFIKCICTIKAP;
TKAAFIKCICTIKAPV; SILVCNCPCLSIYLII;
ILVCNCPCLSIYLIIS; LVCNCPCLSIYLIISG;
VCNCPCLSIYLIISGS; CNCPCLSIYLIISGSP;
NCPCLSIYLIISGSPG; CPCLSIYLIISGSPGS;
PCLSIYLIISGSPGSL; CLSIYLIISGSPGSLS;
LSIYLIISGSPGSLSV; SIYLIISGSPGSLSVP;
IYLIISGSPGSLSVPS; YLIISGSPGSLSVPSN;
LIISGSPGSLSVPSNT; IISGSPGSLSVPSNTL;
ISGSPGSLSVPSNTLT; SGSPGSLSVPSNTLTS;
GSPGSLSVPSNTLTSS; SPGSLSVPSNTLTSST;
PGSLSVPSNTLTSSTW; GSLSVPSNTLTSSTWD;
SLSVPSNTLTSSTWDS; LSVPSNTLTSSTWDSI;
SVPSNTLTSSTWDSIP; VPSNTLTSSTWDSIPY;
PSNTLTSSTWDSIPYI; SNTLTSSTWDSIPYIG;
NTLTSSTWDSIPYIGC; TLTSSTWDSIPYIGCP;
LTSSTWDSIPYIGCPS; TSSTWDSIPYIGCPST;
SSTWDSIPYIGCPSTL; STWDSIPYIGCPSTLW;
TWDSIPYIGCPSTLWV; WDSIPYIGCPSTLWVL;
DSIPYIGCPSTLWVLL; SIPYIGCPSTLWVLLF;
IPYIGCPSTLWVLLFI; PYIGCPSTLWVLLFIR;
YIGCPSTLWVLLFIRS; IGCPSTLWVLLFIRSL;
GCPSTLWVLLFIRSLS; CPSTLWVLLFIRSLSK;
PSTLWVLLFIRSLSKK; STLWVLLFIRSLSKKE;
TLWVLLFIRSLSKKEI; LWVLLFIRSLSKKEIG;
GFFTDLFLRRILKYLA; FFTDLFLRRILKYLAR;
FTDLFLRRILKYLARP; TDLFLRRILKYLARPL;
DLFLRRILKYLARPLH; LFLRRILKYLARPLHC;
FLRRILKYLARPLHCC; LRRILKYLARPLHCCV;
RRILKYLARPLHCCVP; RILKYLARPLHCCVPE;
ILKYLARPLHCCVPEL; LKYLARPLHCCVPELL;
KYLARPLHCCVPELLV; YLARPLHCCVPELLVN;
LARPLHCCVPELLVNR; ARPLHCCVPELLVNRP;
RPLHCCVPELLVNRPQ; PLHCCVPELLVNRPQI;
LHCCVPELLVNRPQIS; HCCVPELLVNRPQISA;
CCVPELLVNRPQISAA; CVPELLVNRPQISAAE;
VPELLVNRPQISAAET; PELLVNRPQISAAETY;
ELLVNRPQISAAETYR; LLVNRPQISAAETYRL;
LVNRPQISAAETYRLS; VNRPQISAAETYRLSA;
NRPQISAAETYRLSAL; RPQISAAETYRLSALQ;
PQISAAETYRLSALQR; QISAAETYRLSALQRG;
ISAAETYRLSALQRGP; SAAETYRLSALQRGPT;
AAETYRLSALQRGPTP; AETYRLSALQRGPTPC;
ETYRLSALQRGPTPCS; TYRLSALQRGPTPCSS;
YRLSALQRGPTPCSSS; RLSALQRGPTPCSSSN;
LSALQRGPTPCSSSNT; SALQRGPTPCSSSNTV;
ALQRGPTPCSSSNTVV; LQRGPTPCSSSNTVVA;
QRGPTPCSSSNTVVAV; RGPTPCSSSNTVVAVL;
GPTPCSSSNTVVAVLV; PTPCSSSNTVVAVLVT;
STGGTFSPPVKVPKYL; TGGTFSPPVKVPKYLA;
GGTFSPPVKVPKYLAF; GTFSPPVKVPKYLAFS;
TFSPPVKVPKYLAFSF; FSPPVKVPKYLAFSFL;
SPPVKVPKYLAFSFLL; PPVKVPKYLAFSFLLG;
PVKVPKYLAFSFLLGS; VKVPKYLAFSFLLGSG;
KVPKYLAFSFLLGSGT; VPKYLAFSFLLGSGTQ;
PKYLAFSFLLGSGTQH; KYLAFSFLLGSGTQHS;
YLAFSFLLGSGTQHST; LAFSFLLGSGTQHSTG;
ALWSVFITWDWAVGFL; LWSVFITWDWAVGFLG;
WSVFITWDWAVGFLGV; SVFITWDWAVGFLGVI;
VFITWDWAVGFLGVIV; FITWDWAVGFLGVIVP;
ITWDWAVGFLGVIVPS; TWDWAVGFLGVIVPSG;
WDWAVGFLGVIVPSGY; DWAVGFLGVIVPSGYF;
WAVGFLGVIVPSGYFD; AVGFLGVIVPSGYFDL;
FISTPCISKGSPPTAK; ISTPCISKGSPPTAKK;
STPCISKGSPPTAKKW; TPCISKGSPPTAKKWK;
PCISKGSPPTAKKWKL; CISKGSPPTAKKWKLL;
ISKGSPPTAKKWKLLP; RLSMLVIPITSVCTVT;
LSMLVIPITSVCTVTA; SMLVIPITSVCTVTAS;
MLVIPITSVCTVTASH; LVIPITSVCTVTASHI;
VIPITSVCTVTASHIS; IPITSVCTVTASHISR;
PITSVCTVTASHISRF; ITSVCTVTASHISRFP;
TSVCTVTASHISRFPQ; SVCTVTASHISRFPQV;
VCTVTASHISRFPQVR; CTVTASHISRFPQVRS;
TVTASHISRFPQVRSS; VTASHISRFPQVRSSF;

TASHISRFPQVRSSFK; ASHISRFPQVRSSFKL;
SHISRFPQVRSSFKLG; HISRFPQVRSSFKLGR;
ISRFPQVRSSFKLGRG; SRFPQVRSSFKLGRGI;
RFPQVRSSFKLGRGIL; FPQVRSSFKLGRGILA;
PQVRSSFKLGRGILAV; QVRSSFKLGRGILAVL;
QGSIFLSGLSLLKSFS; GSIFLSGLSLLKSFSA;
SIFLSGLSLLKSFSAL; IFLSGLSLLKSFSALS;
FLSGLSLLKSFSALSF; LSGLSLLKSFSALSFR;
SGLSLLKSFSALSFRL; GLSLLKSFSALSFRLK;
LSLLKSFSALSFRLKP; SLLKSFSALSFRLKPL;
LLKSFSALSFRLKPLR; LKSFSALSFRLKPLRF;
KSFSALSFRLKPLRFS; SFSALSFRLKPLRFSS;
FSALSFRLKPLRFSSG; SALSFRLKPLRFSSGS;
ALSFRLKPLRFSSGSP; LSFRLKPLRFSSGSPI;
SFRLKPLRFSSGSPIS; FRLKPLRFSSGSPISG;
RLKPLRFSSGSPISGF; LKPLRFSSGSPISGFR;
KPLRFSSGSPISGFRK; PLRFSSGSPISGFRKH;
LRFSSGSPISGFRKHS; RFSSGSPISGFRKHST;
FSSGSPISGFRKHSTS; SSGSPISGFRKHSTSV;
SGSPISGFRKHSTSVI; GSPISGFRKHSTSVIA;
SPISGFRKHSTSVIAS; PISGFRKHSTSVIAST;
ISGFRKHSTSVIASTP; SGFRKHSTSVIASTPV;
GFRKHSTSVIASTPVL; FRKHSTSVIASTPVLT;
RKHSTSVIASTPVLTS; KHSTSVIASTPVLTSR;
HSTSVIASTPVLTSRT; STSVIASTPVLTSRTS;
TSVIASTPVLTSRTST; SVIASTPVLTSRTSTP;
VIASTPVLTSRTSTPP; IASTPVLTSRTSTPPF;
ASTPVLTSRTSTPPFI; STPVLTSRTSTPPFIS;
TPVLTSRTSTPPFISS; PVLTSRTSTPPFISSF;
VLTSRTSTPPFISSFG; LTSRTSTPPFISSFGT;
TSRTSTPPFISSFGTC; SRTSTPPFISSFGTCT;
RTSTPPFISSFGTCTG; TSTPPFISSFGTCTGS;
STPPFISSFGTCTGSF; TPPFISSFGTCTGSFG;
PPFISSFGTCTGSFGF; PFISSFGTCTGSFGFL;
FISSFGTCTGSFGFLG; ISSFGTCTGSFGFLGA;
SSFGTCTGSFGFLGAA; SFGTCTGSFGFLGAAP;
FGTCTGSFGFLGAAPG; GTCTGSFGFLGAAPGH;
TCTGSFGFLGAAPGHS; CTGSFGFLGAAPGHSP;
TGSFGFLGAAPGHSPF; GSFGFLGAAPGHSPFL;
SFGFLGAAPGHSPFLL; FGFLGAAPGHSPFLLV;
GFLGAAPGHSPFLLVG; FLGAAPGHSPFLLVGA;
LGAAPGHSPFLLVGAI; GAAPGHSPFLLVGAIF;
AAPGHSPFLLVGAIFI; APGHSPFLLVGAIFIC;
PGHSPFLLVGAIFICF; GHSPFLLVGAIFICFK;
HSPFLLVGAIFICFKS; SPFLLVGAIFICFKSR;
PFLLVGAIFICFKSRC; FLLVGAIFICFKSRCY;
LLVGAIFICFKSRCYS; LVGAIFICFKSRCYSP;
VGAIFICFKSRCYSPV; GAIFICFKSRCYSPVQ;
AIFICFKSRCYSPVQA; RQHPLRSSSLISTSWG;
QHPLRSSSLISTSWGN; HPLRSSSLISTSWGNS;
PLRSSSLISTSWGNSF; LRSSSLISTSWGNSFF;
RSSSLISTSWGNSFFY; SSSLISTSWGNSFFYK;
SSLISTSWGNSFFYKL; SLISTSWGNSFFYKLS;
VHSLCNFFYTVSIIYT; HSLCNFFYTVSIIYTI;
SLCNFFYTVSIIYTIS; LCNFFYTVSIIYTISM;
CNFFYTVSIIYTISMA; NFFYTVSIIYTISMAK;
FFYTVSIIYTISMAKM; FYTVSIIYTISMAKMY;
YTVSIIYTISMAKMYT; TVSIIYTISMAKMYTG;
VSIIYTISMAKMYTGT; SIIYTISMAKMYTGTF;
IIYTISMAKMYTGTFP; IYTISMAKMYTGTFPF;
YTISMAKMYTGTFPFS; TISMAKMYTGTFPFSY;
ISMAKMYTGTFPFSYL; SMAKMYTGTFPFSYLS;
MAKMYTGTFPFSYLSN; AKMYTGTFPFSYLSNH;
GPNRGKIRIILLNIII; PNRGKIRIILLNIIIK;
NRGKIRIILLNIIIKV; RGKIRIILLNIIIKVY;
GKIRIILLNIIIKVYR; KIRIILLNIIIKVYRG;
IRIILLNIIIKVYRGI; RIILLNIIIKVYRGIY;
IILLNIIIKVYRGIYN; ILLNIIIKVYRGIYNC;
LLNIIIKVYRGIYNCP; LNIIIKVYRGIYNCPG;
NIIIKVYRGIYNCPGS; IIIKVYRGIYNCPGSF;
IIKVYRGIYNCPGSFL; IKVYRGIYNCPGSFLQ;
KVYRGIYNCPGSFLQK; VYRGIYNCPGSFLQKS;
YRGIYNCPGSFLQKSS; RGIYNCPGSFLQKSSQ;
GIYNCPGSFLQKSSQG; IYNCPGSFLQKSSQGV;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

YNCPGSFLQKSSQGVS; NCPGSFLQKSSQGVSK;
CPGSFLQKSSQGVSKK; PGSFLQKSSQGVSKKS;
GSFLQKSSQGVSKKSF; SFLQKSSQGVSKKSFC;
FLQKSSQGVSKKSFCS; LQKSSQGVSKKSFCSS;
QKSSQGVSKKSFCSSL; KSSQGVSKKSFCSSLQ;
SSQGVSKKSFCSSLQF; SQGVSKKSFCSSLQFL;
GYRRYIIPNNMPQSLG; YRRYIIPNNMPQSLGN;
RRYIIPNNMPQSLGNS; RYIIPNNMPQSLGNSS;
YIIPNNMPQSLGNSSK; IIPNNMPQSLGNSSKQ;
IPNNMPQSLGNSSKQR; PNNMPQSLGNSSKQRR;
NNMPQSLGNSSKQRRT; NMPQSLGNSSKQRRTP;
MPQSLGNSSKQRRTPM; PQSLGNSSKQRRTPMP;
QSLGNSSKQRRTPMPR; SLGNSSKQRRTPMPRI;
LGNSSKQRRTPMPRIK; GNSSKQRRTPMPRIKV;
NSSKQRRTPMPRIKVL; SSKQRRTPMPRIKVLN;
SKQRRTPMPRIKVLNI; KQRRTPMPRIKVLNII;
QRRTPMPRIKVLNIIN; RRTPMPRIKVLNIIINK;
RTPMPRIKVLNIINKS; TPMPRIKVLNIINKSI;
PMPRIKVLNIINKSIY; MPRIKVLNIINKSIYT;
PRIKVLNIINKSIYTR; RIKVLNIINKSIYTRK;
IKVLNIINKSIYTRKQ; KVLNIINKSIYTRKQN;
VLNIINKSIYTRKQNI; LNIINKSIYTRKQNII;
NIINKSIYTRKQNIIV; IINKSIYTRKQNIIVL;
INKSIYTRKQNIIVLI; NKSIYTRKQNIIVLIW;
KSIYTRKQNIIVLIWV; SIYTRKQNIIVLIWVK;
IYTRKQNIIVLIWVKQ; YTRKQNIIVLIWVKQF;
TRKQNIIVLIWVKQFQ; RKQNIIVLIWVKQFQS;
KQNIIVLIWVKQFQSH; QNIIVLIWVKQFQSHA;
LLIEAYSGNFVIPIIK; LIEAYSGNFVIPIIKE;
IEAYSGNFVIPIIKEL; EAYSGNFVIPIIKELI;
AYSGNFVIPIIKELIP; YSGNFVIPIIKELIPY;
SGNFVIPIIKELIPYL; GNFVIPIIKELIPYLS;
SSKPSNSPRSTSNYSI; SKPSNSPRSTSNYSIC;
KPSNSPRSTSNYSICL; PSNSPRSTSNYSICLR;
SNSPRSTSNYSICLRS; GTCYALYSSKGCNLNF;
TCYALYSSKGCNLNFY; CYALYSSKGCNLNFYS;
YALYSSKGCNLNFYSS; ALYSSKGCNLNFYSSS;
LYSSKGCNLNFYSSSS; YSSKGCNLNFYSSSSL;
SSKGCNLNFYSSSSLP; SKGCNLNFYSSSSLPS;
KGCNLNFYSSSSLPSS; GCNLNFYSSSSLPSSN;
CNLNFYSSSSLPSSNF; NLNFYSSSSLPSSNFS;
LNFYSSSSLPSSNFSH; SSTHEPGNTKKKGLLT;
ESFTESFTAGKAVVLL; SFTESFTAGKAVVLLF;
FTESFTAGKAVVLLFF; TESFTAGKAVVLLFFP;
ESFTAGKAVVLLFFPS; SFTAGKAVVLLFFPST;
FTAGKAVVLLFFPSTL; TAGKAVVLLFFPSTLS;
AGKAVVLLFFPSTLSS; GKAVVLLFFPSTLSSP;
KAVVLLFFPSTLSSPL; AVVLLFFPSTLSSPLQ;
VVLLFFPSTLSSPLQN; VLLFFPSTLSSPLQNS;
LLFFPSTLSSPLQNSS; LFFPSTLSSPLQNSSK;
FFPSTLSSPLQNSSKS; FPSTLSSPLQNSSKSS;
PSTLSSPLQNSSKSSK; STLSSPLQNSSKSSKI;
TLSSPLQNSSKSSKIK; LSSPLQNSSKSSKIKI;
SSPLQNSSKSSKIKIK; SPLQNSSKSSKIKIKI;
PLQNSSKSSKIKIKIL; ALFFVPVQVLPTFTEA;
LFFVPVQVLPTFTEAC; FFVPVQVLPTFTEACR;
FVPVQVLPTFTEACRD; VPVQVLPTFTEACRDS;
PVQVLPTFTEACRDSW; VQVLPTFTEACRDSWR;
QVLPTFTEACRDSWRR; VLPTFTEACRDSWRRT;
LPTFTEACRDSWRRTM; PTFTEACRDSWRRTMA;
TFTEACRDSWRRTMAF; FTEACRDSWRRTMAFV;
TEACRDSWRRTMAFVQ; EACRDSWRRTMAFVQF;
ACRDSWRRTMAFVQFN; CRDSWRRTMAFVQFNW;
RDSWRRTMAFVQFNWG; DSWRRTMAFVQFNWGQ;
SWRRTMAFVQFNWGQG; WRRTMAFVQFNWGQGQ;
RRTMAFVQFNWGQGQD; RTMAFVQFNWGQGQDS;
ARKTCLSCTFLPEVMV; RKTCLSCTFLPEVMVW;
KTCLSCTFLPEVMVWL; TCLSCTFLPEVMVWLH;
CLSCTFLPEVMVWLHS; LSCTFLPEVMVWLHSM;
SCTFLPEVMVWLHSMG; CTFLPEVMVWLHSMGK;
TFLPEVMVWLHSMGKQ; FLPEVMVWLHSMGKQL;
LPEVMVWLHSMGKQLL; PEVMVWLHSMGKQLLP;
EVMVWLHSMGKQLLPV; VMVWLHSMGKQLLPVS;
MVWLHSMGKQLLPVSH; VWLHSMGKQLLPVSHA;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

WLHSMGKQLLPVSHAL; LHSMGKQLLPVSHALS;
HSMGKQLLPVSHALSF; SMGKQLLPVSHALSFL;
MGKQLLPVSHALSFLR; GKQLLPVSHALSFLRS;
KQLLPVSHALSFLRSW; QLLPVSHALSFLRSWF;
LLPVSHALSFLRSWFG; LPVSHALSFLRSWFGC;
PVSHALSFLRSWFGCI; VSHALSFLRSWFGCIP;
SHALSFLRSWFGCIPL; GLAKLFGEIPILLQFL;
LAKLFGEIPILLQFLQ

BK virus reverse reading frame 2

13 mers:

WIKFLTGKNPWSS; IKFLTGKNPWSSW; KFLTGKNPWSSWT;
FLTGKNPWSSWTF; GSVRNFTLTKGAT; SVRNFTLTKGATR;
VRNFTLTKGATRI; RNFTLTKGATRIK; LISLILEPGVAQR;
ISLILEPGVAQRF; SLILEPGVAQRFV; LILEPGVAQRFVL;
ILEPGVAQRFVLI; LEPGVAQRFVLIF; EPGVAQRFVLIFL;
PGVAQRFVLIFLF; GVAQRFVLIFLFA; VAQRFVLIFLFAQ;
AQRFVLIFLFAQI; QRFVLIFLFAQIP; RFVLIFLFAQIPC;
FVLIFLFAQIPCT; VLIFLFAQIPCTA; LIFLFAQIPCTAR;
IFLFAQIPCTARN; FLFAQIPCTARNG; LFAQIPCTARNGL;
FAQIPCTARNGLF; AQIPCTARNGLFV; QIPCTARNGLFVP;
IPCTARNGLFVPK; PCTARNGLFVPKS; CTARNGLFVPKSL;
TARNGLFVPKSLL; ARNGLFVPKSLLC; RNGLFVPKSLLCT;
NGLFVPKSLLCTA; GLFVPKSLLCTAL; LFVPKSLLCTALA;
FVPKSLLCTALAC; VPKSLLCTALACY; PKSLLCTALACYV;
KSLLCTALACYVS; SLLCTALACYVSL; LLCTALACYVSLD;
IATALTASHSGLA; VIIFFIGANLWNR; IIFFIGANLWNRR;
IFFIGANLWNRRV; FFIGANLWNRRVG; FIGANLWNRRVGV;
IGANLWNRRVGVL; GANLWNRRVGVLV; ANLWNRRVGVLVE;
NLWNRRVGVLVEF; LWNRRVGVLVEFL; RSNSRFSTLNTTQ;
SNSRFSTLNTTQK; NSRFSTLNTTQKK; SRFSTLNTTQKKK;
RFSTLNTTQKKKK; FSTLNTTQKKKKG; STLNTTQKKKKGR;
TLNTTQKKKKGRR; LNTTQKKKKGRRP; NTTQKKKKGRRPS;
SIPYYRRKHSRGL; IPYYRRKHSRGLK; PYYRRKHSRGLKG;
YYRRKHSRGLKGA; GCVFIIRYVFRIS; CVFIIRYVFRISI;
VFIIRYVFRISIQ; FIIRYVFRISIQC; IIRYVFRISIQCR;
IRYVFRISIQCRG; RYVFRISIQCRGV; KSKKYLSASSRYS;
SKKYLSASSRYSF; KKYLSASSRYSFS; KKSRYPSYDQGRN;
KSRYPSYDQGRNA; SRYPSYDQGRNAN; RYPSYDQGRNANR;
YPSYDQGRNANRK; PSYDQGRNANRKI; SYDQGRNANRKIQ;
YDQGRNANRKIQS; DQGRNANRKIQSY; QGRNANRKIQSYI;
GRNANRKIQSYIR; NGFNIWSSWKCCT; GFNIWSSWKCCTR;
FNIWSSWKCCTRT; NIWSSWKCCTRTI; IWSSWKCCTRTIY;
WSSWKCCTRTIYG; SSWKCCTRTIYGR; SWKCCTRTIYGRC;
WKCCTRTIYGRCC; KCCTRTIYGRCCL; CCTRTIYGRCCLA;
CTRTIYGRCCLAA; TRTIYGRCCLAAL; RTIYGRCCLAALF;
TIYGRCCLAALFA; IYGRCCLAALFAT; WKNNTSCRVIRFV;
KNNTSCRVIRFVW; NNTSCRVIRFVWW; SLKCKPTHGKANL;
IKGFAFRTWNKQF; KGFAFRTWNKQFR; GFAFRTWNKQFRQ;
FAFRTWNKQFRQF; AFRTWNKQFRQFE; FRTWNKQFRQFER;
RTWNKQFRQFERL; TWNKQFRQFERLF; WNKQFRQFERLFR;
NKQFRQFERLFRW; KQFRQFERLFRWK; QFRQFERLFRWKC;
GKFRKETFKQKNP; KFRKETFKQKNPN; FRKETFKQKNPNI;
RKETFKQKNPNIS; KETFKQKNPNIST; ETFKQKNPNISTR;
TFKQKNPNISTRL; FKQKNPNISTRLG; KQKNPNISTRLGY;
QKNPNISTRLGYN; KNPNISTRLGYNE; AQNIFKKILTKLR;
QNIFKKILTKLRV; NIFKKILTKLRVL; IFKKILTKLRVLT;
KKNFTKWNDLVAT; KNFTKWNDLVATA; NFTKWNDLVATAN;
FTKWNDLVATANL; TKWNDLVATANLV; IPITMLFPSLRYF;
PITMLFPSLRYFS; ITMLFPSLRYFSP; TMLFPSLRYFSPC;
KWLIQKQHLLNVY; WLIQKQHLLNVYV; LIQKQHLLNVYVQ;
KHLFKAFWFAIVP; HLFKAFWFAIVPV; LFKAFWFAIVPVC;
FKAFWFAIVPVCQ; KAFWFAIVPVCQY; AFWFAIVPVCQYI;
FWFAIVPVCQYIL; WFAIVPVCQYILS; FAIVPVCQYILSY;
AIVPVCQYILSYL; IVPVCQYILSYLG; VPVCQYILSYLGP;
PVCQYILSYLGPL; VCQYILSYLGPLE; CQYILSYLGPLEV;
QYILSYLGPLEVF; YILSYLGPLEVFL; ILSYLGPLEVFLC;
LSYLGPLEVFLCH; SYLGPLEVFLCHQ; YLGPLEVFLCHQT;
LGPLEVFLCHQTP; GHLAKRKLGKDSL; HLAKRKLGKDSLQ;
LAKRKLGKDSLQI; AKRKLGKDSLQIF; KRKLGKDSLQIFF;
RKLGKDSLQIFFS; KLGKDSLQIFFSG; LGKDSLQIFFSGG;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GKDSLQIFFSGGS; NILQGLSTVVFQS; ILQGLSTVVFQSC;
TGHKYQQLKHTGY; GHKYQQLKHTGYQ; HKYQQLKHTGYQL;
KYQQLKHTGYQLY; YQQLKHTGYQLYK; QQLKHTGYQLYKE;
QLKHTGYQLYKEA; LKHTGYQLYKEAP; KHTGYQLYKEAPH;
HTGYQLYKEAPHP; TGYQLYKEAPHPV; GYQLYKEAPHPVH;
YQLYKEAPHPVHL; QLYKEAPHPVHLA; LYKEAPHPVHLAT;
YKEAPHPVHLATL; KEAPHPVHLATLW; LCWSHEVLGEHFP;
CWSHEVLGEHFPL; WSHEVLGEHFPLL; HFHFYWDQVPSTQ;
FHFYWDQVPSTQL; HFYWDQVPSTQLD; FYWDQVPSTQLDK;
YWDQVPSTQLDKH; WDQVPSTQLDKHC; DQVPSTQLDKHCF;
QVPSTQLDKHCFC; VPSTQLDKHCFCP; PSTQLDKHCFCPN;
STQLDKHCFCPNR; TQLDKHCFCPNRP; QLDKHCFCPNRPY;
LDKHCFCPNRPYG; DKHCFCPNRPYGQ; KHCFCPNRPYGQY;
HCFCPNRPYGQYS; CFCPNRPYGQYSL; FCPNRPYGQYSLP;
CPNRPYGQYSLPG; PNRPYGQYSLPGT; NRPYGQYSLPGTG;
RPYGQYSLPGTGL; PYGQYSLPGTGLL; YGQYSLPGTGLLG;
GQYSLPGTGLLGF; YHQGTLTCNSLAL; HQGTLTCNSLALP;
QGTLTCNSLALPA; GTLTCNSLALPAF; TLTCNSLALPAFP;
LTCNSLALPAFPR; TCNSLALPAFPRV; CNSLALPAFPRVL;
NSLALPAFPRVLH; SLALPAFPRVLHL; LALPAFPRVLHLQ;
ALPAFPRVLHLQQ; LPAFPRVLHLQQR; PAFPRVLHLQQRS;
AFPRVLHLQQRSG; FPRVLHLQQRSGN; PRVLHLQQRSGNY;
RVLHLQQRSGNYC; VLHLQQRSGNYCL; LHLQQRSGNYCLE;
VFLHHAHALFVTL; FLHHAHALFVTLH; LHHAHALFVTLHE;
HHAHALFVTLHEG; PLFVQLQPPTSVD; LFVQLQPPTSVDF;
FVQLQPPTSVDFH; VQLQPPTSVDFHR; QLQPPTSVDFHRL;
LQPPTSVDFHRLG; QPPTSVDFHRLGP; PPTSVDFHRLGPH;
PTSVDFHRLGPHL; TSVDFHRLGPHLN; SVDFHRLGPHLNW;
VDFHRLGPHLNWG; DFHRLGPHLNWGG; FHRLGPHLNWGGE;
HRLGPHLNWGGEF; RLGPHLNWGGEFL; LGPHLNWGGEFLL;
GPHLNWGGEFLLC; PHLNWGGEFLLCC; HLNWGGEFLLCCN;
LNWGGEFLLCCNR; NWGGEFLLCCNRE; WGGEFLLCCNREA;
GGEFLLCCNREAF; GEFLLCCNREAFF; EFLLCCNREAFFS;
FLLCCNREAFFSL; LLCCNREAFFSLG; LCCNREAFFSLGY;
CCNREAFFSLGYH; CNREAFFSLGYHC; GFHLDPPFLGLGS;
FHLDPPFLGLGSI; HLDPPFLGLGSIL; LDPPFLGLGSILP;
DPPFLGLGSILPL; LLELLLLLLLVVL; LELLLLLLVVLA;
ELLLLLLLVVLAL; LLLLLLLVVLALA; LLLLLLVVLALAR;
LLLLLVVLALARV; LLLLVVLALARVP; LLLVVLALARVPL;
LLVVLALARVPLA; LVVLALARVPLAF; VVLALARVPLAFW;
VLALARVPLAFWE; LALARVPLAFWEL; ALARVPLAFWELP;
LARVPLAFWELPL; ARVPLAFWELPLD; RVPLAFWELPLDT;
VPLAFWELPLDTL; PLAFWELPLDTLL; LAFWELPLDTLLF;
AFWELPLDTLLFF; FWELPLDTLLFFW; WELPLDTLLFFWL;
ELPLDTLLFFWLG; LPLDTLLFFWLGP; PLDTLLFFWLGPS;
LDTLLFFWLGPSS; DTLLFFWLGPSSY; TLLFFWLGPSSYA;
LLFFWLGPSSYAS; LFFWLGPSSYASR; FFWLGPSSYASRA;
FWLGPSSYASRAG; WLGPSSYASRAGV; LGPSSYASRAGVT;
GPSSYASRAGVTV; PSSYASRAGVTVP; SSYASRAGVTVPY;
SYASRAGVTVPYR; YASRAGVTVPYRP; ASRAGVTVPYRPR;
SRAGVTVPYRPRS; RAGVTVPYRPRSK; AGVTVPYRPRSKG;
GVTVPYRPRSKGN; VTVPYRPRSKGNI; TVPYRPRSKGNIH;
LAPPGAIVFSINS; APPGAIVFSINSP; PPGAIVFSINSPE;
PGAIVFSINSPEC; GAIVFSINSPECT; AIVFSINSPECTL;
IVFSINSPECTLC; FLKSILCVTSSIL; LKSILCVTSSILS;
KSILCVTSSILSA; SILCVTSSILSAS; ILCVTSSILSASS;
LCVTSSILSASSI; CVTSSILSASSIL; VWPKCTRVPSLSA;
WPKCTRVPSLSAT; PKCTRVPSLSATC; KCTRVPSLSATCL;
CTRVPSLSATCLT; TRVPSLSATCLTI; RVPSLSATCLTIE;
VPSLSATCLTIEG; PSLSATCLTIEGL; SLSATCLTIEGLI;
LSATCLTIEGLIG; SATCLTIEGLIGE; ATCLTIEGLIGER;
TCLTIEGLIGERS; CLTIEGLIGERSE; KFIGAFTIVQVVS;
FIGAFTIVQVVSS; IGAFTIVQVVSSK; GAFTIVQVVSSKN;
AFTIVQVVSSKNL; FTIVQVVSSKNLA; TIVQVVSSKNLAK;
IVQVVSSKNLAKE; VQVVSSKNLAKES; QVVSSKNLAKESL;
VVSSKNLAKESLK; VSSKNLAKESLKN; SSKNLAKESLKNL;
SKNLAKESLKNLS; KNLAKESLKNLSV; NLAKESLKNLSVL;
LAKESLKNLSVLL; AKESLKNLSVLLC; KESLKNLSVLLCN;
ESLKNLSVLLCNS; SLKNLSVLLCNSC; LKNLSVLLCNSCE;
KNLSVLLCNSCEV; NLSVLLCNSCEVI; LSVLLCNSCEVIE;
SVLLCNSCEVIEG; VLLCNSCEVIEGI; LLCNSCEVIEGIS;
LCNSCEVIEGISS; CNSCEVIEGISSL; NSCEVIEGISSLI;
SCEVIEGISSLIT; CEVIEGISSLITC; EVIEGISSLITCH;
VIEGISSLITCHK; IEGISSLITCHKA; EGISSLITCHKAW;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GISSLITCHKAWE; ISSLITCHKAWEI; SSLITCHKAWEIV;
SLITCHKAWEIVA; LITCHKAWEIVAN; ITCHKAWEIVANK;
TCHKAWEIVANKE; CHKAWEIVANKEG; HKAWEIVANKEGP;
KAWEIVANKEGPQ; AWEIVANKEGPQC; WEIVANKEGPQCL;
EIVANKEGPQCLG; IVANKEGPQCLGS; VANKEGPQCLGSR;
ANKEGPQCLGSRY; ILLTKVFTPGNRI; LLTKVFTPGNRIS;
YSSGLNNSKAMPD; SSGLNNSKAMPDC; IKAANPAIAPGAP;
KAANPAIAPGAPA; AANPAIAPGAPAI; ANPAIAPGAPAIT;
NPAIAPGAPAITA; PAIAPGAPAITAY; AIAPGAPAITAYV;
GVRPIAAIASEVL; VRPIAAIASEVLV; RPIAAIASEVLVM;
PIAAIASEVLVMP; IAAIASEVLVMPS; AAIASEVLVMPST;
AIASEVLVMPSTV; IASEVLVMPSTVA; ASEVLVMPSTVAR;
SEVLVMPSTVARD; EVLVMPSTVARDA; VLVMPSTVARDAI;
TSIAAAASPAAIS; SIAAAASPAAISA; IAAAASPAAISAT;
AAAASPAAISATE; AAASPAAISATEN; AASPAAISATENP;
ASPAAISATENPV; SPAAISATENPVA; PAAISATENPVAA;
AAISATENPVAAA; AISATENPVAAAA; ISATENPVAAAAS;
SATENPVAAAASD; ATENPVAAAASDT; TENPVAAAASDTL;
ENPVAAAASDTLA; NPVAAAASDTLAT; PVAAAASDTLATR;
VAAAASDTLATRS; AAAASDTLATRSP; AAASDTLATRSPK;
AASDTLATRSPKS; ASDTLATRSPKSA; SDTLATRSPKSAR;
DTLATRSPKSARA; TLATRSPKSARAA; LATRSPKSARAAP;
ATRSPKSARAAPM; TRSPKSARAAPMN; RSPKSARAAPMNL;
SPKSARAAPMNLE; PKSARAAPMNLEI; KSARAAPMNLEIQ;
SARAAPMNLEIQK; ARAAPMNLEIQKK; RAAPMNLEIQKKR;
AAPMNLEIQKKRD; APMNLEIQKKRDY; PMNLEIQKKRDYL;
MNLEIQKKRDYLP; NLEIQKKRDYLPR; LEIQKKRDYLPRS;
EIQKKRDYLPRSL; IQKKRDYLPRSLL; QKKRDYLPRSLLQ;
KKRDYLPRSLLQS; KRDYLPRSLLQSL; RDYLPRSLLQSLL;
DYLPRSLLQSLLQ; YLPRSLLQSLLQQ; LPRSLLQSLLQQV;
PRSLLQSLLQQVK; RSLLQSLLQQVKQ; SLLQSLLQQVKQW;
LLQSLLQQVKQWY; LQSLLQQVKQWYF; QSLLQQVKQWYFC;
SLLQQVKQWYFCF; LLQQVKQWYFCFS; LQQVKQWYFCFSR;
QQVKQWYFCFSRL; QVKQWYFCFSRLH; VKQWYFCFSRLHC;
KQWYFCFSRLHCL; QWYFCFSRLHCLH; WYFCFSRLHCLHL;
YFCFSRLHCLHLY; FCFSRLHCLHLYK; CFSRLHCLHLYKI;
FSRLHCLHLYKIP; SRLHCLHLYKIPA; RLHCLHLYKIPAK;
LHCLHLYKIPAKA; HCLHLYKIPAKAL; CLHLYKIPAKALK;
KSSELFFLFQSRF; SSELFFLFQSRFY; SELFFLFQSRFYQ;
ELFFLFQSRFYQL; LFFLFQSRFYQLS; FFLFQSRFYQLSL;
FLFQSRFYQLSLK; LFQSRFYQLSLKL; FQSRFYQLSLKLV;
QSRFYQLSLKLVV; SRFYQLSLKLVVT; RFYQLSLKLVVTA;
FYQLSLKLVVTAG; YQLSLKLVVTAGA; QLSLKLVVTAGAE;
LSLKLVVTAGAEP; SLKLVVTAGAEPW; LKLVVTAGAEPWP;
KLVVTAGAEPWPL; LVVTAGAEPWPLS; VVTAGAEPWPLSS;
VTAGAEPWPLSSL; TAGAEPWPLSSLT; AGAEPWPLSSLTG;
GAEPWPLSSLTGD; AEPWPLSSLTGDK; EPWPLSSLTGDKA;
PWPLSSLTGDKAK; WPLSSLTGDKAKI; PLSSLTGDKAKIP;
LSSLTGDKAKIPR; SSLTGDKAKIPRL; SLTGDKAKIPRLA;
LTGDKAKIPRLAK; TGDKAKIPRLAKH; GDKAKIPRLAKHV;
DKAKIPRLAKHVC; KAKIPRLAKHVCH; AKIPRLAKHVCHA;
KIPRLAKHVCHAL; IPRLAKHVCHALS; PRLAKHVCHALSF;
RLAKHVCHALSFL; LAKHVCHALSFLR; AKHVCHALSFLRS;
KHVCHALSFLRSW; HVCHALSFLRSWF; VCHALSFLRSWFG;
CHALSFLRSWFGC; HALSFLRSWFGCI; ALSFLRSWFGCIP;
LSFLRSWFGCIPW; SFLRSWFGCIPWV; FLRSWFGCIPWVS;
LRSWFGCIPWVSS; RSWFGCIPWVSSS; SWFGCIPWVSSSS;
WFGCIPWVSSSSL; GHGLAAFPCESCT; HGLAAFPCESCTF;
GLAAFPCESCTFL; LAAFPCESCTFLP; AAFPCESCTFLPE;
AFPCESCTFLPEV; FPCESCTFLPEVM; PCESCTFLPEVMV;
CESCTFLPEVMVW; ESCTFLPEVMVWL; SCTFLPEVMVWLH;
CTFLPEVMVWLHS; TFLPEVMVWLHSM; FLPEVMVWLHSMG;
LPEVMVWLHSMGK; PEVMVWLHSMGKQ; EVMVWLHSMGKQL;
VMVWLHSMGKQLL; MVWLHSMGKQLLP; VWLHSMGKQLLPV;
WLHSMGKQLLPVA; LHSMGKQLLPVAF; HSMGKQLLPVAFF;
SMGKQLLPVAFFF; MGKQLLPVAFFFI; GKQLLPVAFFFII;
KQLLPVAFFFIIY; QLLPVAFFFIIYK; LLPVAFFFIIYKR;
LPVAFFFIIYKRP; PVAFFFIIYKRPR; VAFFFIIYKRPRP;
AFFFIIYKRPRPP; FFFIIYKRPRPPL; FFIIYKRPRPPLP;
FIIYKRPRPPLPP; IIYKRPRPPLPPP; IYKRPRPPLPPPF;
YKRPRPPLPPPFL; KRPRPPLPPPFLS; RPRPPLPPPFLSS;
PRPPLPPPFLSSS; RPPLPPPFLSSSK; PPLPPPFLSSSKG;
PLPPPFLSSSKGV; LPPPFLSSSKGVE; PPPFLSSSKGVEA;
PPFLSSSKGVEAF; PFLSSSKGVEAFS; FLSSSKGVEAFSE;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

LSSSKGVEAFSEA; QNYLGKSLFFCNF; NYLGKSLFFCNFC; YLGKSLFFCNFCK 14 mers:

WIKFLTGKNPWSSW; IKFLTGKNPWSSWT; KFLTGKNPWSSWTF;
GSVRNFTLTKGATR; SVRNFTLTKGATRI; VRNFTLTKGATRIK;
LISLILEPGVAQRF; ISLILEPGVAQRFV; SLILEPGVAQRFVL;
LILEPGVAQRFVLI; ILEPGVAQRFVLIF; LEPGVAQRFVLIFL;
EPGVAQRFVLIFLF; PGVAQRFVLIFLFA; GVAQRFVLIFLFAQ;
VAQRFVLIFLFAQI; AQRFVLIFLFAQIP; QRFVLIFLFAQIPC;
RFVLIFLFAQIPCT; FVLIFLFAQIPCTA; VLIFLFAQIPCTAR;
LIFLFAQIPCTARN; IFLFAQIPCTARNG; FLFAQIPCTARNGL;
LFAQIPCTARNGLF; FAQIPCTARNGLFV; AQIPCTARNGLFVP;
QIPCTARNGLFVPK; IPCTARNGLFVPKS; PCTARNGLFVPKSL;
CTARNGLFVPKSLL; TARNGLFVPKSLLC; ARNGLFVPKSLLCT;
RNGLFVPKSLLCTA; NGLFVPKSLLCTAL; GLFVPKSLLCTALA;
LFVPKSLLCTALAC; FVPKSLLCTALACY; VPKSLLCTALACYV;
PKSLLCTALACYVS; KSLLCTALACYVSL; SLLCTALACYVSLD;
VIIFFIGANLWNRR; IIFFIGANLWNRRV; IFFIGANLWNRRVG;
FFIGANLWNRRVGV; FIGANLWNRRVGVL; IGANLWNRRVGVLV;
GANLWNRRVGVLVE; ANLWNRRVGVLVEF; NLWNRRVGVLVEFL;
RSNSRFSTLNTTQK; SNSRFSTLNTTQKK; NSRFSTLNTTQKKK;
SRFSTLNTTQKKKK; RFSTLNTTQKKKKG; FSTLNTTQKKKKGR;
STLNTTQKKKKGRR; TLNTTQKKKKGRRP; RSIPYYRRKHSRGL;
SIPYYRRKHSRGLK; IPYYRRKHSRGLKG; PYYRRKHSRGLKGA;
GCVFIIRYVFRISI; CVFIIRYVFRISIQ; VFIIRYVFRISIQC;
FIIRYVFRISIQCR; IIRYVFRISIQCRG; IRYVFRISIQCRGV;
KSKKYLSASSRYSF; SKKYLSASSRYSFS; KKSRYPSYDQGRNA;
KSRYPSYDQGRNAN; SRYPSYDQGRNANR; RYPSYDQGRNANRK;
YPSYDQGRNANRKI; PSYDQGRNANRKIQ; SYDQGRNANRKIQS;
YDQGRNANRKIQSY; DQGRNANRKIQSYI; QGRNANRKIQSYIR;
NGFNIWSSWKCCTR; GFNIWSSWKCCTRT; FNIWSSWKCCTRTI;
NIWSSWKCCTRTIY; IWSSWKCCTRTIYG; WSSWKCCTRTIYGR;
SSWKCCTRTIYGRC; SWKCCTRTIYGRCC; WKCCTRTIYGRCCL;
KCCTRTIYGRCCLA; CCTRTIYGRCCLAA; CTRTIYGRCCLAAL;
TRTIYGRCCLAALF; RTIYGRCCLAALFA; TIYGRCCLAALFAT;
WKNNTSCRVIRFVW; KNNTSCRVIRFVWW; IKGFAFRTWNKQFR;
KGFAFRTWNKQFRQ; GFAFRTWNKQFRQF; FAFRTWNKQFRQFE;
AFRTWNKQFRQFER; FRTWNKQFRQFERL; RTWNKQFRQFERLF;
TWNKQFRQFERLFR; WNKQFRQFERLFRW; NKQFRQFERLFRWK;
KQFRQFERLFRWKC; GKFRKETFKQKNPN; KFRKETFKQKNPNI;
FRKETFKQKNPNIS; RKETFKQKNPNIST; KETFKQKNPNISTR;
ETFKQKNPNISTRL; TFKQKNPNISTRLG; FKQKNPNISTRLGY;
KQKNPNISTRLGYN; QKNPNISTRLGYNE; AQNIFKKILTKLRV;
QNIFKKILTKLRVL; NIFKKILTKLRVLT; KKNFTKWNDLVATA;
KNFTKWNDLVATAN; NFTKWNDLVATANL; FTKWNDLVATANLV;
IPITMLFPSLRYFS; PITMLFPSLRYFSP; ITMLFPSLRYFSPC;
KWLIQKQHLLNVYV; WLIQKQHLLNVYVQ; KHLFKAFWFAIVPV;
HLFKAFWFAIVPVC; LFKAFWFAIVPVCQ; FKAFWFAIVPVCQY;
KAFWFAIVPVCQYI; AFWFAIVPVCQYIL; FWFAIVPVCQYILS;
WFAIVPVCQYILSY; FAIVPVCQYILSYL; AIVPVCQYILSYLG;
IVPVCQYILSYLGP; VPVCQYILSYLGPL; PVCQYILSYLGPLE;
VCQYILSYLGPLEV; CQYILSYLGPLEVF; QYILSYLGPLEVFL;
YILSYLGPLEVFLC; ILSYLGPLEVFLCH; LSYLGPLEVFLCHQ;
SYLGPLEVFLCHQT; YLGPLEVFLCHQTP; GHLAKRKLGKDSLQ;
HLAKRKLGKDSLQI; LAKRKLGKDSLQIF; AKRKLGKDSLQIFF;
KRKLGKDSLQIFFS; RKLGKDSLQIFFSG; KLGKDSLQIFFSGG;
LGKDSLQIFFSGGS; NILQGLSTVVFQSC; TGHKYQQLKHTGYQ;
GHKYQQLKHTGYQL; HKYQQLKHTGYQLY; KYQQLKHTGYQLYK;
YQQLKHTGYQLYKE; QQLKHTGYQLYKEA; QLKHTGYQLYKEAP;
LKHTGYQLYKEAPH; KHTGYQLYKEAPHP; HTGYQLYKEAPHPV;
TGYQLYKEAPHPVH; GYQLYKEAPHPVHL; YQLYKEAPHPVHLA;
QLYKEAPHPVHLAT; LYKEAPHPVHLATL; YKEAPHPVHLATLW;
LCWSHEVLGEHPPL; CWSHEVLGEHPPLL; HFHFYWDQVPSTQL;
FHFYWDQVPSTQLD; HFYWDQVPSTQLDK; FYWDQVPSTQLDKH;
YWDQVPSTQLDKHC; WDQVPSTQLDKHCF; DQVPSTQLDKHCFC;
QVPSTQLDKHCFCP; VPSTQLDKHCFCPN; PSTQLDKHCFCPNR;
STQLDKHCFCPNRP; TQLDKHCFCPNRPY; QLDKHCFCPNRPYG;
LDKHCFCPNRPYGQ; DKHCFCPNRPYGQY; KHCFCPNRPYGQYS;
HCFCPNRPYGQYSL; CFCPNRPYGQYSLP; FCPNRPYGQYSLPG;
CPNRPYGQYSLPGT; PNRPYGQYSLPGTG; NRPYGQYSLPGTGL;
RPYGQYSLPGTGLL; PYGQYSLPGTGLLG; YGQYSLPGTGLLGF;
YHQGTLTCNSLALP; HQGTLTCNSLALPA; QGTLTCNSLALPAF;
GTLTCNSLALPAFP; TLTCNSLALPAFPR; LTCNSLALPAFPRV;
TCNSLALPAFPRVL; CNSLALPAFPRVLH; NSLALPAFPRVLHL;
SLALPAFPRVLHLQ; LALPAFPRVLHLQQ; ALPAFPRVLHLQQR;
LPAFPRVLHLQQRS; PAFPRVLHLQQRSG; AFPRVLHLQQRSGN;
FPRVLHLQQRSGNY; PRVLHLQQRSGNYC; RVLHLQQRSGNYCL;
VLHLQQRSGNYCLE; VFLHHAHALFVTLH; FLHHAHALFVTLHE;
LHHAHALFVTLHEG; PLFVQLQPPTSVDF; LFVQLQPPTSVDFH;
FVQLQPPTSVDFHR; VQLQPPTSVDFHRL; QLQPPTSVDFHRLG;
LQPPTSVDFHRLGP; QPPTSVDFHRLGPH; PPTSVDFHRLGPHL;
PTSVDFHRLGPHLN; TSVDFHRLGPHLNW; SVDFHRLGPHLNWG;
VDFHRLGPHLNWGG; DFHRLGPHLNWGGE; FHRLGPHLNWGGEF;
HRLGPHLNWGGEFL; RLGPHLNWGGEFLL; LGPHLNWGGEFLLC;
GPHLNWGGEFLLCC; PHLNWGGEFLLCCN; HLNWGGEFLLCCNR;
LNWGGEFLLCCNRE; NWGGEFLLCCNREA; WGGEFLLCCNREAF;
GGEFLLCCNREAFF; GEFLLCCNREAFFS; EFLLCCNREAFFSL;
FLLCCNREAFFSLG; LLCCNREAFFSLGY; LCCNREAFFSLGYH;
CCNREAFFSLGYHC; GFHLDPPFLGLGSI; FHLDPPFLGLGSIL;
HLDPPFLGLGSILP; LDPPFLGLGSILPL; LLELLLLLLVVLA;
LELLLLLLVVLAL; ELLLLLLVVLALA; LLLLLLVVLALAR;
LLLLLVVLALARV; LLLLVVLALARVP; LLLVVLALARVPL;
LLVVLALARVPLA; LVVLALARVPLAF; VVLALARVPLAFW;
VLALARVPLAFWE; LALARVPLAFWEL; ALARVPLAFWELP;
ALARVPLAFWELPL; LARVPLAFWELPLD; ARVPLAFWELPLDT;
RVPLAFWELPLDTL; VPLAFWELPLDTLL; PLAFWELPLDTLLF;
LAFWELPLDTLLFF; AFWELPLDTLLFFW; FWELPLDTLLFFWL;
WELPLDTLLFFWLG; ELPLDTLLFFWLGP; LPLDTLLFFWLGPS;
PLDTLLFFWLGPSS; LDTLLFFWLGPSSY; DTLLFFWLGPSSYA;
TLLFFWLGPSSYAS; LLFFWLGPSSYASR; LFFWLGPSSYASRA;
FFWLGPSSYASRAG; FWLGPSSYASRAGV; WLGPSSYASRAGVT;
LGPSSYASRAGVTV; GPSSYASRAGVTVP; PSSYASRAGVTVPY;
SSYASRAGVTVPYR; SYASRAGVTVPYRP; YASRAGVTVPYRPR;
ASRAGVTVPYRPRS; SRAGVTVPYRPRSK; RAGVTVPYRPRSKG;
AGVTVPYRPRSKGN; GVTVPYRPRSKGNI; VTVPYRPRSKGNIH;
LAPPGAIVFSINSP; APPGAIVFSINSPE; PPGAIVFSINSPEC;
PGAIVFSINSPECT; GAIVFSINSPECTL; AIVFSINSPECTLC;
FLKSILCVTSSILS; LKSILCVTSSILSA; KSILCVTSSILSAS;
SILCVTSSILSASS; ILCVTSSILSASSI; LCVTSSILSASSIL;
VWPKCTRVPSLSAT; WPKCTRVPSLSATC; PKCTRVPSLSATCL;
KCTRVPSLSATCLT; CTRVPSLSATCLTI; TRVPSLSATCLTIE;
RVPSLSATCLTIEG; VPSLSATCLTIEGL; PSLSATCLTIEGLI;
SLSATCLTIEGLIG; LSATCLTIEGLIGE; SATCLTIEGLIGER;
ATCLTIEGLIGERS; TCLTIEGLIGERSE; KFIGAFTIVQVSS;
FIGAFTIVQVSSK; IGAFTIVQVSSKN; GAFTIVQVSSKNL;
AFTIVQVSSKNLA; FTIVQVSSKNLAK; TIVQVSSKNLAKE;
IVQVVSSKNLAKES; VQVVSSKNLAKESL; QVVSSKNLAKESLK;
VVSSKNLAKESLKN; VSSKNLAKESLKNL; SSKNLAKESLKNLS;
SKNLAKESLKNLSV; KNLAKESLKNLSVL; NLAKESLKNLSVLL;
LAKESLKNLSVLLC; AKESLKNLSVLLCN; KESLKNLSVLLCNS;
ESLKNLSVLLCNSC; SLKNLSVLLCNSCE; LKNLSVLLCNSCEV;
KNLSVLLCNSCEVI; NLSVLLCNSCEVIE; LSVLLCNSCEVIEG;
SVLLCNSCEVIEGI; VLLCNSCEVIEGIS; LLCNSCEVIEGISS;
LCNSCEVIEGISSL; CNSCEVIEGISSLI; NSCEVIEGISSLIT;
SCEVIEGISSLITC; CEVIEGISSLITCH; EVIEGISSLITCHK;
VIEGISSLITCHKA; IEGISSLITCHKAW; EGISSLITCHKAWE;
GISSLITCHKAWEI; ISSLITCHKAWEIV; SSLITCHKAWEIVA;
SLITCHKAWEIVAN; LITCHKAWEIVANK; ITCHKAWEIVANKE;
TCHKAWEIVANKEG; CHKAWEIVANKEGP; HKAWEIVANKEGPQ;
KAWEIVANKEGPQC; AWEIVANKEGPQCL; WEIVANKEGPQCLG;
EIVANKEGPQCLGS; IVANKEGPQCLGSR; VANKEGPQCLGSRY;
ILLTKVFTPGNRIS; YSSGLNNSKAMPDC; IKAANPAIAPGAPA;
KAANPAIAPGAPAI; AANPAIAPGAPAIT; ANPAIAPGAPAITA;
NPAIAPGAPAITAY; PAIAPGAPAITAYV; GVRPIAAIASEVLV;
VRPIAAIASEVLVM; RPIAAIASEVLVMP; PIAAIASEVLVMPS;
IAAIASEVLVMPST; AAIASEVLVMPSTV; AIASEVLVMPSTVA;
IASEVLVMPSTVAR; ASEVLVMPSTVARD; SEVLVMPSTVARDA;
EVLVMPSTVARDAI; TSIAAAASPAAISA; SIAAAASPAAISAT;
IAAAASPAAISATE; AAAASPAAISATEN; AAASPAAISATENP;
AASPAAISATENPV; ASPAAISATENPVA; SPAAISATENPVAA;
PAAISATENPVAAA; AAISATENPVAAAS; AISATENPVAAAAS;
ISATENPVAAAASD; SATENPVAAAASDT; ATENPVAAAASDTL;
TENPVAAAASDTLA; ENPVAAAASDTLAT; NPVAAAASDTLATR;
PVAAAASDTLATRS; VAAAASDTLATRSP; AAAASDTLATRSPK;
AAASDTLATRSPKS; AASDTLATRSPKSA; ASDTLATRSPKSAR;
SDTLATRSPKSARA; DTLATRSPKSARAA; TLATRSPKSARAAP;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

LATRSPKSARAAPM; ATRSPKSARAAPMN; TRSPKSARAAPMNL;
RSPKSARAAPMNLE; SPKSARAAPMNLEI; PKSARAAPMNLEIQ;
KSARAAPMNLEIQK; SARAAPMNLEIQKK; ARAAPMNLEIQKKR;
RAAPMNLEIQKKRD; AAPMNLEIQKKRDY; APMNLEIQKKRDYL;
PMNLEIQKKRDYLP; MNLEIQKKRDYLPR; NLEIQKKRDYLPRS;
LEIQKKRDYLPRSL; EIQKKRDYLPRSLL; IQKKRDYLPRSLLQ;
QKKRDYLPRSLLQS; KKRDYLPRSLLQSL; KRDYLPRSLLQSLL;
RDYLPRSLLQSLLQ; DYLPRSLLQSLLQQ; YLPRSLLQSLLQQV;
LPRSLLQSLLQQVK; PRSLLQSLLQQVKQ; RSLLQSLLQQVKQW;
SLLQSLLQQVKQWY; LLQSLLQQVKQWYF; LQSLLQQVKQWYFC;
QSLLQQVKQWYFCF; SLLQQVKQWYFCFS; LLQQVKQWYFCFSR;
LQQVKQWYFCFSRL; QQVKQWYFCFSRLH; QVKQWYFCFSRLHC;
VKQWYFCFSRLHCL; KQWYFCFSRLHCLH; QWYFCFSRLHCLHL;
WYFCFSRLHCLHLY; YFCFSRLHCLHLYK; FCFSRLHCLHLYKI;
CFSRLHCLHLYKIP; FSRLHCLHLYKIPA; SRLHCLHLYKIPAK;
RLHCLHLYKIPAKA; LHCLHLYKIPAKAL; HCLHLYKIPAKALK;
KSSELFFLFQSRFY; SSELFFLFQSRFYQ; SELFFLFQSRFYQL;
ELFFLFQSRFYQLS; LFFLFQSRFYQLSL; FFLFQSRFYQLSLK;
FLFQSRFYQLSLKL; LFQSRFYQLSLKLV; FQSRFYQLSLKLVV;
QSRFYQLSLKLVVT; SRFYQLSLKLVVTA; RFYQLSLKLVVTAG;
FYQLSLKLVVTAGA; YQLSLKLVVTAGAE; QLSLKLVVTAGAEP;
LSLKLVVTAGAEPW; SLKLVVTAGAEPWP; LKLVVTAGAEPWPL;
KLVVTAGAEPWPLS; LVVTAGAEPWPLSS; VVTAGAEPWPLSSL;
VTAGAEPWPLSSLT; TAGAEPWPLSSLTG; AGAEPWPLSSLTGD;
GAEPWPLSSLTGDK; AEPWPLSSLTGDKA; EPWPLSSLTGDKAK;
PWPLSSLTGDKAKI; WPLSSLTGDKAKIP; PLSSLTGDKAKIPR;
LSSLTGDKAKIPRL; SSLTGDKAKIPRLA; SLTGDKAKIPRLAK;
LTGDKAKIPRLAKH; TGDKAKIPRLAKHV; GDKAKIPRLAKHVC;
DKAKIPRLAKHVCH; KAKIPRLAKHVCHA; AKIPRLAKHVCHAL;
KIPRLAKHVCHALS; IPRLAKHVCHALSF; PRLAKHVCHALSFL;
RLAKHVCHALSFLR; LAKHVCHALSFLRS; AKHVCHALSFLRSW;
KHVCHALSFLRSWF; HVCHALSFLRSWFG; VCHALSFLRSWFGC;
CHALSFLRSWFGCI; HALSFLRSWFGCIP; ALSFLRSWFGCIPW;
LSFLRSWFGCIPWV; SFLRSWFGCIPWVS; FLRSWFGCIPWVSS;
LRSWFGCIPWVSSS; RSWFGCIPWVSSSS; SWFGCIPWVSSSSL;
GHGLAAFPCESCTF; HGLAAFPCESCTFL; GLAAFPCESCTFLP;
LAAFPCESCTFLPE; AAFPCESCTFLPEV; AFPCESCTFLPEVM;
FPCESCTFLPEVMV; PCESCTFLPEVMVW; CESCTFLPEVMVWL;
ESCTFLPEVMVWLH; SCTFLPEVMVWLHS; CTFLPEVMVWLHSM;
TFLPEVMVWLHSMG; FLPEVMVWLHSMGK; LPEVMVWLHSMGKQ;
PEVMVWLHSMGKQL; EVMVWLHSMGKQLL; VMVWLHSMGKQLLP;
MVWLHSMGKQLLPV; VWLHSMGKQLLPVA; WLHSMGKQLLPVAF;
LHSMGKQLLPVAFF; HSMGKQLLPVAFFF; SMGKQLLPVAFFFI;
MGKQLLPVAFFFII; GKQLLPVAFFFIIY; KQLLPVAFFFIIYK;
QLLPVAFFFIIYKR; LLPVAFFFIIYKRP; LPVAFFFIIYKRPR;
PVAFFFIIYKRPRP; VAFFFIIYKRPRPP; AFFFIIYKRPRPPL;
FFFIIYKRPRPPLP; FFIIYKRPRPPLPP; FIIYKRPRPPLPPP;
IIYKRPRPPLPPPL; IYKRPRPPLPPPFL; YKRPRPPLPPPFLS;
KRPRPPLPPPFLSS; RPRPPLPPPFLSSS; PRPPLPPPFLSSSK;
RPPLPPPFLSSSKG; PPLPPPFLSSSKGV; PLPPPFLSSSKGVE;
LPPPFLSSSKGVEA; PPPFLSSSKGVEAF; PPFLSSSKGVEAFS;
PFLSSSKGVEAFSE; FLSSSKGVEAFSEA; QNYLGKSLFFCNFC;
NYLGKSLFFCNFCK 15 mers:

WIKFLTGKNPWSSWT; IKFLTGKNPWSSWTF; GSVRNFTLTKGATRI;
SVRNFTLTKGATRIK; LISLILEPGVAQRFV; ISLILEPGVAQRFVL;
SLILEPGVAQRFVLI; LILEPGVAQRFVLIF; ILEPGVAQRFVLIFL;
LEPGVAQRFVLIFLF; EPGVAQRFVLIFLFA; PGVAQRFVLIFLAQ;
GVAQRFVLIFLFAQI; VAQRFVLIFLFAQIP; AQRFVLIFLFAQIPC;
QRFVLIFLFAQIPCT; RFVLIFLFAQIPCTA; FVLIFLFAQIPCTAR;
VLIFLFAQIPCTARN; LIFLFAQIPCTARNG; IFLFAQIPCTARNGL;
FLFAQIPCTARNGLF; LFAQIPCTARNGLFV; FAQIPCTARNGLFVP;
AQIPCTARNGLFVPK; QIPCTARNGLFVPKS; IPCTARNGLFVPKSL;
PCTARNGLFVPKSLL; CTARNGLFVPKSLLC; TARNGLFVPKSLLCT;
ARNGLFVPKSLLCTA; RNGLFVPKSLLCTAL; NGLFVPKSLLCTALA;
GLFVPKSLLCTALAC; LFVPKSLLCTALACY; FVPKSLLCTALACYV;
VPKSLLCTALACYVS; PKSLLCTALACYVSL; KSLLCTALACYVSLD;
VIIFFIGANLWNRRV; IIFFIGANLWNRRVG; IFFIGANLWNRRVGV;
FFIGANLWNRRVGVL; FIGANLWNRRVGVLV; IGANLWNRRVGVLVE;
GANLWNRRVGVLVEF; ANLWNRRVGVLVEFL; RSNSRFSTLNTTQKK;
SNSRFSTLNTTQKKK; NSRFSTLNTTQKKKK; SRFSTLNTTQKKKKG;
RFSTLNTTQKKKKGR; FSTLNTTQKKKKGRR; STLNTTQKKKKGRRP;

RSIPYYRRKHSRGLK; SIPYYRRKHSRGLKG; IPYYRRKHSRGLKGA;
GCVFIIRYVFRISIQ; CVFIIRYVFRISIQC; VFIIRYVFRISIQCR;
FIIRYVFRISIQCRG; IIRYVFRISIQCRGV; KSKKYLSASSRYSFS;
KKSRYPSYDQGRNAN; KSRYPSYDQGRNANR; SRYPSYDQGRNANRK;
RYPSYDQGRNANRKI; YPSYDQGRNANRKIQ; PSYDQGRNANRKIQS;
SYDQGRNANRKIQSY; YDQGRNANRKIQSYI; DQGRNANRKIQSYIR;
NGFNIWSSWKCCTRT; GFNIWSSWKCCTRTI; FNIWSSWKCCTRTIY;
NIWSSWKCCTRTIYG; IWSSWKCCTRTIYGR; WSSWKCCTRTIYGRC;
SSWKCCTRTIYGRCC; SWKCCTRTIYGRCCL; WKCCTRTIYGRCCLA;
KCCTRTIYGRCCLAA; CCTRTIYGRCCLAAL; CTRTIYGRCCLAALF;
TRTIYGRCCLAALFA; RTIYGRCCLAALFAT; WKNNTSCRVIRFVWW;
IKGFAFRTWNKQFRQ; KGFAFRTWNKQFRQF; GFAFRTWNKQFRQFE;
FAFRTWNKQFRQFER; AFRTWNKQFRQFERL; FRTWNKQFRQFERLF;
RTWNKQFRQFERLFR; TWNKQFRQFERLFRW; WNKQFRQFERLFRWK;
NKQFRQFERLFRWKC; GKFRKETFKQKNPNI; KFRKETFKQKNPNIS;
FRKETFKQKNPNIST; RKETFKQKNPNISTR; KETFKQKNPNISTRL;
ETFKQKNPNISTRLG; TFKQKNPNISTRLGY; FKQKNPNISTRLGYN;
KQKNPNISTRLGYNE; AQNIFKKILTKLRVL; QNIFKKILTKLRVLT;
KKNFTKWNDLVATAN; KNFTKWNDLVATANL; NFTKWNDLVATANLV;
IPITMLFPSLRYFSP; PITMLFPSLRYFSPC; KWLIQKQHLLNVYVQ;
KHLFKAFWFAIVPVC; HLFKAFWFAIVPVCQ; LFKAFWFAIVPVCQY;
FKAFWFAIVPVCQYI; KAFWFAIVPVCQYIL; AFWFAIVPVCQYILS;
FWFAIVPVCQYILSY; WFAIVPVCQYILSYL; FAIVPVCQYILSYLG;
AIVPVCQYILSYLGP; IVPVCQYILSYLGPL; VPVCQYILSYLGPLE;
PVCQYILSYLGPLEV; VCQYILSYLGPLEVF; CQYILSYLGPLEVFL;
QYILSYLGPLEVFLC; YILSYLGPLEVFLCH; ILSYLGPLEVFLCHQ;
LSYLGPLEVFLCHQT; SYLGPLEVFLCHQTP; GHLAKRKLGKDSLQI;
HLAKRKLGKDSLQIF; LAKRKLGKDSLQIFF; AKRKLGKDSLQIFFS;
KRKLGKDSLQIFFSG; RKLGKDSLQIFFSGG; KLGKDSLQIFFSGGS;
TGHKYQQLKHTGYQL; GHKYQQLKHTGYQLY; HKYQQLKHTGYQLYK;
KYQQLKHTGYQLYKE; YQQLKHTGYQLYKEA; QQLKHTGYQLYKEAP;
QLKHTGYQLYKEAPH; LKHTGYQLYKEAPHP; KHTGYQLYKEAPHPV;
HTGYQLYKEAPHPVH; TGYQLYKEAPHPVHL; GYQLYKEAPHPVHLA;
YQLYKEAPHPVHLAT; QLYKEAPHPVHLATL; LYKEAPHPVHLATLW;
LCWSHEVLGEHFPLL; HFHFYWDQVPSTQLD; FHFYWDQVPSTQLDK;
HFYWDQVPSTQLDKH; FYWDQVPSTQLDKHC; YWDQVPSTQLDKHCF;
WDQVPSTQLDKHCFC; DQVPSTQLDKHCFCP; QVPSTQLDKHCFCPN;
VPSTQLDKHCFCPNR; PSTQLDKHCFCPNRP; STQLDKHCFCPNRPY;
TQLDKHCFCPNRPYG; QLDKHCFCPNRPYGQ; LDKHCFCPNRPYGQY;
DKHCFCPNRPYGQYS; KHCFCPNRPYGQYSL; HCFCPNRPYGQYSLP;
CFCPNRPYGQYSLPG; FCPNRPYGQYSLPGT; CPNRPYGQYSLPGTG;
PNRPYGQYSLPGTGL; NRPYGQYSLPGTGLL; RPYGQYSLPGTGLLG;
PYGQYSLPGTGLLGF; YHQGTLTCNSLALPA; HQGTLTCNSLALPAF;
QGTLTCNSLALPAFP; GTLTCNSLALPAFPR; TLTCNSLALPAFPRV;
LTCNSLALPAFPRVL; TCNSLALPAFPRVLH; CNSLALPAFPRVLHL;
NSLALPAFPRVLHLQ; SLALPAFPRVLHLQQ; LALPAFPRVLHLQQR;
ALPAFPRVLHLQQRS; LPAFPRVLHLQQRSG; PAFPRVLHLQQRSGN;
AFPRVLHLQQRSGNY; FPRVLHLQQRSGNYC; PRVLHLQQRSGNYCL;
RVLHLQQRSGNYCLE; VFLHHAHALFVTLHE; FLHHAHALFVTLHEG;
PLFVQLQPPTSVDFH; LFVQLQPPTSVDFHR; FVQLQPPTSVDFHRL;
VQLQPPTSVDFHRLG; QLQPPTSVDFHRLGP; LQPPTSVDFHRLGPH;
QPPTSVDFHRLGPHL; PPTSVDFHRLGPHLN; PTSVDFHRLGPHLNW;
TSVDFHRLGPHLNWG; SVDFHRLGPHLNWGG; VDFHRLGPHLNWGGE;
DFHRLGPHLNWGGEF; FHRLGPHLNWGGEFL; HRLGPHLNWGGEFLL;
RLGPHLNWGGEFLLC; LGPHLNWGGEFLLCC; GPHLNWGGEFLLCCN;
PHLNWGGEFLLCCNR; HLNWGGEFLLCCNRE; LNWGGEFLLCCNREA;
NWGGEFLLCCNREAF; WGGEFLLCCNREAFF; GGEFLLCCNREAFFS;
GEFLLCCNREAFFSL; EFLLCCNREAFFSLG; FLLCCNREAFFSLGY;
LLCCNREAFFSLGYH; LCCNREAFFSLGYHC; GFHLDPPFLGLGSIL;
FHLDPPFLGLGSILP; HLDPPFLGLGSILPL; LLELLLLLLLVVLAL;
LELLLLLLLVVLALA; ELLLLLLLVVLALAR; LLLLLLLVVLALARV;
LLLLLLVVLALARVP; LLLLLVVLALARVPL; LLLLVVLALARVPLA;
LLLVVLALARVPLAF; LLVVLALARVPLAFW; LVVLALARVPLAFWE;
VVLALARVPLAFWEL; VLALARVPLAFWELP; LALARVPLAFWELPL;
ALARVPLAFWELPLD; LARVPLAFWELPLDT; ARVPLAFWELPLDTL;
RVPLAFWELPLDTLL; VPLAFWELPLDTLLF; PLAFWELPLDTLLFF;
LAFWELPLDTLLFFW; AFWELPLDTLLFFWL; FWELPLDTLLFFWLG;
WELPLDTLLFFWLGP; ELPLDTLLFFWLGPS; LPLDTLLFFWLGPSS;
PLDTLLFFWLGPSSY; LDTLLFFWLGPSSYA; DTLLFFWLGPSSYAS;
TLLFFWLGPSSYASR; LLFFWLGPSSYASRA; LFFWLGPSSYASRAG;
FFWLGPSSYASRAGV; FWLGPSSYASRAGVT; WLGPSSYASRAGVTV;
LGPSSYASRAGVTVP; GPSSYASRAGVTVPY; PSSYASRAGVTVPYR;
SSYASRAGVTVPYRP; SYASRAGVTVPYRPR; YASRAGVTVPYRPRS;
ASRAGVTVPYRPRSK; SRAGVTVPYRPRSKG; RAGVTVPYRPRSKGN;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

AGVTVPYRPRSKGNI; GVTVPYRPRSKGNIH; LAPPGAIVFSINSPE;
APPGAIVFSINSPEC; PPGAIVFSINSPECT; PGAIVFSINSPECTL;
GAIVFSINSPECTLC; FLKSILCVTSSILSA; LKSILCVTSSILSAS;
KSILCVTSSILSASS; SILCVTSSILSASSI; ILCVTSSILSASSIL;
VWPKCTRVPSLSATC; WPKCTRVPSLSATCL; PKCTRVPSLSATCLT;
KCTRVPSLSATCLTI; CTRVPSLSATCLTIE; TRVPSLSATCLTIEG;
RVPSLSATCLTIEGL; VPSLSATCLTIEGLI; PSLSATCLTIEGLIG;
SLSATCLTIEGLIGE; LSATCLTIEGLIGER; SATCLTIEGLIGERS;
ATCLTIEGLIGERSE; KFIGAFTIVQVVSSK; FIGAFTIVQVVSSKN;
IGAFTIVQVVSSKNL; GAFTIVQVVSSKNLA; AFTIVQVVSSKNLAK;
FTIVQVVSSKNLAKE; TIVQVVSSKNLAKES; IVQVVSSKNLAKESL;
VQVVSSKNLAKESLK; QVVSSKNLAKESLKN; VVSSKNLAKESLKNL;
VSSKNLAKESLKNLS; SSKNLAKESLKNLSV; SKNLAKESLKNLSVL;
KNLAKESLKNLSVLL; NLAKESLKNLSVLLC; LAKESLKNLSVLLCN;
AKESLKNLSVLLCNS; KESLKNLSVLLCNSC; ESLKNLSVLLCNSCE;
SLKNLSVLLCNSCEV; LKNLSVLLCNSCEVI; KNLSVLLCNSCEVIE;
NLSVLLCNSCEVIEG; LSVLLCNSCEVIEGI; SVLLCNSCEVIEGIS;
VLLCNSCEVIEGISS; LLCNSCEVIEGISSL; LCNSCEVIEGISSLI;
CNSCEVIEGISSLIT; NSCEVIEGISSLITC; SCEVIEGISSLITCH;
CEVIEGISSLITCHK; EVIEGISSLITCHKA; VIEGISSLITCHKAW;
IEGISSLITCHKAWE; EGISSLITCHKAWEI; GISSLITCHKAWEIV;
ISSLITCHKAWEIVA; SSLITCHKAWEIVAN; SLITCHKAWEIVANK;
LITCHKAWEIVANKE; ITCHKAWEIVANKEG; TCHKAWEIVANKEGP;
CHKAWEIVANKEGPQ; HKAWEIVANKEGPQC; KAWEIVANKEGPQCL;
AWEIVANKEGPQCLG; WEIVANKEGPQCLGS; EIVANKEGPQCLGSR;
IVANKEGPQCLGSRY; IKAANPAIAPGAPAI; KAANPAIAPGAPAIT;
AANPAIAPGAPAITA; ANPAIAPGAPAITAY; NPAIAPGAPAITAYN;
GVRPIAAIASEVLVM; VRPIAAIASEVLVMP; RPIAAIASEVLVMPS;
PIAAIASEVLVMPST; IAAIASEVLVMPSTV; AAIASEVLVMPSTVA;
AIASEVLVMPSTVAR; IASEVLVMPSTVARD; ASEVLVMPSTVARDA;
SEVLVMPSTVARDAI; TSIAAAASPAAISAT; SIAAAASPAAISATE;
IAAAASPAAISATEN; AAAASPAAISATENP; AAASPAAISATENPV;
AASPAAISATENPVA; ASPAAISATENPVAA; SPAAISATENPVAAA;
PAAISATENPVAAAA; AAISATENPVAAAAS; AISATENPVAAAASD;
ISATENPVAAAASDT; SATENPVAAAASDTL; ATENPVAAAASDTLA;
TENPVAAAASDTLAT; ENPVAAAASDTLATR; NPVAAAASDTLATRS;
PVAAAASDTLATRSP; VAAAASDTLATRSPK; AAAASDTLATRSPKS;
AAASDTLATRSPKSA; AASDTLATRSPKSAR; ASDTLATRSPKSARA;
SDTLATRSPKSARAA; DTLATRSPKSARAAP; TLATRSPKSARAAPM;
LATRSPKSARAAPMN; ATRSPKSARAAPMNL; TRSPKSARAAPMNLE;
RSPKSARAAPMNLEI; SPKSARAAPMNLEIQ; PKSARAAPMNLEIQK;
KSARAAPMNLEIQKK; SARAAPMNLEIQKKR; ARAAPMNLEIQKKRD;
RAAPMNLEIQKKRDY; AAPMNLEIQKKRDYL; APMNLEIQKKRDYLP;
PMNLEIQKKRDYLPR; MNLEIQKKRDYLPRS; NLEIQKKRDYLPRSL;
LEIQKKRDYLPRSLL; EIQKKRDYLPRSLLQ; IQKKRDYLPRSLLQS;
QKKRDYLPRSLLQSL; KKRDYLPRSLLQSLL; KRDYLPRSLLQSLLQ;
RDYLPRSLLQSLLQQ; DYLPRSLLQSLLQQV; YLPRSLLQSLLQQVK;
LPRSLLQSLLQQVKQ; PRSLLQSLLQQVKQW; RSLLQSLLQQVKQWY;
SLLQSLLQQVKQWYF; LLQSLLQQVKQWYFC; LQSLLQQVKQWYFCF;
QSLLQQVKQWYFCFS; SLLQQVKQWYFCFSR; LLQQVKQWYFCFSRL;
LQQVKQWYFCFSRLH; QQVKQWYFCFSRLHC; QVKQWYFCFSRLHCL;
VKQWYFCFSRLHCLH; KQWYFCFSRLHCLHL; QWYFCFSRLHCLHLY;
WYFCFSRLHCLHLYK; YFCFSRLHCLHLYKI; FCFSRLHCLHLYKIP;
CFSRLHCLHLYKIPA; FSRLHCLHLYKIPAK; SRLHCLHLYKIPAKA;
RLHCLHLYKIPAKAL; LHCLHLYKIPAKALK; KSSELFFLFQSRFYQ;
SSELFFLFQSRFYQL; SELFFLFQSRFYQLS; ELFFLFQSRFYQLSL;
LFFLFQSRFYQLSLK; FFLFQSRFYQLSLKL; FLFQSRFYQLSLKLV;
LFQSRFYQLSLKLVV; FQSRFYQLSLKLVVT; QSRFYQLSLKLVVTA;
SRFYQLSLKLVVTAG; RFYQLSLKLVVTAGA; FYQLSLKLVVTAGAE;
YQLSLKLVVTAGAEP; QLSLKLVVTAGAEPW; LSLKLVVTAGAEPWP;
SLKLVVTAGAEPWPL; LKLVVTAGAEPWPLS; KLVVTAGAEPWPLSS;
LVVTAGAEPWPLSSL; VVTAGAEPWPLSSLT; VTAGAEPWPLSSLTG;
TAGAEPWPLSSLTGD; AGAEPWPLSSLTGDK; GAEPWPLSSLTGDKA;
AEPWPLSSLTGDKAK; EPWPLSSLTGDKAKI; PWPLSSLTGDKAKIP;
WPLSSLTGDKAKIPR; PLSSLTGDKAKIPRL; LSSLTGDKAKIPRLA;
SSLTGDKAKIPRLAK; SLTGDKAKIPRLAKH; LTGDKAKIPRLAKHV;
TGDKAKIPRLAKHVC; GDKAKIPRLAKHVCH; DKAKIPRLAKHVCHA;
KAKIPRLAKHVCHAL; AKIPRLAKHVCHALS; KIPRLAKHVCHALSF;
IPRLAKHVCHALSFL; PRLAKHVCHALSFLR; RLAKHVCHALSFLRS;
LAKHVCHALSFLRSW; AKHVCHALSFLRSWF; KHVCHALSFLRSWFG;
HVCHALSFLRSWFGC; VCHALSFLRSWFGCI; CHALSFLRSWFGCIP;
HALSFLRSWFGCIPW; ALSFLRSWFGCIPWV; LSFLRSWFGCIPWVS;
SFLRSWFGCIPWVSS; FLRSWFGCIPWVSSS; LRSWFGCIPWVSSSS;
RSWFGCIPWVSSSSL; GHGLAAFPCESCTFL; HGLAAFPCESCTFLP;
GLAAFPCESCTFLPE; LAAFPCESCTFLPEV; AAFPCESCTFLPEVM;
AFPCESCTFLPEVMV; FPCESCTFLPEVMVW; PCESCTFLPEVMVWL;
CESCTFLPEVMVWLH; ESCTFLPEVMVWLHS; SCTFLPEVMVWLHSM;
CTFLPEVMVWLHSMG; TFLPEVMVWLHSMGK; FLPEVMVWLHSMGKQ;
LPEVMVWLHSMGKQL; PEVMVWLHSMGKQLL; EVMVWLHSMGKQLLP;
VMVWLHSMGKQLLPV; MVWLHSMGKQLLPVA; VWLHSMGKQLLPVAF;
WLHSMGKQLLPVAFF; LHSMGKQLLPVAFFF; HSMGKQLLPVAFFFI;
SMGKQLLPVAFFFII; MGKQLLPVAFFFIIY; GKQLLPVAFFFIIYK;
KQLLPVAFFFIIYKR; QLLPVAFFFIIYKRP; LLPVAFFFIIYKRPR;
LPVAFFFIIYKRPRP; PVAFFFIIYKRPRPP; VAFFFIIYKRPRPPL;
AFFFIIYKRPRPPLP; FFFIIYKRPRPPLPP; FFIIYKRPRPPLPPP;
FIIYKRPRPPLPPPF; IIYKRPRPPLPPPFL; IYKRPRPPLPPPFLS;
YKRPRPPLPPPFLSS; KRPRPPLPPPFLSSS; RPRPPLPPPFLSSSK;
PRPPLPPPFLSSSKG; RPPLPPPFLSSSKGV; PPLPPPFLSSSKGVE;
PLPPPFLSSSKGVEA; LPPPFLSSSKGVEAF; PPPFLSSSKGVEAFS;
PPFLSSSKGVEAFSE; PFLSSSKGVEAFSEA; QNYLGKSLFFCNFCK 16 mers:

WIKFLTGKNPWSSWTF; GSVRNFTLTKGATRIK;
LISLILEPGVAQRFVL; ISLILEPGVAQRFVLI;
SLILEPGVAQRFVLIF; LILEPGVAQRFVLIFL;
ILEPGVAQRFVLIFLF; LEPGVAQRFVLIFLFA;
EPGVAQRFVLIFLFAQ; PGVAQRFVLIFLFAQI;
GVAQRFVLIFLFAQIP; VAQRFVLIFLFAQIPC;
AQRFVLIFLFAQIPCT; QRFVLIFLFAQIPCTA;
RFVLIFLFAQIPCTAR; FVLIFLFAQIPCTARN;
VLIFLFAQIPCTARNG; LIFLFAQIPCTARNGL;
IFLFAQIPCTARNGLF; FLFAQIPCTARNGLFV;
LFAQIPCTARNGLFVP; FAQIPCTARNGLFVPK;
AQIPCTARNGLFVPKS; QIPCTARNGLFVPKSL;
IPCTARNGLFVPKSLL; PCTARNGLFVPKSLLC;
CTARNGLFVPKSLLCT; TARNGLFVPKSLLCTA;
ARNGLFVPKSLLCTAL; RNGLFVPKSLLCTALA;
NGLFVPKSLLCTALAC; GLFVPKSLLCTALACY;
LFVPKSLLCTALACYV; FVPKSLLCTALACYVS;
VPKSLLCTALACYVSL; PKSLLCTALACYVSLD;
VIIFFIGANLWNRRVG; IIFFIGANLWNRRVGV;
IFFIGANLWNRRVGVL; FFIGANLWNRRVGVLV;
FIGANLWNRRVGVLVE; IGANLWNRRVGVLVEF;
GANLWNRRVGVLVEFL; RSNSRFSTLNTTQKKK;
SNSRFSTLNTTQKKKK; NSRFSTLNTTQKKKKG;
SRFSTLNTTQKKKKGR; RFSTLNTTQKKKKGRR;
FSTLNTTQKKKKGRRP; RSIPYYRRKHSRGLKG;
SIPYYRRKHSRGLKGA; GCVFIIRYVFRISIQC;
CVFIIRYVFRISIQCR; VFIIRYVFRISIQCRG;
FIIRYVFRISIQCRGV; KKSRYPSYDQGRNANR;
KSRYPSYDQGRNANRK; SRYPSYDQGRNANRKI;
RYPSYDQGRNANRKIQ; YPSYDQGRNANRKIQS;
PSYDQGRNANRKIQSY; SYDQGRNANRKIQSYI;
YDQGRNANRKIQSYIR; NGFNIWSSWKCCTRTI;
GFNIWSSWKCCTRTIY; FNIWSSWKCCTRTIYG;
NIWSSWKCCTRTIYGR; IWSSWKCCTRTIYGRC;
WSSWKCCTRTIYGRCC; SSWKCCTRTIYGRCCL;
SWKCCTRTIYGRCCLA; WKCCTRTIYGRCCLAA;
KCCTRTIYGRCCLAAL; CCTRTIYGRCCLAALF;
CTRTIYGRCCLAALFA; TRTIYGRCCLAALFAT;
IKGFAFRTWNKQFRQF; KGFAFRTWNKQFRQFE;
GFAFRTWNKQFRQFER; FAFRTWNKQFRQFERL;
AFRTWNKQFRQFERLF; FRTWNKQFRQFERLFR;
RTWNKQFRQFERLFRW; TWNKQFRQFERLFRWK;
WNKQFRQFERLFRWKC; GKFRKETFKQKNPNIS;
KFRKETFKQKNPNIST; FRKETFKQKNPNISTR;
RKETFKQKNPNISTRL; KETFKQKNPNISTRLG;
ETFKQKNPNISTRLGY; TFKQKNPNISTRLGYN;
FKQKNPNISTRLGYNE; AQNIFKKILTKLRVLT;
KKNFTKWNDLVATANL; KNFTKWNDLVATANLV;
IPITMLFPSLRYFSPC; KHLFKAFWFAIVPVCQ;
HLFKAFWFAIVPVCQY; LFKAFWFAIVPVCQYI;
FKAFWFAIVPVCQYIL; KAFWFAIVPVCQYILS;
AFWFAIVPVCQYILSY; FWFAIVPVCQYILSYL;
WFAIVPVCQYILSYLG; FAIVPVCQYILSYLGP;
AIVPVCQYILSYLGPL; IVPVCQYILSYLGPLE;
VPVCQYILSYLGPLEV; PVCQYILSYLGPLEVF;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

VCQYILSYLGPLEVFL; CQYILSYLGPLEVFLC;
QYILSYLGPLEVFLCH; YILSYLGPLEVFLCHQ;
ILSYLGPLEVFLCHQT; LSYLGPLEVFLCHQTP;
GHLAKRKLGKDSLQIF; HLAKRKLGKDSLQIFF;
LAKRKLGKDSLQIFFS; AKRKLGKDSLQIFFSG;
KRKLGKDSLQIFFSGG; RKLGKDSLQIFFSGGS;
TGHKYQQLKHTGYQLY; GHKYQQLKHTGYQLYK;
HKYQQLKHTGYQLYKE; KYQQLKHTGYQLYKEA;
YQQLKHTGYQLYKEAP; QQLKHTGYQLYKEAPH;
QLKHTGYQLYKEAPHP; LKHTGYQLYKEAPHPV;
KHTGYQLYKEAPHPVH; HTGYQLYKEAPHPVHL;
TGYQLYKEAPHPVHLA; GYQLYKEAPHPVHLAT;
YQLYKEAPHPVHLATL; QLYKEAPHPVHLATLW;
HFHFYWDQVPSTQLDK; FHFYWDQVPSTQLDKH;
HFYWDQVPSTQLDKHC; FYWDQVPSTQLDKHCF;
YWDQVPSTQLDKHCFC; WDQVPSTQLDKHCFCP;
DQVPSTQLDKHCFCPN; QVPSTQLDKHCFCPNR;
VPSTQLDKHCFCPNRP; PSTQLDKHCFCPNRPY;
STQLDKHCFCPNRPYG; TQLDKHCFCPNRPYGQ;
QLDKHCFCPNRPYGQY; LDKHCFCPNRPYGQYS;
DKHCFCPNRPYGQYSL; KHCFCPNRPYGQYSLP;
HCFCPNRPYGQYSLPG; CFCPNRPYGQYSLPGT;
FCPNRPYGQYSLPGTG; CPNRPYGQYSLPGTGL;
PNRPYGQYSLPGTGLL; NRPYGQYSLPGTGLLG;
RPYGQYSLPGTGLLGF; YHQGTLTCNSLALPAF;
HQGTLTCNSLALPAFP; QGTLTCNSLALPAFPR;
GTLTCNSLALPAFPRV; TLTCNSLALPAFPRVL;
LTCNSLALPAFPRVLH; TCNSLALPAFPRVLHL;
CNSLALPAFPRVLHLQ; NSLALPAFPRVLHLQQ;
SLALPAFPRVLHLQQR; LALPAFPRVLHLQQRS;
ALPAFPRVLHLQQRSG; LPAFPRVLHLQQRSGN;
PAFPRVLHLQQRSGNY; AFPRVLHLQQRSGNYC;
FPRVLHQQRSGNYCL; PRVLHQQRSGNYCLE;
VFLHHAHALFVTLHEG; PLFVQLQPPTSVDFHR;
LFVQLQPPTSVDFHRL; FVQLQPPTSVDFHRLG;
VQLQPPTSVDFHRLGP; QLQPPTSVDFHRLGPH;
LQPPTSVDFHRLGPHL; QPPTSVDFHRLGPHLN;
PPTSVDFHRLGPHLNW; PTSVDFHRLGPHLNWG;
TSVDFHRLGPHLNWGG; SVDFHRLGPHLNWGGE;
VDFHRLGPHLNWGGEF; DFHRLGPHLNWGGEFL;
FHRLGPHLNWGGEFLL; HRLGPHLNWGGEFLLC;
RLGPHLNWGGEFLLCC; LGPHLNWGGEFLLCCN;
GPHLNWGGEFLLCCNR; PHLNWGGEFLLCCNRE;
HLNWGGEFLLCCNREA; LNWGGEFLLCCNREAF;
NWGGEFLLCCNREAFF; WGGEFLLCCNREAFFS;
GGEFLLCCNREAFFSL; GEFLLCCNREAFFSLG;
EFLLCCNREAFFSLGY; FLLCCNREAFFSLGYH;
LLCCNREAFFSLGYHC; GFHLDPPFLGLGSILP;
FHLDPPFLGLGSILPL; LLELLLLLLVVLALA;
LELLLLLLLVVLALAR; ELLLLLLLVVLALARV;
LLLLLLLVVLALARVP; LLLLLLVVLALARVPL;
LLLLLVVLALARVPLA; LLLLVVLALARVPLAF;
LLLVVLALARVPLAFW; LLVVLALARVPLAFWE;
LVVLALARVPLAFWEL; VVLALARVPLAFWELP;
VLALARVPLAFWELPL; LALARVPLAFWELPLD;
ALARVPLAFWELPLDT; LARVPLAFWELPLDTL;
ARVPLAFWELPLDTLL; RVPLAFWELPLDTLLF;
VPLAFWELPLDTLLFF; PLAFWELPLDTLLFFW;
LAFWELPLDTLLFFWL; AFWELPLDTLLFFWLG;
FWELPLDTLLFFWLGP; WELPLDTLLFFWLGPS;
ELPLDTLLFFWLGPSS; LPLDTLLFFWLGPSSY;
PLDTLLFFWLGPSSYA; LDTLLFFWLGPSSYAS;
DTLLFFWLGPSSYASR; TLLFFWLGPSSYASRA;
LLFFWLGPSSYASRAG; LFFWLGPSSYASRAGV;
FFWLGPSSYASRAGVT; FWLGPSSYASRAGVTV;
WLGPSSYASRAGVTVP; LGPSSYASRAGVTVPY;
GPSSYASRAGVTVPYR; PSSYASRAGVTVPYRP;
SSYASRAGVTVPYRPR; SYASRAGVTVPYRPRS;
YASRAGVTVPYRPRSK; ASRAGVTVPYRPRSKG;
SRAGVTVPYRPRSKGN; RAGVTVPYRPRSKGNI;
AGVTVPYRPRSKGNIH; LAPPGAIVFSINSPEC;
APPGAIVFSINSPECT; PPGAIVFSINSPECTL;
PGAIVFSINSPECTLC; FLKSILCVTSSILSAS;
LKSILCVTSSILSASS; KSILCVTSSILSASSI;
SILCVTSSILSASSIL; VWPKCTRVPSLSATCL;
WPKCTRVPSLSATCLT; PKCTRVPSLSATCLTI;
KCTRVPSLSATCLTIE; CTRVPSLSATCLTIEG;
TRVPSLSATCLTIEGL; RVPSLSATCLTIEGLI;
VPSLSATCLTIEGLIG; PSLSATCLTIEGLIGE;
SLSATCLTIEGLIGER; LSATCLTIEGLIGERS;
SATCLTIEGLIGERSE; KFIGAFTIVQVVSSKN;
FIGAFTIVQVVSSKNL; IGAFTIVQVVSSKNLA;
GAFTIVQVVSSKNLAK; AFTIVQVVSSKNLAKE;
FTIVQVVSSKNLAKES; TIVQVVSSKNLAKESL;
IVQVVSSKNLAKESLK; VQVVSSKNLAKESLKN;
QVVSSKNLAKESLKNL; VVSSKNLAKESLKNLS;
VSSKNLAKESLKNLSV; SSKNLAKESLKNLSVL;
SKNLAKESLKNLSVLL; KNLAKESLKNLSVLLC;
NLAKESLKNLSVLLCN; LAKESLKNLSVLLCNS;
AKESLKNLSVLLCNSC; KESLKNLSVLLCNSCE;
ESLKNLSVLLCNSCEV; SLKNLSVLLCNSCEVI;
LKNLSVLLCNSCEVIE; KNLSVLLCNSCEVIEG;
NLSVLLCNSCEVIEGI; LSVLLCNSCEVIEGIS;
SVLLCNSCEVIEGISS; VLLCNSCEVIEGISSL;
LLCNSCEVIEGISSLI; LCNSCEVIEGISSLIT;
CNSCEVIEGISSLITC; NSCEVIEGISSLITCH;
SCEVIEGISSLITCHK; CEVIEGISSLITCHKA;
EVIEGISSLITCHKAW; VIEGISSLITCHKAWE;
IEGISSLITCHKAWEI; EGISSLITCHKAWEIV;
GISSLITCHKAWEIVA; ISSLITCHKAWEIVAN;
SSLITCHKAWEIVANK; SLITCHKAWEIVANKE;
LITCHKAWEIVANKEG; ITCHKAWEIVANKEGP;
TCHKAWEIVANKEGPQ; CHKAWEIVANKEGPQC;
HKAWEIVANKEGPQCL; KAWEIVANKEGPQCLG;
AWEIVANKEGPQCLGS; WEIVANKEGPQCLGSR;
EIVANKEGPQCLGSRY; IKAANPAIAPGAPAIT;
KAANPAIAPGAPAITA; AANPAIAPGAPAITAY;
ANPAIAPGAPAITAYV; GVRPIAAIASEVLVMP;
VRPIAAIASEVLVMPS; RPIAAIASEVLVMPST;
PIAAIASEVLVMPSTV; IAAIASEVLVMPSTVA;
AAIASEVLVMPSTVAR; AIASEVLVMPSTVARD;
IASEVLVMPSTVARDA; ASEVLVMPSTVARDAI;
TSIAAAASPAAISATE; SIAAAASPAAISATEN;
IAAAASPAAISATENP; AAAASPAAISATENPV;
AAASPAAISATENPVA; AASPAAISATENPVAA;
ASPAAISATENPVAAA; SPAAISATENPVAAAA;
PAAISATENPVAAAAS; AAISATENPVAAAASD;
AISATENPVAAAASDT; ISATENPVAAAASDTL;
SATENPVAAAASDTLA; ATENPVAAAASDTLAT;
TENPVAAAASDTLATR; ENPVAAAASDTLATRS;
NPVAAAASDTLATRSP; PVAAAASDTLATRSPK;
VAAAASDTLATRSPKS; AAAASDTLATRSPKSA;
AAASDTLATRSPKSAR; AASDTLATRSPKSARA;
ASDTLATRSPKSARAA; SDTLATRSPKSARAAP;
DTLATRSPKSARAAPM; TLATRSPKSARAAPMN;
LATRSPKSARAAPMNL; ATRSPKSARAAPMNLE;
TRSPKSARAAPMNLEI; RSPKSARAAPMNLEIQ;
SPKSARAAPMNLEIQK; PKSARAAPMNLEIQKK;
KSARAAPMNLEIQKKR; SARAAPMNLEIQKKRD;
ARAAPMNLEIQKKRDY; RAAPMNLEIQKKRDYL;
AAPMNLEIQKKRDYLP; APMNLEIQKKRDYLPR;
PMNLEIQKKRDYLPRS; MNLEIQKKRDYLPRSL;
NLEIQKKRDYLPRSLL; LEIQKKRDYLPRSLLQ;
EIQKKRDYLPRSLLQS; IQKKRDYLPRSLLQSL;
QKKRDYLPRSLLQSLL; KKRDYLPRSLLQSLLQ;
KRDYLPRSLLQSLLQQ; RDYLPRSLLQSLLQQV;
DYLPRSLLQSLLQQVK; YLPRSLLQSLLQQVKQ;
LPRSLLQSLLQQVKQW; PRSLLQSLLQQVKQWY;
RSLLQSLLQQVKQWYF; SLLQSLLQQVKQWYFC;
LLQSLLQQVKQWYFCF; LQSLLQQVKQWYFCFS;
QSLLQQVKQWYFCFSR; SLLQQVKQWYFCFSRL;
LLQQVKQWYFCFSRLH; LQQVKQWYFCFSRLHC;
QQVKQWYFCFSRLHCL; QVKQWYFCFSRLHCLH;
VKQWYFCFSRLHCLHL; KQWYFCFSRLHCLHLY;
QWYFCFSRLHCLHLYK; WYFCFSRLHCLHLYKI;
YFCFSRLHCLHLYKIP; FCFSRLHCLHLYKIPA;
CFSRLHCLHLYKIPAK; FSRLHCLHLYKIPAKA;
SRLHCLHLYKIPAKAL; RLHCLHLYKIPAKALK;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

KSSELFFLFQSRFYQL; SSELFFLFQSRFYQLS;
SELFFLFQSRFYQLSL; ELFFLFQSRFYQLSLK;
LFFLFQSRFYQLSLKL; FFLFQSRFYQLSLKLV;
FLFQSRFYQLSLKLVV; LFQSRFYQLSLKLVVT;
FQSRFYQLSLKLVVTA; QSRFYQLSLKLVVTAG;
SRFYQLSLKLVVTAGA; RFYQLSLKLVVTAGAE;
FYQLSLKLVVTAGAEP; YQLSLKLVVTAGAEPW;
QLSLKLVVTAGAEPWP; LSLKLVVTAGAEPWPL;
SLKLVVTAGAEPWPLS; LKLVVTAGAEPWPLSS;
KLVVTAGAEPWPLSSL; LVVTAGAEPWPLSSLT;
VVTAGAEPWPLSSLTG; VTAGAEPWPLSSLTGD;
TAGAEPWPLSSLTGDK; AGAEPWPLSSLTGDKA;
GAEPWPLSSLTGDKAK; AEPWPLSSLTGDKAKI;
EPWPLSSLTGDKAKIP; PWPLSSLTGDKAKIPR;
WPLSSLTGDKAKIPRL; PLSSLTGDKAKIPRLA;
LSSLTGDKAKIPRLAK; SSLTGDKAKIPRLAKH;
SLTGDKAKIPRLAKHV; LTGDKAKIPRLAKHVC;
TGDKAKIPRLAKHVCH; GDKAKIPRLAKHVCHA;
DKAKIPRLAKHVCHAL; KAKIPRLAKHVCHALS;
AKIPRLAKHVCHALSF; KIPRLAKHVCHALSFL;
IPRLAKHVCHALSFLR; PRLAKHVCHALSFLRS;
RLAKHVCHALSFLRSW; LAKHVCHALSFLRSWF;
AKHVCHALSFLRSWFG; KHVCHALSFLRSWFGC;
HVCHALSFLRSWFGCI; VCHALSFLRSWFGCIP;
CHALSFLRSWFGCIPW; HALSFLRSWFGCIPWV;
ALSFLRSWFGCIPWVS; LSFLRSWFGCIPWVSS;
SFLRSWFGCIPWVSSS; FLRSWFGCIPWVSSSL;
LRSWFGCIPWVSSSSL; GHGLAAFPCESCTFLP;
HGLAAFPCESCTFLPE; GLAAFPCESCTFLPEV;
LAAFPCESCTFLPEVM; AAFPCESCTFLPEVMV;
APFCESCTFLPEVMVW; FPCESCTFLPEVMVWL;
PCESCTFLPEVMVWLH; CESCTFLPEVMVWLHS;
ESCTFLPEVMVWLHSM; SCTFLPEVMVWLHSMG;
CTFLPEVMVWLHSMGK; TFLPEVMVWLHSMGKQ;
FLPEVMVWLHSMGKQL; LPEVMVWLHSMGKQLL;
PEVMVWLHSMGKQLLP; EVMVWLHSMGKQLLPV;
VMVWLHSMGKQLLPVA; MVWLHSMGKQLLPVAF;
VWLHSMGKQLLPVAFF; WLHSMGKQLLPVAFFF;
LHSMGKQLLPVAFFFI; HSMGKQLLPVAFFFII;
SMGKQLLPVAFFFIIY; MGKQLLPVAFFFIIYK;
GKQLLPVAFFFIIYKR; KQLLPVAFFFIIYKRP;
QLLPVAFFFIIYKRPR; LLPVAFFFIIYKRPRP;
LPVAFFFIIYKRPRPP; PVAFFFIIYKRPRPPL;
VAFFFIIYKRPRPPLP; AFFFIIYKRPRPPLPP;
FFFIIYKRPRPPLPPP; FFIIYKRPRPPLPPPF;
FIIYKRPRPPLPPPFL; IIYKRPRPPLPPPFLS;
IYKRPRPPLPPPFLSS; YKRPRPPLPPPFLSSS;
KRPRPPLPPPFLSSSK; RPRPPLPPPFLSSSKG;
PRPPLPPPFLSSSKGV; RPPLPPPFLSSSKGVE;
PPLPPPFLSSSKGVEA; PLPPPFLSSSKGVEAF;
LPPPFLSSSKGVEAFS; PPPFLSSSKGVEAFSE;
PPFLSSSKGVEAFSEA

BK virus, reverse reading frame 3

13 mers:

QGRIHGAHGPFRP; KSCLGKSSLNEKS; SCLGKSSLNEKSL;
CLGKSSLNEKSLF; LGKSSLNEKSLFK; GKSSLNEKSLFKE;
KSSLNEKSLFKEV; FSSLPRYPVLQGMA; SSLPRYPVLQGMAY;
SLPRYPVLQGMAY; LPRYPVLQGMAYL; PRYPVLQGMAYLF;
RYPVLQGMAYLFQ; YPVLQGMAYLFQK; PVLQGMAYLFQKA;
VLQGMAYLFQKAF; LQGMAYLFQKAFC; QGMAYLFQKAFCA;
GMAYLFQKAFCAL; MAYLFQKAFCALP; AYLFQKAFCALPL;
YLFQKAFCALPLH; LFQKAFCALPLHA; FQKAFCALPLHAM;
QKAFCALPLHAMS; KAFCALPLHAMSA; KIFKKRALGLDRL;
IFKKRALGLDRLL; FKKRALGLDRLLL; KKRALGLDRLLLH;
RNSAMVGPNNWRN; NSAMVGPNNWRNS; SAMVGPNNWRNSL;
AMVGPNNWRNSLQ; MVGPNNWRNSLQR; VGPNNWRNSLQRS;
GPNNWRNSLQRSK; PNNWRNSLQRSKA; NNWRNSLQRSKAL;
NWRNSLQRSKALR; VPTYGTEEWESWW; PTYGTEEWESWWS;
TYGTEEWESWWSS; YGTEEWESWWSSF; GTEEWESWWSSFN;
TEEWESWWSSFNE; EEWESWWSSFNEK; EWESWWSSFNEKW;
WESWWSSFNEKWD; ESWWSSFNEKWDE; SWWSSFNEKWDED;
WWSSFNEKWDEDL; WSSFNEKWDEDLF; SSFNEKWDEDLFC;
SFNEKWDEDLFCH; FNEKWDEDLFCHE; NEKWDEDLFCHED;
EKWDEDLFCHEDM; KWDEDLFCHEDMF; WDEDLFCHEDMFA;
DEDLFCHEDMFAS; EDLFCHEDMFASD; DLFCHEDMFASDE;
LFCHEDMFASDEE; FCHEDMFASDEEA; CHEDMFASDEEAT;
HEDMFASDEEATA; EDMFASDEEATAD; DMFASDEEATADS;
MFASDEEATADSQ; FASDEEATADSQH; ASDEEATADSQHS;
SDEEATADSQHST; DEEATADSQHSTP; EEATADSQHSTPP;
EATADSQHSTPPK; ATADSQHSTPPKK; TADSQHSTPPKKK;
ADSQHSTPPKKKR; DSQHSTPPKKKRK; SQHSTPPKKKRKV;
QHSTPPKKKRKVE; HSTPPKKKRKVED; STPPKKKRKVEDP;
TPPKKKRKVEDPK; PPKKKRKVEDPKD; PKKKRKVEDPKDF;
KKKRKVEDPKDFP; KKRKVEDPKDFPS; KRKVEDPKDFPSD;
RKVEDPKDFPSDL; KVEDPKDFPSDLH; VEDPKDFPSDLHQ;
EDPKDFPSDLHQF; DPKDFPSDLHQFL; PKDFPSDLHQFLS;
KDFPSDLHQFLSQ; DFPSDLHQFLSQA; FPSDLHQFLSQAV;
PSDLHQFLSQAVF; SDLHQFLSQAVFS; DLHQFLSQAVFSN;
LHQFLSQAVFSNR; HQFLSQAVFSNRT; QFLSQAVFSNRTL;
FLSQAVFSNRTLA; LSQAVFSNRTLAC; SQAVFSNRTLACF;
QAVFSNRTLACFA; AVFSNRTLACFAV; VFSNRTLACFAVY;
FSNRTLACFAVYT; SNRTLACFAVYTT; NRTLACFAVYTTK;
RTLACFAVYTTKE; TLACFAVYTTKEK; LACFAVYTTKEKA;
ACFAVYTTKEKAQ; CFAVYTTKEKAQI; FAVYTTKEKAQIL;
AVYTTKEKAQILY; VYTTKEKAQILYK; YTTKEKAQILYKK;
TTKEKAQILYKKL; TKEKAQILYKKLM; KEKAQILYKKLME;
EKAQILYKKLMEY; KAQILYKKLMEYS; AQILYKKLMEYSV;
QILYKKLMEYSVT; ILYKKLMEYSVTF;
YKKLMEYSVTFI; KKLMEYSVTFIS; KLMEYSVTFISR;
LMEKYSVTFISRH; MEKYSVTFISRHM; EKYSVTFISRHMC;
KYSVTFISRHMCA; YSVTFISRHMCAG; SVTFISRHMCAGH;
VTFISRHMCAGHN; TFISRHMCAGHNI; FISRHMCAGHNII;
ISRHMCAGHNIIF; SRHMCAGHNIIFF; RHMCAGHNIIFFL;
HMCAGHNIIFFLT; MCAGHNIIFFLTP; CAGHNIIFFLTPH;
AGHNIIFFLTPHR; GHNIIFFLTPHRH; HNIIFFLTPHRHR;
NIIFFLTPHRHRV; IIFFLTPHRHRVS; IFFLTPHRHRVSA;
FFLTPHRHRVSAI; FLTPHRHRVSAIN; LTPHRHRVSAINN;
TPHRHRVSAINNF; PHRHRVSAINNFC; HRHRVSAINNFCQ;
RHRVSAINNFCQK; HRVSAINNFCQKL; RVSAINNFCQKLC;
VSAINNFCQKLCT; SAINNFCQKLCTF; AINNFCQKLCTFS;
INNFCQKLCTFSF; NNFCQKLCTFSFL; NFCQKLCTFSFLI;
FCQKLCTFSFLIC; CQKLCTFSFLICK; QKLCTFSFLICKG;
KLCTFSFLICKGV; LCTFSFLICKGVN; CTFSFLICKGVNK;
TFSFLICKGVNKE; FSFLICKGVNKEY; SFLICKGVNKEYL;
FLICKGVNKEYLL; LICKGVNKEYLLY; ICKGVNKEYLLYS;
CKGVNKEYLLYSA; KGVNKEYLLYSAL; GVNKEYLLYSALT;
VNKEYLLYSALTR; NKEYLLYSALTRD; KEYLLYSALTRDP;
EYLLYSALTRDPY; YLLYSALTRDPYH; LLYSALTRDPYHT;
LYSALTRDPYHTI; YSALTRDPYHTIE; SALTRDPYHTIEE;
ALTRDPYHTIEES; LTRDPYHTIEESI; TRDPYHTIEESIQ;
RDPYHTIEESIQG; DPYHTIEESIQGG; PYHTIEESIQGGL;
YHTIEESIQGGLK; HTIEESIQGGLKE; TIEESIQGGLKEH;
IEESIQGGLKEHD; EESIQGGLKEHDF; ESIQGGLKEHDFS;
SIQGGLKEHDFSP; IQGGLKEHDFSPE; QGGLKEHDFSPEE;
GGLKEHDFSPEEP; GLKEHDFSPEEPE; LKEHDFSPEEPEE;
KEHDFSPEEPEET; EHDFSPEEPEETK; HDFSPEEPEETKQ;
DFSPEEPEETKQV; FSPEEPEETKQVS; SPEEPEETKQVSW;
PEEPEETKQVSWK; EEPEETKQVSWKL; EPEETKQVSWKLI;
PEETKQVSWKLIT; EETKQVSWKLITE; ETKQVSWKLITEY;
TKQVSWKLITEYA; KQVSWKLITEYAV; QVSWKLITEYAVE;
VSWKLITEYAVET; SWKLITEYAVETK; WKLITEYAVETKC;
KLITEYAVETKCE; LITEYAVETKCED; ITEYAVETKCEDV;
TEYAVETKCEDVF; EYAVETKCEDVFL; YAVETKCEDVFLL;
AVETKCEDVFLLL; VETKCEDVFLLLG; ETKCEDVFLLLGM;
TKCEDVFLLLGMY; KCEDVFLLLGMYL; CEDVFLLLGMYLE;
EDVFLLLGMYLEF; DVFLLLGMYLEFQ; VFLLLGMYLEFQY;
FLLLGMYLEFQYN; LLLGMYLEFQYNV; LLGMYLEFQYNVE;
LGMYLEFQYNVEE; GMYLEFQYNVEEC; MYLEFQYNVEECK;
YLEFQYNVEECKK; LEFQYNVEECKKC; EFQYNVEECKKCQ;
FQYNVEECKKCQK; QYNVEECKKCQKK; YNVEECKKCQKKD;
NVEECKKCQKKDQ; VEECKKCQKKDQP; EECKKCQKKDQPY;
ECKKCQKKDQPYH; CKKCQKKDQPYHF; KKCQKKDQPYHFK;
KCQKKDQPYHFKY; CQKKDQPYHFKYH; QKKDQPYHFKYHE;
KKDQPYHFKYHEK; KDQPYHFKYHEKH; DQPYHFKYHEKHF;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

QPYHFKYHEKHFA; PYHFKYHEKHFAN; YHFKYHEKHFANA;
HFKYHEKHFANAI; FKYHEKHFANAII; KYHEKHFANAIIF;
YHEKHFANAIIFA; HEKHFANAIIFAE; EKHFANAIIFAES;
KHFANAIIFAESK; HFANAIIFAESKN; FANAIIFAESKNQ;
ANAIIFAESKNQK; NAIIFAESKNQKS; AIIFAESKNQKSI;
IIFAESKNQKSIC; IFAESKNQKSICQ; FAESKNQKSICQQ;
AESKNQKSICQQA; ESKNQKSICQQAV; SKNQKSICQQAVD;
KNQKSICQQAVDT; NQKSICQQAVDTV; QKSICQQAVDTVL;
KSICQQAVDTVLA; SICQQAVDTVLAK; ICQQAVDTVLAKK;
CQQAVDTVLAKKR; QQAVDTVLAKKRV; QAVDTVLAKKRVD;
AVDTVLAKKRVDT; VDTVLAKKRVDTL; DTVLAKKRVDTLH;
TVLAKKRVDTLHM; VLAKKRVDTLHMT; LAKKRVDTLHMTR;
AKKRVDTLHMTRE; KKRVDTLHMTREE; KRVDTLHMTREEM;
RVDTLHMTREEML; VDTLHMTREEMLT; DTLHMTREEMLTE;
TLHMTREEMLTER; LHMTREEMLTERF; HMTREEMLTERFN;
MTREEMLTERFNH; TREEMLTERFNHI; REEMLTERFNHIL;
EEMLTERFNHILD; EMLTERFNHILDK; MLTERFNHILDKM;
LTERFNHILDKMD; TERFNHILDKMDL; ERFNHILDKMDLI;
RFNHILDKMDLIF; FNHILDKMDLIFG; NHILDKMDLIFGA;
HILDKMDLIFGAH; ILDKMDLIFGAHG; LDKMDLIFGAHGN;
DKMDLIFGAHGNA; KMDLIFGAHGNAV; MDLIFGAHGNAVL;
DLIFGAHGNAVLE; LIFGAHGNAVLEQ; IFGAHGNAVLEQY;
FGAHGNAVLEQYM; GAHGNAVLEQYMA; AHGNAVLEQYMAG;
HGNAVLEQYMAGV; GNAVLEQYMAGVA; NAVLEQYMAGVAW;
AVLEQYMAGVAWL; VLEQYMAGVAWLH; LEQYMAGVAWLHC;
EQYMAGVAWLHCL; QYMAGVAWLHCLL; YMAGVAWLHCLLP;
MAGVAWLHCLLPK; AGVAWLHCLLPKM; GVAWLHCLLPKMD;
VAWLHCLLPKMDS; AWLHCLLPKMDSV; WLHCLLPKMDSVI;
LHCLLPKMDSVIF; HCLLPKMDSVIFD; CLLPKMDSVIFDF;
LLPKMDSVIFDFL; LPKMDSVIFDFLH; PKMDSVIFDFLHC;
KMDSVIFDFLHCI; MDSVIFDFLHCIV; DSVIFDFLHCIVF;
SVIFDFLHCIVFN; VIFDFLHCIVFNV; IFDFLHCIVFNVP;
FDFLHCIVFNVPK; DFLHCIVFNVPKR; FLHCIVFNVPKRR;
LHCIVFNVPKRRY; HCIVFNVPKRRYW; CIVFNVPKRRYWL;
IVFNVPKRRYWLF; VFNVPKRRYWLFK; FNVPKRRYWLFKG;
NVPKRRYWLFKGP; VPKRRYWLFKGPI; PKRRYWLFKGPID;
KRRYWLFKGPIDS; RRYWLFKGPIDSG; RYWLFKGPIDSGK;
YWLFKGPIDSGKT; WLFKGPIDSGKTT; LFKGPIDSGKTTL;
FKGPIDSGKTTLA; KGPIDSGKTTLAA; GPIDSGKTTLAAG;
PIDSGKTTLAAGL; IDSGKTTLAAGLL; DSGKTTLAAGLLD;
SGKTTLAAGLLDL; GKTTLAAGLLDLC; KTTLAAGLLDLCG;
TTLAAGLLDLCGG; TLAAGLLDLCGGK; LAAGLLDLCGGKA;
AAGLLDLCGGKAL; AGLLDLCGGKALN; GLLDLCGGKALNV;
LLDLCGGKALNVN; LDLCGGKALNVNL; DLCGGKALNVNLP;
LCGGKALNVNLPM; CGGKALNVNLPME; GGKALNVNLPMER;
GKALNVNLPMERL; KALNVNLPMERLT; ALNVNLPMERLTF;
LNVNLPMERLTFE; NVNLPMERLTFEL; VNLPMERLTFELG;
NLPMERLTFELGV; LPMERLTFELGVA; PMERLTFELGVAI;
MERLTFELGVAID; ERLTFELGVAIDQ; RLTFELGVAIDQY;
LTFELGVAIDQYM; TFELGVAIDQYMV; FELGVAIDQYMVV;
ELGVAIDQYMVVF; LGVAIDQYMVVFE; GVAIDQYMVVFED;
VAIDQYMVVFEDV; AIDQYMVVFEDVK; IDQYMVVFEDVKG;
DQYMVVFEDVKGT; QYMVVFEDVKGTG; YMVVFEDVKGTGA;
MVVFEDVKGTGAE; VVFEDVKGTGAES; VFEDVKGTGAESK;
FEDVKGTGAESKD; EDVKGTGAESKDL; DVKGTGAESKDLP;
VKGTGAESKDLPS; KGTGAESKDLPSG; GTGAESKDLPSGH;
TGAESKDLPSGHG; GAESKDLPSGHGI; AESKDLPSGHGIN;
ESKDLPSGHGINN; SKDLPSGHGINNL; KDLPSGHGINNLD;
DLPSGHGINNLDS; LPSGHGINNLDSL; PSGHGINNLDSLR;
SGHGINNLDSLRD; GHGINNLDSLRDY; HGINNLDSLRDYL;
GINNLDSLRDYLD; INNLDSLRDYLDG; NNLDSLRDYLDGS;
NLDSLRDYLDGSV; LDSLRDYLDGSVK; DSLRDYLDGSVKV;
SLRDYLDGSVKVN; LRDYLDGSVKVNL; RDYLDGSVKVNLE;
DYLDGSVKVNLEK; YLDGSVKVNLEKK; LDGSVKVNLEKKH;
DGSVKVNLEKKHL; GSVKVNLEKKHLN; SVKVNLEKKHLNK;
VKVNLEKKHLNKR; KVNLEKKHLNKRT; VNLEKKHLNKRTQ;
NLEKKHLNKRTQI; LEKKHLNKRTQIF; EKKHLNKRTQIFP;
KKHLNKRTQIFPP; KHLNKRTQIFPPG; HLNKRTQIFPPGL;
LNKRTQIFPPGLV; NKRTQIFPPGLVT; KRTQIFPPGLVTM;
RTQIFPPGLVTMN; TQIFPPGLVTMNE; QIFPPGLVTMNEY;
IFPPGLVTMNEYP; FPPGLVTMNEYPV; PPGLVTMNEYPVP;
PGLVTMNEYPVPK; GLVTMNEYPVPKT; LVTMNEYPVPKTL;
VTMNEYPVPKTLQ; TMNEYPVPKTLQA; MNEYPVPKTLQAR;
NEYPVPKTLQARF; EYPVPKTLQARFV; YPVPKTLQARFVR;

PVPKTLQARFVRQ; VPKTLQARFVRQI; PKTLQARFVRQID;
KTLQARFVRQIDF; TLQARFVRQIDFR; LQARFVRQIDFRP;
QARFVRQIDFRPK; ARFVRQIDFRPKI; RFVRQIDFRPKIY;
FVRQIDFRPKIYL; VRQIDFRPKIYLR; RQIDFRPKIYLRK;
QIDFRPKIYLRKS; IDFRPKIYLRKSL; DFRPKIYLRKSLQ;
FRPKIYLRKSLQN; RPKIYLRKSLQNS; PKIYLRKSLQNSE;
KIYLRKSLQNSEF; IYLRKSLQNSEFL; YLRKSLQNSEFLL;
LRKSLQNSEFLLE; RKSLQNSEFLLEK; KSLQNSEFLLEKR;
SLQNSEFLLEKRI; LQNSEFLLEKRIL; QNSEFLLEKRILQ;
NSEFLLEKRILQS; SEFLLEKRILQSG; EFLLEKRILQSGM;
FLLEKRILQSGMT; LLEKRILQSGMTL; LEKRILQSGMTLL;
EKRILQSGMTLLL; KRILQSGMTLLLL; RILQSGMTLLLLL;
ILQSGMTLLLLLI; LQSGMTLLLLLIW; QSGMTLLLLLIWF;
SGMTLLLLLIWFR; GMTLLLLLIWFRP; MTLLLLLIWFRPV;
TLLLLLIWFRPVA; LLLLLIWFRPVAD; LLLLIWFRPVADF;
LLLIWFRPVADFA; LLIWFRPVADFAT; LIWFRPVADFATD;
IWFRPVADFATDI; WFRPVADFATDIQ; FRPVADFATDIQS;
RPVADFATDIQSR; PVADFATDIQSRI; VADFATDIQSRIV;
ADFATDIQSRIVE; DFATDIQSRIVEW; FATDIQSRIVEWK;
ATDIQSRIVEWKE; TDIQSRIVEWKER; DIQSRIVEWKERL;
IQSRIVEWKERLD; QSRIVEWKERLDS; SRIVEWKERLDSE;
RIVEWKERLDSEI; IVEWKERLDSEIS; VEWKERLDSEISM;
EWKERLDSEISMY; WKERLDSEISMYT; KERLDSEISMYTF;
ERLDSEISMYTFS; RLDSEISMYTFSR; LDSEISMYTFSRM;
DSEISMYTFSRMK; SEISMYTFSRMKY; EISMYTFSRMKYN;
ISMYTFSRMKYNI; SMYTFSRMKYNIC; MYTFSRMKYNICM;
YTFSRMKYNICMG; TFSRMKYNICMGK; FSRMKYNICMGKC;
SRMKYNICMGKCI; RMKYNICMGKCIL; MKYNICMGKCILD;
KYNICMGKCILDI; YNICMGKCILDIT; NICMGKCILDITR;
ICMGKCILDITRE; CMGKCILDITREE; MGKCILDITREED;
GKCILDITREEDS; KCILDITREEDSE; CILDITREEDSET;
ILDITREEDSETE; LDITREEDSETED; DITREEDSETEDS;
ITREEDSETEDSG; TREEDSETEDSGH; REEDSETEDSGHG;
EEDSETEDSGHGS; EDSETEDSGHGSS; DSETEDSGHGSST;
SETEDSGHGSSTE; ETEDSGHGSSTES; TEDSGHGSSTESQ;
EDSGHGSSTESQS; DSGHGSSTESQSQ; SGHGSSTESQSQC;
GHGSSTESQSQCS; HGSSTESQSQCSS; GSSTESQSQCSSQ;
SSTESQSQCSSQV; STESQSQCSSQVS; TESQSQCSSQVSD;
ESQSQCSSQVSDT; SQSQCSSQVSDTS; QSQCSSQVSDTSA;
SQCSSQVSDTSAP; QCSSQVSDTSAPA; CSSQVSDTSAPAE;
SSQVSDTSAPAED; SQVSDTSAPAEDS; QVSDTSAPAEDSQ;
VSDTSAPAEDSQR; SDTSAPAEDSQRS; DTSAPAEDSQRSD;
TSAPAEDSQRSDP; SAPAEDSQRSDPH; APAEDSQRSDPHS;
PAEDSQRSDPHSQ; AEDSQRSDPHSQE; EDSQRSDPHSQEL;
DSQRSDPHSQELH; SQRSDPHSQELHL; QRSDPHSQELHLC;
RSDPHSQELHLCK; SDPHSQELHLCKG; DPHSQELHLCKGF;
PHSQELHLCKGFQ; HSQELHLCKGFQC; SQELHLCKGFQCF;
QELHLCKGFQCFK; ELHLCKGFQCFKR; LHLCKGFQCFKRP;
HLCKGFQCFKRPK; LCKGFQCFKRPKT; CKGFQCFKRPKTP;
KGFQCFKRPKTPP; GFQCFKRPKTPPP; FQCFKRPKTPPPK;
HKLKSGLYKSSIY; MYMYNKSTCLKHF; YMYNKSTCLKHFG;
MYNKSTCLKHFGL; YNKSTCLKHFGLQ; NKSTCLKHFGLQL;
KSTCLKHFGLQLS; STCLKHFGLQLSL; TCLKHFGLQLSLF;
CLKHFGLQLSLFV; LKHFGLQLSLFVN; KHFGLQLSLFVNI;
HFGLQLSLFVNIS; FGLQLSLFVNISY; GLQLSLFVNISYH;
LQLSLFVNISYHI; QLSLFVNISYHIW; LSLFVNISYHIWV;
SLFVNISYHIWVP; LFVNISYHIWVPW; FVNISYHIWVPWK;
VNISYHIWVPWKS; NISYHIWVPWKSF; ISYHIWVPWKSFC;
SYHIWVPWKSFCA; YHIWVPWKSFCAI; HIWVPWKSFCAIK;
IWVPWKSFCAIKH; WVPWKSFCAIKHP; VPWKSFCAIKHPN;
PWKSFCAIKHPNL; WKSFCAIKHPNLF; KSFCAIKHPNLFY;
SFCAIKHPNLFYL; FCAIKHPNLFYLG; CAIKHPNLFYLGF;
AIKHPNLFYLGFH; IKHPNLFYLGFHT; KHPNLFYLGFHTI;
HPNLFYLGFHTIH; PNLFYLGFHTIHR; NLFYLGFHTIHRL;
LFYLGFHTIHRLP; FYLGFHTIHRLPI; YLGFHTIHRLPIH;
LGFHTIHRLPIHS; GFHTIHRLPIHSL; FHTIHRLPIHSLG;
HTIHRLPIHSLGS; TIHRLPIHSLGSP; IHRLPIHSLGSPV;
HRLPIHSLGSPVY; RLPIHSLGSPVYK; LPIHSLGSPVYKV;
PIHSLGSPVYKVT; QKGNWVRILYRSF; KGNWVRILYRSFS;
GNWVRILYRSFSQ; NWVRILYRSFSQA; WVRILYRSFSQAD;
VRILYRSFSQADL; RILYRSFSQADLK; ILYRSFSQADLKI;
LYRSFSQADLKIS; YRSFSQADLKISC; RSFSQADLKISCK;
SFSQADLKISCKA; FSQADLKISCKAS; SQADLKISCKASP;
QADLKISCKASPL; ADLKISCKASPLL; DLKISCKASPLLC;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

LKISCKASPLLCS; KISCKASPLLCSR; ISCKASPLLCSRA;
SCKASPLLCSRAV; CKASPLLCSRAVS; KASPLLCSRAVSK;
ASPLLCSRAVSKQ; SPLLCSRAVSKQA; PLLCSRAVSKQAT;
LLCSRAVSKQATN; LCSRAVSKQATNI; CSRAVSKQATNIS;
SRAVSKQATNISS; NIQAISFTKRPHT; IQAISFTKRPHTL;
QAISFTKRPHTLF; AISFTKRPHTLFI; QHCGSCVGHMKYW;
HCGSCVGHMKYWG; CGSCVGHMKYWGN; GSCVGHMKYWGNI;
SCVGHMKYWGNIF; CVGHMKYWGNIFP; VGHMKYWGNIFPS;
GHMKYWGNIFPSC; HMKYWGNIFPSCE; MKYWGNIFPSCES;
KYWGNIFPSCESP; YWGNIFPSCESPK; WGNIFPSCESPKI;
GNIFPSCESPKIP; NIFPSCESPKIPS; IFPSCESPKIPSI;
FPSCESPKIPSIF; PSCESPKIPSIFI; SCESPKIPSIFIS;
CESPKIPSIFIST; ESPKIPSIFISTG; SPKIPSIFISTGI;
PKIPSIFISTGIR; KIPSIFISTGIRY; IPSIFISTGIRYP;
PSIFISTGIRYPA; SIFISTGIRYPAL; IFISTGIRYPALN;
FISTGIRYPALNW; ISTGIRYPALNWI; STGIRYPALNWIS;
TGIRYPALNWISI; GIRYPALNWISIV; IRYPALNWISIVF;
RYPALNWISIVFV; YPALNWISIVFVQ; PALNWISIVFVQI;
ALNWISIVFVQIG; LNWISIVFVQIGL; NWISIVFVQIGLM;
WISIVFVQIGLMV; ISIVFVQIGLMVS; SIVFVQIGLMVSI;
IVFVQIGLMVSIH; VFVQIGLMVSIHY; FVQIGLMVSIHYL;
VQIGLMVSIHYLG; QIGLMVSIHYLGL; IGLMVSIHYLGLG;
GLMVSIHYLGLGC; LMVSIHYLGLGCW; MVSIHYLGLGCWV;
VSIHYLGLGCWVF; SIHYLGLGCWVFR; IHYLGLGCWVFRG;
HYLGLGCWVFRGY; YLGLGCWVFRGYS; LGLGCWVFRGYST;
GLGCWVFRGYSTI; LGCWVFRGYSTIR; GCWVFRGYSTIRV;
CWVFRGYSTIRVL; HSLHFQGFSTYSK; SLHFQGFSTYSKE;
LHFQGFSTYSKEV; HFQGFSTYSKEVE; FQGFSTYSKEVEI;
QGFSTYSKEVEIT; GFSTYSKEVEITA; FSTYSKEVEITAL;
STYSKEVEITALN; TYSKEVEITALNR; YSKEVEITALNRF;
SKEVEITALNRFS; KEVEITALNRFSS; EVEITALNRFSST;
VEITALNRFSSTM; EITALNRFSSTML; ITALNRFSSTMLM;
TALNRFSSTMLMH; ALNRFSSTMLMHF; LNRFSSTMLMHFL;
PCMKVKHASYSNN; CMKVKHASYSNNL; MKVKHASYSNNLC;
KVKHASYSNNLCL; VKHASYSNNLCLY; KHASYSNNLCLYS;
HASYSNNLCLYSY; ASYSNNLCLYSYS; SYSNNLCLYSYSL;
YSNNLCLYSYSLP; SNNLCLYSYSLPH; NNLCLYSYSLPHQ;
IGEGNSCCAVTGK; GEGNSCCAVTGKH; EGNSCCAVTGKHF;
GNSCCAVTGKHFS; NSCCAVTGKHFSL; SCCAVTGKHFSLW;
CCAVTGKHFSLWA; CAVTGKHFSLWAI; AVTGKHFSLWAIT;
VTGKHFSLWAITA; TGKHFSLWAITAK; GKHFSLWAITAKV;
KHFSLWAITAKVI; HFSLWAITAKVIF; FSLWAITAKVIFS;
SLWAITAKVIFST; TKAPKVFIWIPHF; KAPKVFIWIPHFW;
APKVFIWIPHFWV; EAFYLCNSIYPSF; AFYLCNSIYPSFN;
FYLCNSIYPSFNF; FWHLHGFLWLFGS; WHLHGFLWLFGSC;
HLHGFLWLFGSCP; LHGFLWLFGSCPW; HGFLWLFGSCPWT;
GFLWLFGSCPWTL; FLWLFGSCPWTLS; LWLFGSCPWTLSF;
WLFGSCPWTLSFS; LFGSCPWTLSFSF; FGSCPWTLSFSFG;
GSCPWTLSFSFGW; SCPWTLSFSFGWG; CPWTLSFSFGWGH;
PWTLSFSFGWGHL; WTLSFSFGWGHLH; TLSFSFGWGHLHM;
LSFSFGWGHLHML; SFSFGWGHLHMLQ; FSFGWGHLHMLQE;
SFGWGHLHMLQEQ; FGWGHLHMLQEQV; GWGHLHMLQEQVL;
WGHLHMLQEQVLQ; GHLHMLQEQVLQS; HLHMLQEQVLQSR;
LHMLQEQVLQSRT; HMLQEQVLQSRTG; MLQEQVLQSRTGL;
LQEQVLQSRTGLE; QEQVLQSRTGLEV; EQVLQSRTGLEVK;
QVLQSRTGLEVKA; VLQSRTGLEVKAT; LQSRTGLEVKATS;
QSRTGLEVKATSI; SRTGLEVKATSIE; RTGLEVKATSIEE;
TGLEVKATSIEEQ; GLEVKATSIEEQF; LEVKATSIEEQFF;
EVKATSIEEQFFD; TLLNVHFVDFLSP; LLNVHFVDFLSPF;
LNVHFVDFLSPFF; NVHFVDFLSPFFV; LLLYCQHHLYYKY;
LLYCQHHLYYKYG; LYCQHHLYYKYGQ; YCQHHLYYKYGQN;
CQHHLYYKYGQNV; QHHLYYKYGQNVH; HHLYYKYGQNVHG;
HLYYKYGQNVHGY; LYYKYGQNVHGYL; YYKYGQNVHGYLP;
YKYGQNVHGYLPF; KYGQNVHGYLPFQ; YGQNVHGYLPFQL;
GQNVHGYLPFQLL; QNVHGYLPFQLLV; GKDQNNIVEYNYK;
KDQNNIVEYNYKS; DQNNIVEYNYKSL; KIFLFFSAIPVRL;
QKYLHQETEYHST; KYLHQETEYHSTH; YLHQETEYHSTHL;
LHQETEYHSTHLG; TIPKPCLIADRGL; IPKPCLIADRGLQ;
PKPCLIADRGLQW; KPCLIADRGLQWK; PCLIADRGLQWKL;
CLIADRGLQWKLC; LIADRGLQWKLCD; IADRGLQWKLCDP;
ADRGLQWKLCDPN; DRGLQWKLCDPNH; RGLQWKLCDPNHQ;
GLQWKLCDPNHQR; LQWKLCDPNHQRT; QWKLCDPNHQRTY;
WKLCDPNHQRTYT; KLCDPNHQRTYTL; LCDPNHQRTYTLL;
CDPNHQRTYTLLE; DPNHQRTYTLLEL; PNHQRTYTLLELR;
NHQRTYTLLELRN; PQEHQQLQHMFEE; QEHQQLQHMFEEL;
EHQQLQHMFEELG; HQQLQHMFEELGL; QQQPPQQQFQPLK;
QPPPQQQFQPLKI; QPPQQQFQPLKIL; PPQQQFQPLKILW;
PQQQFQPLKILWQ; QQQFQPLKILWQQ; QQFQPLKILWQQQ;
QFQPLKILWQQQP; FQPLKILWQQQPQ; QPLKILWQQQPQI;
PLKILWQQQPQIH; LKILWQQQPQIHW; KILWQQQPQIHWQ;
ILWQQQPQIHWQL; LWQQQPQIHWQLG; WQQQPQIHWQLGP;
QQQPQIHWQLGPP; QQPQIHWQLGPPK; QPQIHWQLGPPKV;
PQIHWQLGPPKVL; QIHWQLGPPKVLE; IHWQLGPPKVLEQ;
HWQLGPPKVLEQH; WQLGPPKVLEQHP; TWKYKKKGITYLG;
WKYKKKGITYLGV; KYKKKGITYLGVF; YKKKGITYLGVFY;
KKKGITYLGVFYR; KKGITYLGVFYRV; KGITYLGVFYRVF;
GITYLGVFYRVFY; ITYLGVFYRVFYS; TYLGVFYRVFYSR;
SSGTFVFPVYTVF; SGTFVFPVYTVFT; GTFVFPVYTVFTS;
TFVFPVYTVFTST; FVFPVYTVFTSTK; VFPVYTVFTSTKF;
FPVYTVFTSTKFQ; PVYTVFTSTKFQQ; VYTVFTSTKFQQK;
YTVFTSTKFQQKL; NKNKNPLSSFFCS; KNKNPLSSFFCSS;
NKNPLSSFFCSSP; KNPLSSFFCSSPG; NPLSSFFCSSPGF;
PLSSFFCSSPGFT; LSSFFCSSPGFTN; SSFFCSSPGFTNF;
SFFCSSPGFTNFH; FFCSSPGFTNFHG; GTRPRFLGSQNMS;
TRPRFLGSQNMSV; RPRFLGSQNMSVM; PRFLGSQNMSVMH;
RFLGSQNMSVMHF; FLGSQNMSVMHFP; LGSQNMSVMHFPS;
AAPPCESCTFLPE; APPCESCTFLPEV; PPCESCTFLPEVM;
PCESCTFLPEVMV; CESCTFLPEVMVW; ESCTFLPEVMVWL;
SCTFLPEVMVWLH; CTFLPEVMVWLHS; TFLPEVMVWLHSP;
FLPEVMVWLHSPV; LPEVMVWLHSPVS; PEVMVWLHSPVSH;
EVMVWLHSPVSHA; VMVWLHSPVSHAL; MVWLHSPVSHALS;
VWLHSPVSHALSF; WLHSPVSHALSFL; LHSPVSHALSFLR;
HSPVSHALSFLRS; SPVSHALSFLRSW; PVSHALSFLRSWF;
VSHALSFLRSWFG; SHALSFLRSWFGC; HALSFLRSWFGCI;
ALSFLRSWFGCIP; LSFLRSWFGCIPW; SFLRSWFGCIPWV;
FLRSWFGCIPWVS; LRSWFGCIPWVSS; RSWFGCIPWVSSS;
SWFGCIPWVSSSS; WFGCIPWVSSSSL; FGCIPWVSSSSLW;
GCIPWVSSSSLWP; CIPWVSSSSLWPF; IPWVSSSSLWPFF;
PWVSSSSLWPFFL; YIRGRGRLCLHPF; IRGRGRLCLHPFS;
RGRGRLCLHPFSQ; GRGRLCLHPFSQV; RGRLCLHPFSQVV;
GRLCLHPFSQVVR; RLCLHPFSQVVRV; LCLHPFSQVVRVW;
CLHPFSQVVRVWR; LHPFSQVVRVWRL; HPFSQVVRVWRLF;
PFSQVVRVWRLFL; FSQVVRVWRLFLR; SQVVRVWRLFLRP;
QVVRVWRLFLRPS; VVRVWRLFLRPSK; VRVWRLFLRPSKT;
RVWRLFLRPSKTI; VWRLFLRPSKTIW; WRLFLRPSKTIWG;
RLFLRPSKTIWGN; LFLRPSKTIWGNP; FLRPSKTIWGNPY;
LRPSKTIWGNPYS; RPSKTIWGNPYSF; PSKTIWGNPYSFA;
SKTIWGNPYSFAI; KTIWGNPYSFAIF; TIWGNPYSFAIFA;
IWGNPYSFAIFAK 14 mers:

KSCLGKSSLNEKSL; SCLGKSSLNEKSLF; CLGKSSLNEKSLFK;
LGKSSLNEKSLFKE; GKSSLNEKSLFKEV; FSSLPRYPVLQGMA;
SSLPRYPVLQGMAY; SLPRYPVLQGMAYL; LPRYPVLQGMAYLF;
PRYPVLQGMAYLFQ; RYPVLQGMAYLFQK; YPVLQGMAYLFQKA;
PVLQGMAYLFQKAF; VLQGMAYLFQKAFC; LQGMAYLFQKAFCA;
QGMAYLFQKAFCAL; GMAYLFQKAFCALP; MAYLFQKAFCALPL;
AYLFQKAFCALPLH; YLFQKAFCALPLHA; LFQKAFCALPLHAM;
FQKAFCALPLHAMS; QKAFCALPLHAMSA; KIPKKRALGLDRLL;
IFKKRALGLDRLLL; FKKRALGLDRLLLH; RNSAMVGPNNWRNS;
NSAMVGPNNWRNSL; SAMVGPNNWRNSLQ; AMVGPNNWRNSLQR;
MVGPNNWRNSLQRS; VGPNNWRNSLQRSK; GPNNWRNSLQRSKA;
PNNWRNSLQRSKAL; NNWRNSLQRSKALR; VPTYGTEEWESWWS;
PTYGTEEWESWWSS; TYGTEEWESWWSSF; YGTEEWESWWSSFN;
GTEEWESWWSSFNE; TEEWESWWSSFNEK; EEWESWWSSFNEKW;
EWESWWSSFNEKWD; WESWWSSFNEKWDE; ESWWSSFNEKWDED;
SWWSSFNEKWDEDL; WWSSFNEKWDEDLF; WSSFNEKWDEDLFC;
SSFNEKWDEDLFCH; SFNEKWDEDLFCHE; FNEKWDEDLFCHED;
NEKWDEDLFCHEDM; EKWDEDLFCHEDMF; KWDEDLFCHEDMFA;
WDEDLFCHEDMFAS; DEDLFCHEDMFASD; EDLFCHEDMFASDE;
DLFCHEDMFASDEE; LFCHEDMFASDEEA; FCHEDMFASDEEAT;
CHEDMFASDEEATA; HEDMFASDEEATAD; EDMFASDEEATADS;
DMFASDEEATADSQ; MFASDEEATADSQH; FASDEEATADSQHS;
ASDEEATADSQHST; SDEEATADSQHSTP; DEEATADSQHSTPP;
EEATADSQHSTPPK; EATADSQHSTPPKK; ATADSQHSTPPKKK;
TADSQHSTPPKKKR; ADSQHSTPPKKKRK; DSQHSTPPKKKRKV;
SQHSTPPKKKRKVE; QHSTPPKKKRKVED; HSTPPKKKRKVEDP;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

STPPKKKRKVEDPK; TPPKKKRKVEDPKD; PPKKKRKVEDPKDF;
PKKKRKVEDPKDFP; KKKRKVEDPKDFPS; KKRKVEDPKDFPSD;
KRKVEDPKDFPSDL; RKVEDPKDFPSDLH; KVEDPKDFPSDLHQ;
VEDPKDFPSDLHQF; EDPKDFPSDLHQFL; DPKDFPSDLHQFLS;
PKDFPSDLHQFLSQ; KDFPSDLHQFLSQA; DFPSDLHQFLSQAV;
FPSDLHQFLSQAVF; PSDLHQFLSQAVFS; SDLHQFLSQAVFSN;
DLHQFLSQAVFSNR; LHQFLSQAVFSNRT; HQFLSQAVFSNRTL;
QFLSQAVFSNRTLA; FLSQAVFSNRTLAC; LSQAVFSNRTLACF;
SQAVFSNRTLACFA; QAVFSNRTLACFAV; AVFSNRTLACFAVY;
VFSNRTLACFAVYT; FSNRTLACFAVYTT; SNRTLACFAVYTTK;
NRTLACFAVYTTKE; RTLACFAVYTTKEK; TLACFAVYTTKEKA;
LACFAVYTTKEKAQ; ACFAVYTTKEKAQI; CFAVYTTKEKAQIL;
FAVYTTKEKAQILY; AVYTTKEKAQILYK; VYTTKEKAQILYKK;
YTTKEKAQILYKKL; TTKEKAQILYKKLM; TKEKAQILYKKLME;
KEKAQILYKKLMEK; EKAQILYKKLMEKY; KAQILYKKLMEKYS;
AQILYKKLMEKYSV; QILYKKLMEKYSVT; ILYKKLMEKYSVTF;
LYKKLMEKYSVTFI; YKKLMEKYSVTFIS; KKLMEKYSVTFISR;
KLMEKYSVTFISRH; LMEKYSVTFISRHM; MEKYSVTFISRHMC;
EKYSVTFISRHMCA; KYSVTFISRHMCAG; YSVTFISRHMCAGH;
SVTFISRHMCAGHN; VTFISRHMCAGHNI; TFISRHMCAGHNII;
FISRHMCAGHNIIF; ISRHMCAGHNIIFF; SRHMCAGHNIIFFL;
RHMCAGHNIIFFLT; HMCAGHNIIFFLTP; MCAGHNIIFFLTPH;
CAGHNIIFFLTPHR; AGHNIIFFLTPHRH; GHNIIFFLTPHRHR;
HNIIFFLTPHRHRV; NIIFFLTPHRHRVS; IIFFLTPHRHRVSA;
IFFLTPHRHRVSAI; FFLTPHRHRVSAIN; FLTPHRHRVSAINN;
LTPHRHRVSAINNF; TPHRHRVSAINNFC; PHRHRVSAINNFCQ;
HRHRVSAINNFCQK; RHRVSAINNFCQKL; HRVSAINNFCQKLC;
RVSAINNFCQKLCT; VSAINNFCQKLCTF; SAINNFCQKLCTFS;
AINNFCQKLCTFSF; INNFCQKLCTFSFL; NNFCQKLCTFSFLI;
NFCQKLCTFSFLIC; FCQKLCTFSFLICK; CQKLCTFSFLICKG;
QKLCTFSFLICKGV; KLCTFSFLICKGVN; LCTFSFLICKGVNK;
CTFSFLICKGVNKE; TFSFLICKGVNKEY; FSFLICKGVNKEYL;
SFLICKGVNKEYLL; FLICKGVNKEYLLY; LICKGVNKEYLLYS;
ICKGVNKEYLLYSA; CKGVNKEYLLYSAL; KGVNKEYLLYSALT;
GVNKEYLLYSALTR; VNKEYLLYSALTRD; NKEYLLYSALTRDP;
KEYLLYSALTRDPY; EYLLYSALTRDPYH; YLLYSALTRDPYHT;
LLYSALTRDPYHTI; LYSALTRDPYHTIE; YSALTRDPYHTIEE;
SALTRDPYHTIEES; ALTRDPYHTIEESI; LTRDPYHTIEESIQ;
TRDPYHTIEESIQG; RDPYHTIEESIQGG; DPYHTIEESIQGGL;
PYHTIEESIQGGLK; YHTIEESIQGGLKE; HTIEESIQGGLKEH;
TIEESIQGGLKEHD; IEESIQGGLKEHDF; EESIQGGLKEHDFS;
ESIQGGLKEHDFSP; SIQGGLKEHDFSPE; IQGGLKEHDFSPEE;
QGGLKEHDFSPEEP; GGLKEHDFSPEEPE; GLKEHDFSPEEPEE;
LKEHDFSPEEPEET; KEHDFSPEEPEETK; EHDFSPEEPEETKQ;
HDFSPEEPEETKQV; DFSPEEPEETKQVS; FSPEEPEETKQVSW;
SPEEPEETKQVSWK; PEEPEETKQVSWKL; EEPEETKQVSWKLI;
EPEETKQVSWKLIT; PEETKQVSWKLITE; EETKQVSWKLITEY;
ETKQVSWKLITEYA; TKQVSWKLITEYAV; KQVSWKLITEYAVE;
QVSWKLITEYAVET; VSWKLITEYAVETK; SWKLITEYAVETKC;
WKLITEYAVETKCE; KLITEYAVETKCED; LITEYAVETKCEDV;
ITEYAVETKCEDVF; TEYAVETKCEDVFL; EYAVETKCEDVFLL;
YAVETKCEDVFLLL; AVETKCEDVFLLLG; VETKCEDVFLLLGM;
ETKCEDVFLLLGMY; TKCEDVFLLLGMYL; KCEDVFLLLGMYLE;
CEDVFLLLGMYLEF; EDVFLLLGMYLEFQ; DVFLLLGMYLEFQY;
VFLLLGMYLEFQYN; FLLLGMYLEFQYNV; LLLGMYLEFQYNVE;
LLGMYLEFQYNVEE; LGMYLEFQYNVEEC; GMYLEFQYNVEECK;
MYLEFQYNVEECKK; YLEFQYNVEECKKC; LEFQYNVEECKKCQ;
EFQYNVEECKKCQK; FQYNVEECKKCQKK; QYNVEECKKCQKKD;
YNVEECKKCQKKDQ; NVEECKKCQKKDQP; VEECKKCQKKDQPY;
EECKKCQKKDQPYH; ECKKCQKKDQPYHF; CKKCQKKDQPYHFK;
KKCQKKDQPYHFKY; KCQKKDQPYHFKYH; CQKKDQPYHFKYHE;
QKKDQPYHFKYHEK; KKDQPYHFKYHEKH; KDQPYHFKYHEKHF;
DQPYHFKYHEKHFA; QPYHFKYHEKHFAN; PYHFKYHEKHFANA;
YHFKYHEKHFANAI; HFKYHEKHFANAII; FKYHEKHFANAIIF;
KYHEKHFANAIIFA; YHEKHFANAIIFAE; HEKHFANAIIFAES;
EKHFANAIIFAESK; KHFANAIIFAESKN; HFANAIIFAESKNQ;
FANAIIFAESKNQK; ANAIIFAESKNQKS; NAIIFAESKNQKSI;
AIIFAESKNQKSIC; IIFAESKNQKSICQ; IFAESKNQKSICQQ;
FAESKNQKSICQQA; AESKNQKSICQQAV; ESKNQKSICQQAVD;
SKNQKSICQQAVDT; KNQKSICQQAVDTV; NQKSICQQAVDTVL;
QKSICQQAVDTVLA; KSICQQAVDTVLAK; SICQQAVDTVLAKK;
ICQQAVDTVLAKKR; CQQAVDTVLAKKRV; QQAVDTVLAKKRVD;
QAVDTVLAKKRVDT; AVDTVLAKKRVDTL; VDTVLAKKRVDTLH;
DTVLAKKRVDTLHM; TVLAKKRVDTLHMT; VLAKKRVDTLHMTR;
LAKKRVDTLHMTRE; AKKRVDTLHMTREE; KKRVDTLHMTREEM;
KRVDTLHMTREEML; RVDTLHMTREEMLT; VDTLHMTREEMLTE;
DTLHMTREEMLTER; TLHMTREEMLTERF; LHMTREEMLTERFN;
HMTREEMLTERFNH; MTREEMLTERFNHI; TREEMLTERFNHIL;
REEMLTERFNHILD; EEMLTERFNHILDK; EMLTERFNHILDKM;
MLTERFNHILDKMD; LTERFNHILDKMDL; TERFNHILDKMDLI;
ERFNHILDKMDLIF; RFNHILDKMDLIFG; FNHILDKMDLIFGA;
NHILDKMDLIFGAH; HILDKMDLIFGAHG; ILDKMDLIFGAHGN;
LDKMDLIFGAHGNA; DKMDLIFGAHGNAV; KMDLIFGAHGNAVL;
MDLIFGAHGNAVLE; DLIFGAHGNAVLEQ; LIFGAHGNAVLEQY;
IFGAHGNAVLEQYM; FGAHGNAVLEQYMA; GAHGNAVLEQYMAG;
AHGNAVLEQYMAGV; HGNAVLEQYMAGVA; GNAVLEQYMAGVAW;
NAVLEQYMAGVAWL; AVLEQYMAGVAWLH; VLEQYMAGVAWLHC;
LEQYMAGVAWLHCL; EQYMAGVAWLHCLL; QYMAGVAWLHCLLP;
YMAGVAWLHCLLPK; MAGVAWLHCLLPKM; AGVAWLHCLLPKMD;
GVAWLHCLLPKMDS; VAWLHCLLPKMDSV; AWLHCLLPKMDSVI;
WLHCLLPKMDSVIF; LHCLLPKMDSVIFD; HCLLPKMDSVIFDF;
CLLPKMDSVIFDFL; LLPKMDSVIFDFLH; LPKMDSVIFDFLHC;
PKMDSVIFDFLHCI; KMDSVIFDFLHCIV; MDSVIFDFLHCIVF;
DSVIFDFLHCIVFN; SVIFDFLHCIVFNV; VIFDFLHCIVFNVP;
IFDFLHCIVFNVPK; FDFLHCIVFNVPKR; DFLHCIVFNVPKRR;
FLHCIVFNVPKRRY; LHCIVFNVPKRRYW; HCIVFNVPKRRYWL;
CIVFNVPKRRYWLF; IVFNVPKRRYWLFK; VFNVPKRRYWLFKG;
FNVPKRRYWLFKGP; NVPKRRYWLFKGPI; VPKRRYWLFKGPID;
PKRRYWLFKGPIDS; KRRYWLFKGPIDSG; RRYWLFKGPIDSGK;
RYWLFKGPIDSGKT; YWLFKGPIDSGKTT; WLFKGPIDSGKTTL;
LFKGPIDSGKTTLA; FKGPIDSGKTTLAA; KGPIDSGKTTLAAG;
GPIDSGKTTLAAGL; PIDSGKTTLAAGLL; IDSGKTTLAAGLLD;
DSGKTTLAAGLLDL; SGKTTLAAGLLDLC; GKTTLAAGLLDLCG;
KTTLAAGLLDLCGG; TTLAAGLLDLCGGK; TLAAGLLDLCGGKA;
LAAGLLDLCGGKAL; AAGLLDLCGGKALN; AGLLDLCGGKALNV;
GLLDLCGGKALNVL; LLDLCGGKALNVLP; LDLCGGKALNVLPM;
DLCGGKALNVLPME; LCGGKALNVLPMER; CGGKALNVLPMERL;
GGKALNVLPMERLT; GKALNVLPMERLTF; KALNVLPMERLTFE;
ALNVLPMERLTFEL; LNVLPMERLTFELG; NVLPMERLTFELGV;
VNLPMERLTFELGV; NLPMERLTFELGVA; LPMERLTFELGVAI;
PMERLTFELGVAID; MERLTFELGVAIDQ; ERLTFELGVAIDQY;
RLTFELGVAIDQYM; LTFELGVAIDQYMV; TFELGVAIDQYMVV;
FELGVAIDQYMVVF; ELGVAIDQYMVVFE; LGVAIDQYMVVFED;
GVAIDQYMVVFEDV; VAIDQYMVVFEDVK; AIDQYMVVFEDVKG;
IDQYMVVFEDVKGT; DQYMVVFEDVKGTG; QYMVVFEDVKGTGA;
YMVVFEDVKGTGAE; MVVFEDVKGTGAES; VVFEDVKGTGAESK;
VFEDVKGTGAESKD; FEDVKGTGAESKDL; EDVKGTGAESKDLP;
DVKGTGAESKDLPS; VKGTGAESKDLPSG; KGTGAESKDLPSGH;
GTGAESKDLPSGHG; TGAESKDLPSGHGI; GAESKDLPSGHGIN;
AESKDLPSGHGINN; ESKDLPSGHGINNL; SKDLPSGHGINNLD;
KDLPSGHGINNLDS; DLPSGHGINNLDSL; LPSGHGINNLDSLR;
PSGHGINNLDSLRD; SGHGINNLDSLRDY; GHGINNLDSLRDYL;
HGINNLDSLRDYLD; GINNLDSLRDYLDG; INNLDSLRDYLDGS;
NNLDSLRDYLDGSV; NLDSLRDYLDGSVK; LDSLRDYLDGSVKV;
DSLRDYLDGSVKVN; SLRDYLDGSVKVNL; LRDYLDGSVKVNLE;
RDYLDGSVKVNLEK; DYLDGSVKVNLEKK; YLDGSVKVNLEKKH;
LDGSVKVNLEKKHL; DGSVKVNLEKKHLN; GSVKVNLEKKHLNK;
SVKVNLEKKHLNKR; VKVNLEKKHLNKRT; KVNLEKKHLNKRTQ;
VNLEKKHLNKRTQI; NLEKKHLNKRTQIF; LEKKHLNKRTQIFP;
EKKHLNKRTQIFPP; KKHLNKRTQIFPPG; KHLNKRTQIFPPGL;
HLNKRTQIFPPGLV; LNKRTQIFPPGLVT; NKRTQIFPPGLVTM;
KRTQIFPPGLVTMN; RTQIFPPGLVTMNE; TQIFPPGLVTMNEY;
QIFPPGLVTMNEYP; IFPPGLVTMNEYPV; FPPGLVTMNEYPVP;
PPGLVTMNEYPVPK; PGLVTMNEYPVPKT; GLVTMNEYPVPKTL;
LVTMNEYPVPKTLQ; VTMNEYPVPKTLQA; TMNEYPVPKTLQAR;
MNEYPVPKTLQARF; NEYPVPKTLQARFV; EYPVPKTLQARFVR;
YPVPKTLQARFVRQ; PVPKTLQARFVRQI; VPKTLQARFVRQID;
PKTLQARFVRQIDF; KTLQARFVRQIDFR; TLQARFVRQIDFRP;
LQARFVRQIDFRPK; QARFVRQIDFRPKI; ARFVRQIDFRPKIY;
RFVRQIDFRPKIYL; FVRQIDFRPKIYLR; VRQIDFRPKIYLRK;
RQIDFRPKIYLRKS; QIDFRPKIYLRKSL; IDFRPKIYLRKSLQ;
DFRPKIYLRKSLQN; FRPKIYLRKSLQNS; RPKIYLRKSLQNSE;
PKIYLRKSLQNSEF; KIYLRKSLQNSEFL; IYLRKSLQNSEFLL;
YLRKSLQNSEFLLE; LRKSLQNSEFLLEK; RKSLQNSEFLLEKR;
KSLQNSEFLLEKRI; SLQNSEFLLEKRIL; LQNSEFLLEKRILQ;
QNSEFLLEKRILQS; NSEFLLEKRILQSG; SEFLLEKRILQSGM;
EFLLEKRILQSGMT; FLLEKRILQSGMTL; LLEKRILQSGMTLL;
LEKRILQSGMTLLL; EKRILQSGMTLLLL; KRILQSGMTLLLLL;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

RILQSGMTLLLLLI; ILQSGMTLLLLLIW; LQSGMTLLLLLIWF;
QSGMTLLLLLIWFR; SGMTLLLLLIWFRP; GMTLLLLLIWFRPV;
MTLLLLLIWFRPVA; TLLLLLIWFRPVAD; LLLLLIWFRPVADF;
LLLLIWFRPVADFA; LLLIWFRPVADFAT; LLIWFRPVADFATD;
LIWFRPVADFATDI; IWFRPVADFATDIQ; WFRPVADFATDIQS;
FRPVADFATDIQSR; RPVADFATDIQSRI; PVADFATDIQSRIV;
VADFATDIQSRIVE; ADFATDIQSRIVEW; DFATDIQSRIVEWK;
FATDIQSRIVEWKE; ATDIQSRIVEWKER; TDIQSRIVEWKERL;
DIQSRIVEWKERLD; IQSRIVEWKERLDS; QSRIVEWKERLDSE;
SRIVEWKERLDSEI; RIVEWKERLDSEIS; IVEWKERLDSEISM;
VEWKERLDSEISMY; EWKERLDSEISMYT; WKERLDSEISMYTF;
KERLDSEISMYTFS; ERLDSEISMYTFSR; RLDSEISMYTFSRM;
LDSEISMYTFSRMK; DSEISMYTFSRMKY; SEISMYTFSRMKYN;
EISMYTFSRMKYNI; ISMYTFSRMKYNIC; SMYTFSRMKYNICM;
MYTFSRMKYNICMG; YTFSRMKYNICMGK; TFSRMKYNICMGKC;
FSRMKYNICMGKCI; SRMKYNICMGKCIL; RMKYNICMGKCILD;
MKYNICMGKCILDI; KYNICMGKCILDIT; YNICMGKCILDITR;
NICMGKCILDITRE; ICMGKCILDITREE; CMGKCILDITREED;
MGKCILDITREEDS; GKCILDITREEDSE; KCILDITREEDSET;
CILDITREEDSETE; ILDITREEDSETED; LDITREEDSETEDS;
DITREEDSETEDSG; ITREEDSETEDSGH; TREEDSETEDSGHG;
REEDSETEDSGHGS; EEDSETEDSGHGSS; EDSETEDSGHGSST;
DSETEDSGHGSSTE; SETEDSGHGSSTES; ETEDSGHGSSTESQ;
TEDSGHGSSTESQS; EDSGHGSSTESQSQ; DSGHGSSTESQSQC;
SGHGSSTESQSQCS; GHGSSTESQSQCSS; HGSSTESQSQCSSQ;
GSSTESQSQCSSQV; SSTESQSQCSSQVS; STESQSQCSSQVSD;
TESQSQCSSQVSDT; ESQSQCSSQVSDTS; SQSQCSSQVSDTSA;
QSQCSSQVSDTSAP; SQCSSQVSDTSAPA; QCSSQVSDTSAPAE;
CSSQVSDTSAPAED; SSQVSDTSAPAEDS; SQVSDTSAPAEDSQ;
QVSDTSAPAEDSQR; VSDTSAPAEDSQRS; SDTSAPAEDSQRSD;
DTSAPAEDSQRSDP; TSAPAEDSQRSDPH; SAPAEDSQRSDPHS;
APAEDSQRSDPHSQ; PAEDSQRSDPHSQE; AEDSQRSDPHSQEL;
EDSQRSDPHSQELH; DSQRSDPHSQELHL; SQRSDPHSQELHLC;
QRSDPHSQELHLCK; RSDPHSQELHLCKG; SDPHSQELHLCKGF;
DPHSQELHLCKGFQ; PHSQELHLCKGFQC; HSQELHLCKGFQCF;
SQELHLCKGFQCFK; QELHLCKGFQCFKR; ELHLCKGFQCFKRP;
LHLCKGFQCFKRPK; HLCKGFQCFKRPKT; LCKGFQCFKRPKTP;
CKGFQCFKRPKTPP; KGFQCFKRPKTPPP; GFQCFKRPKTPPPK;
MYMYNKSTCLKHFG; YMYNKSTCLKHFGL; MYNKSTCLKHFGLQ;
YNKSTCLKHFGLQL; NKSTCLKHFGLQLS; KSTCLKHFGLQLSL;
STCLKHFGLQLSLF; TCLKHFGLQLSLFV; CLKHFGLQLSLFVN;
LKHFGLQLSLFVNI; KHFGLQLSLFVNIS; HFGLQLSLFVNISY;
FGLQLSLFVNISYH; GLQLSLFVNISYHI; LQLSLFVNISYHIW;
QLSLFVNISYHIWV; LSLFVNISYHIWVP; SLFVNISYHIWVPW;
LFVNISYHIWVPWK; FVNISYHIWVPWKS; VNISYHIWVPWKSF;
NISYHIWVPWKSFC; ISYHIWVPWKSFCA; SYHIWVPWKSFCAI;
YHIWVPWKSFCAIK; HIWVPWKSFCAIKH; IWVPWKSFCAIKHP;
WVPWKSFCAIKHPN; VPWKSFCAIKHPNL; PWKSFCAIKHPNLF;
WKSFCAIKHPNLFY; KSFCAIKHPNLFYL; SFCAIKHPNLFYLG;
FCAIKHPNLFYLGF; CAIKHPNLFYLGFH; AIKHPNLFYLGFHT;
IKHPNLFYLGFHTI; KHPNLFYLGFHTIH; HPNLFYLGFHTIHR;
PNLFYLGFHTIHRL; NLFYLGFHTIHRLP; LFYLGFHTIHRLPI;
FYLGFHTIHRLPIH; YLGFHTIHRLPIHS; LGFHTIHRLPIHSL;
GFHTIHRLPIHSLG; FHTIHRLPIHSLGS; HTIHRLPIHSLGSP;
TIHRLPIHSLGSPV; IHRLPIHSLGSPVY; HRLPIHSLGSPVYK;
RLPIHSLGSPVYKV; LPIHSLGSPVYKVT; QKGNWVRILYRSFS;
KGNWVRILYRSFSQ; GNWVRILYRSFSQA; NWVRILYRSFSQAD;
WVRILYRSFSQADL; VRILYRSFSQADLK; RILYRSFSQADLKI;
ILYRSFSQADLKIS; LYRSFSQADLKISC; YRSFSQADLKISCK;
RSFSQADLKISCKA; SFSQADLKISCKAS; FSQADLKISCKASP;
SQADLKISCKASPL; QADLKISCKASPLL; ADLKISCKASPLLC;
DLKISCKASPLLCS; LKISCKASPLLCSR; KISCKASPLLCSRA;
ISCKASPLLCSRAV; SCKASPLLCSRAVS; CKASPLLCSRAVSK;
KASPLLCSRAVSKQ; ASPLLCSRAVSKQA; SPLLCSRAVSKQAT;
PLLCSRAVSKQATN; LLCSRAVSKQATNI; LCSRAVSKQATNIS;
CSRAVSKQATNISS; NIQAISFTKRPHTL; IQAISFTKRPHTLF;
QAISFTKRPHTLFI; QHCGSCVGHMKYWG; HCGSCVGHMKYWGN;
CGSCVGHMKYWGNI; GSCVGHMKYWGNIF; SCVGHMKYWGNIFP;
CVGHMKYWGNIFPS; VGHMKYWGNIFPSC; GHMKYWGNIFPSCE;
HMKYWGNIFPSCES; MKYWGNIFPSCESP; KYWGNIFPSCESPK;
YWGNIFPSCESPKI; WGNIFPSCESPKIP; GNIFPSCESPKIPS;
NIFPSCESPKIPSI; IFPSCESPKIPSIF; FPSCESPKIPSIFI;
PSCESPKIPSIFIS; SCESPKIPSIFIST; CESPKIPSIFISTG;
ESPKIPSIFISTGI; SPKIPSIFISTGIR; PKIPSIFISTGIRY;
KIPSIFISTGIRYP; IPSIFISTGIRYPA; PSIFISTGIRYPAL;
SIFISTGIRYPALN; IFISTGIRYPALNW; FISTGIRYPALNWI;
ISTGIRYPALNWIS; STGIRYPALNWISI; TGIRYPALNWISIV;
GIRYPALNWISIVF; IRYPALNWISIVFV; RYPALNWISIVFVQ;
YPALNWISIVFVQI; PALNWISIVFVQIG; ALNWISIVFVQIGL;
LNWISIVFVQIGLM; NWISIVFVQIGLMV; WISIVFVQIGLMVS;
ISIVFVQIGLMVSI; SIVFVQIGLMVSIH; IVFVQIGLMVSIHY;
VFVQIGLMVSIHYL; FVQIGLMVSIHYLG; VQIGLMVSIHYLGL;
QIGLMVSIHYLGLG; IGLMVSIHYLGLGC; GLMVSIHYLGLGCW;
LMVSIHYLGLGCWV; MVSIHYLGLGCWVF; VSIHYLGLGCWVFR;
SIHYLGLGCWVFRG; IHYLGLGCWVFRGY; HYLGLGCWVFRGYS;
YLGLGCWVFRGYST; LGLGCWVFRGYSTI; GLGCWVFRGYSTIR;
LGCWVFRGYSTIRV; GCWVFRGYSTIRVL; HSLHFQGFSTYSKE;
SLHFQGFSTYSKEV; LHFQGFSTYSKEVE; HFQGFSTYSKEVEI;
FQGFSTYSKEVEIT; QGFSTYSKEVEITA; GFSTYSKEVEITAL;
FSTYSKEVEITALN; STYSKEVEITALNR; TYSKEVEITALNRF;
YSKEVEITALNRFS; SKEVEITALNRFSS; KEVEITALNRFSST;
EVEITALNRFSSTM; VEITALNRFSSTML; EITALNRFSSTMLM;
ITALNRFSSTMLMH; TALNRFSSTMLMHF; ALNRFSSTMLMHFL;
PCMKVKHASYSNNL; CMKVKHASYSNNLC; MKVKHASYSNNLCL;
KVKHASYSNNLCLY; VKHASYSNNLCLYS; KHASYSNNLCLYSY;
HASYSNNLCLYSYS; ASYSNNLCLYSYSL; SYSNNLCLYSYSLP;
YSNNLCLYSYSLPH; SNNLCLYSYSLPHQ; NNLCLYSYSLPHQI;
IGEGNSCCAVTGKH; GEGNSCCAVTGKHF; EGNSCCAVTGKHFS; GNSCCAVTGKHFSL;
NSCCAVTGKHFSLW; SCCAVTGKHFSLWA; CCAVTGKHFSLWAI;
CAVTGKHFSLWAIT; AVTGKHFSLWAITA; VTGKHFSLWAITAK;
TGKHFSLWAITAKV; GKHFSLWAITAKVI; KHFSLWAITAKVIF;
HFSLWAITAKVIFS; FSLWAITAKVIFST; TKAPKVFIWIPHFW;
KAPKVFIWIPHFWV; EAFYLCNSIYPSFN; AFYLCNSIYPSFNF;
FWHLHGFLWLFGSC; WHLHGFLWLFGSCP; HLHGFLWLFGSCPW;
LHGFLWLFGSCPWT; HGFLWLFGSCPWTL; GFLWLFGSCPWTLS;
FLWLFGSCPWTLSF; LWLFGSCPWTLSFS; WLFGSCPWTLSFSF;
LFGSCPWTLSFSFG; FGSCPWTLSFSFGW; GSCPWTLSFSFGWG;
SCPWTLSFSFGWGH; CPWTLSFSFGWGHL; PWTLSFSFGWGHLH;
WTLSFSFGWGHLHM; TLSFSFGWGHLHML; LSFSFGWGHLHMLQ;
SFSFGWGHLHMLQE; FSFGWGHLHMLQEQ; SFGWGHLHMLQEQV;
FGWGHLHMLQEQVL; GWGHLHMLQEQVLQ; WGHLHMLQEQVLQS;
GHLHMLQEQVLQSR; HLHMLQEQVLQSRT; LHMLQEQVLQSRTG;
HMLQEQVLQSRTGL; MLQEQVLQSRTGLE; LQEQVLQSRTGLEV;
QEQVLQSRTGLEVK; EQVLQSRTGLEVKA; QVLQSRTGLEVKAT;
VLQSRTGLEVKATS; LQSRTGLEVKATSI; QSRTGLEVKATSIE;
SRTGLEVKATSIEE; RTGLEVKATSIEEQ; TGLEVKATSIEEQF;
GLEVKATSIEEQFF; LEVKATSIEEQFFD; TLLNVHFVDFLSPF;
LLNVHFVDFLSPFV; LNVHFVDFLSPFFV; LLLYCQHHLYYKYG;
LLYCQHHLYYKYGQ; LYCQHHLYYKYGQN; YCQHHLYYKYGQNV;
CQHHLYYKYGQNVH; QHHLYYKYGQNVHG; HHLYYKYGQNVHGY;
HLYYKYGQNVHGYL; LYYKYGQNVHGYLP; YYKYGQNVHGYLPF;
YKYGQNVHGYLPFQ; KYGQNVHGYLPFQL; YGQNVHGYLPFQLL;
GQNVHGYLPFQLLV; GKDQNNIVEYNYKS; KDQNNIVEYNYKSL;
QKYLHQETEYHSTH; KYLHQETEYHSTHL; YLHQETEYHSTHLG;
TIPKPCLIADRGLQ; IPKPCLIADRGLQW; PKPCLIADRGLQWK;
KPCLIADRGLQWKL; PCLIADRGLQWKLC; CLIADRGLQWKLCD;
LIADRGLQWKLCDP; IADRGLQWKLCDPN; ADRGLQWKLCDPNH;
DRGLQWKLCDPNHQ; RGLQWKLCDPNHQR; GLQWKLCDPNHQRT;
LQWKLCDPNHQRTY; QWKLCDPNHQRTYT; WKLCDPNHQRTYTL;
KLCDPNHQRTYTLL; LCDPNHQRTYTLLE; CDPNHQRTYTLLEL;
DPNHQRTYTLLELR; PNHQRTYTLLELRN; PQEHQQLQHMFEEL;
QEHQQLQHMFEELG; EHQQLQHMFEELGL; QQQPPQQQFQPLKI;
QQPPQQQFQPLKIL; QPPQQQFQPLKILW; PPQQQFQPLKILWQ;
PQQQFQPLKILWQQ; QQQFQPLKILWQQQ; QQFQPLKILWQQQP;
QFQPLKILWQQQPQ; FQPLKILWQQQPQI; QPLKILWQQQPQIH;
PLKILWQQQPQIHW; LKILWQQQPQIHWQ; KILWQQQPQIHWQL;
ILWQQQPQIHWQLG; LWQQQPQIHWQLGP; WQQQPQIHWQLGPP;
QQQPQIHWQLGPPK; QQPQIHWQLGPPKV; QPQIHWQLGPPKVL;
PQIHWQLGPPKVLE; QIHWQLGPPKVLEQ; IHWQLGPPKVLEQH;
HWQLGPPKVLEQHP; TWKYKKKGITYLGV; WKYKKKGITYLGVF;
KYKKKGITYLGVFY; YKKKGITYLGVFYR; KKKGITYLGVFYRV;
KKGITYLGVFYRVF; KGITYLGVFYRVFY; GITYLGVFYRVFYS;
ITYLGVFYRVFYST; YLGVFYRVFYSTFV; SSGTFVFPVYTVFT; SGTFVFPVYTVFTS;
GTFVFPVYTVFTST; TFVFPVYTVFTSTK; FVFPVYTVFTSTKF;
VFPVYTVFTSTKFQ; FPVYTVFTSTKFQQ; PVYTVFTSTKFQQK;
VYTVFTSTKFQQKL; NKNKNPLSSFFCSS; KNKNPLSSFFCSSP;
NKNPLSSFFCSSPG; KNPLSSFFCSSPGF; NPLSSFFCSSPGFT;
PLSSFFCSSPGFTN; LSSFFCSSPGFTNF; SSFFCSSPGFTNFH;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

LGTRPRFLGSQNMS; GTRPRFLGSQNMSV; TRPRFLGSQNMSVM;
RPRFLGSQNMSVMH; PRFLGSQNMSVMHF; RFLGSQNMSVMHFP;
FLGSQNMSVMHFPS; AAPPCESCTFLPEV; APPCESCTFLPEVM;
PPCESCTFLPEVMV; PCESCTFLPEVMVW; CESCTFLPEVMVWL;
ESCTFLPEVMVWLH; SCTFLPEVMVWLHS; CTFLPEVMVWLHSP;
TFLPEVMVWLHSPV; FLPEVMVWLHSPVS; LPEVMVWLHSPVSH;
PEVMVWLHSPVSHA; EVMVWLHSPVSHAL; VMVWLHSPVSHALS;
MVWLHSPVSHALSF; VWLHSPVSHALSFL; WLHSPVSHALSFLR;
LHSPVSHALSFLRS; HSPVSHALSFLRSW; SPVSHALSFLRSWF;
PVSHALSFLRSWFG; VSHALSFLRSWFGC; SHALSFLRSWFGCI;
HALSFLRSWFGCIP; ALSFLRSWFGCIPW; LSFLRSWFGCIPWV;
SFLRSWFGCIPWVS; FLRSWFGCIPWVSS; LRSWFGCIPWVSSS;
RSWFGCIPWVSSSS; SWFGCIPWVSSSSL; WFGCIPWVSSSSLW;
FGCIPWVSSSSLWP; GCIPWVSSSSLWPF; CIPWVSSSSLWPFF;
IPWVSSSSLWPFFL; YIRGRGRLCLHPFS; IRGRGRLCLHPFSQ;
RGRGRLCLHPFSQV; GRGRLCLHPFSQVV; RGRLCLHPFSQVVR;
GRLCLHPFSQVVRV; RLCLHPFSQVVRVW; LCLHPFSQVVRVWR;
CLHPFSQVVRVWRL; LHPFSQVVRVWRLF; HPFSQVVRVWRLFL;
PFSQVVRVWRLFLR; FSQVVRVWRLFLRP; SQVVRVWRLFLRPS;
QVVRVWRLFLRPSK; VVRVWRLFLRPSKT; VRVWRLFLRPSKTI;
RVWRLFLRPSKTIW; VWRLFLRPSKTIWG; WRLFLRPSKTIWGN;
RLFLRPSKTIWGNP; LFLRPSKTIWGNPY; FLRPSKTIWGNPYS;
LRPSKTIWGNPYSF; RPSKTIWGNPYSFA; PSKTIWGNPYSFAI;
SKTIWGNPYSFAIF; KTIWGNPYSFAIFA; TIWGNPYSFAIFAK 15 mers:

KSCLGKSSLNEKSLF; SCLGKSSLNEKSLFK; CLGKSSLNEKSLFKE;
LGKSSLNEKSLFKEV; FSSLPRYPVLQGMAY; SSLPRYPVLQGMAYL;
SLPRYPVLQGMAYLF; LPRYPVLQGMAYLFQ; PRYPVLQGMAYLFQK;
RYPVLQGMAYLFQKA; YPVLQGMAYLFQKAF; PVLQGMAYLFQKAFC;
VLQGMAYLFQKAFCA; LQGMAYLFQKAFCAL; QGMAYLFQKAFCALP;
GMAYLFQKAFCALPL; MAYLFQKAFCALPLH; AYLFQKAFCALPLHA;
YLFQKAFCALPLHAM; LFQKAFCALPLHAMS; FQKAFCALPLHAMSA;
KIFKKRALGLDRLLL; IFKKRALGLDRLLLH; RNSAMVGPNNWRNSL;
NSAMVGPNNWRNSLQ; SAMVGPNNWRNSLQR; AMVGPNNWRNSLQRS;
MVGPNNWRNSLQRSK; VGPNNWRNSLQRSKA; GPNNWRNSLQRSKAL;
PNNWRNSLQRSKALR; VPTYGTEEWESWWSS; PTYGTEEWESWWSSF;
TYGTEEWESWWSSFN; YGTEEWESWWSSFNE; GTEEWESWWSSFNEK;
TEEWESWWSSFNEKW; EEWESWWSSFNEKWD; EWESWWSSFNEKWDE;
WESWWSSFNEKWDED; ESWWSSFNEKWDEDL; SWWSSFNEKWDEDLF;
WWSSFNEKWDEDLFC; WSSFNEKWDEDLFCH; SSFNEKWDEDLFCHE;
SFNEKWDEDLFCHED; FNEKWDEDLFCHEDM; NEKWDEDLFCHEDMF;
EKWDEDLFCHEDMFA; KWDEDLFCHEDMFAS; WDEDLFCHEDMFASD;
DEDLFCHEDMFASDE; EDLFCHEDMFASDEE; DLFCHEDMFASDEEA;
LFCHEDMFASDEEAT; FCHEDMFASDEEATA; CHEDMFASDEEATAD;
HEDMFASDEEATADS; EDMFASDEEATADSQ; DMFASDEEATADSQH;
MFASDEEATADSQHS; FASDEEATADSQHST; ASDEEATADSQHSTP;
SDEEATADSQHSTPP; DEEATADSQHSTPPK; EEATADSQHSTPPKK;
EATADSQHSTPPKKK; ATADSQHSTPPKKKR; TADSQHSTPPKKKRK;
ADSQHSTPPKKKRKV; DSQHSTPPKKKRKVE; SQHSTPPKKKRKVED;
QHSTPPKKKRKVEDP; HSTPPKKKRKVEDPK; STPPKKKRKVEDPKD;
TPPKKKRKVEDPKDF; PPKKKRKVEDPKDFP; PKKKRKVEDPKDFPS;
KKKRKVEDPKDFPSD; KKRKVEDPKDFPSDL; KRKVEDPKDFPSDLH;
RKVEDPKDFPSDLHQ; KVEDPKDFPSDLHQF; VEDPKDFPSDLHQFL;
EDPKDFPSDLHQFLS; DPKDFPSDLHQFLSQ; PKDFPSDLHQFLSQA;
KDFPSDLHQFLSQAV; DFPSDLHQFLSQAVF; FPSDLHQFLSQAVFS;
PSDLHQFLSQAVFSN; SDLHQFLSQAVFSNR; DLHQFLSQAVFSNRT;
LHQFLSQAVFSNRTL; HQFLSQAVFSNRTLA; QFLSQAVFSNRTLAC;
FLSQAVFSNRTLACF; LSQAVFSNRTLACFA; SQAVFSNRTLACFAV;
QAVFSNRTLACFAVY; AVFSNRTLACFAVYT; VFSNRTLACFAVYTT;
FSNRTLACFAVYTTK; SNRTLACFAVYTTKE; NRTLACFAVYTTKEK;
RTLACFAVYTTKEKA; TLACFAVYTTKEKAQ; LACFAVYTTKEKAQI;
ACFAVYTTKEKAQIL; CFAVYTTKEKAQILY; FAVYTTKEKAQILYK;
AVYTTKEKAQILYKK; VYTTKEKAQILYKKL; YTTKEKAQILYKKLM;
TTKEKAQILYKKLME; TKEKAQILYKKLMEK; KEKAQILYKKLMEKY;
EKAQILYKKLMEKYS; KAQILYKKLMEKYSV; AQILYKKLMEKYSVT;
QILYKKLMEKYSVTF; ILYKKLMEKYSVTFI; LYKKLMEKYSVTFIS;
YKKLMEKYSVTFISR; KKLMEKYSVTFISRH; KLMEKYSVTFISRHM;
LMEKYSVTFISRHMC; MEKYSVTFISRHMCA; EKYSVTFISRHMCAG;
KYSVTFISRHMCAGH; YSVTFISRHMCAGHN; SVTFISRHMCAGHNI;
VTFISRHMCAGHNII; TFISRHMCAGHNIIF; FISRHMCAGHNIIFF;
ISRHMCAGHNIIFFL; SRHMCAGHNIIFFLT; RHMCAGHNIIFFLTP;
HMCAGHNIIFFLTPH; MCAGHNIIFFLTPHR; CAGHNIIFFLTPHRH;

AGHNIIFFLTPHRHR; GHNIIFFLTPHRHRV; HNIIFFLTPHRHRVS;
NIIFFLTPHRHRVSA; IIFFLTPHRHRVSAI; IFFLTPHRHRVSAIN;
FFLTPHRHRVSAINN; FLTPHRHRVSAINNF; LTPHRHRVSAINNFC;
TPHRHRVSAINNFCQ; PHRHRVSAINNFCQK; HRHRVSAINNFCQKL;
RHRVSAINNFCQKLC; HRVSAINNFCQKLCT; RVSAINNFCQKLCTF;
VSAINNFCQKLCTFS; SAINNFCQKLCTFSF; AINNFCQKLCTFSFL;
INNFCQKLCTFSFLI; NNFCQKLCTFSFLIC; NFCQKLCTFSFLICK;
FCQKLCTFSFLICKG; CQKLCTFSFLICKGV; QKLCTFSFLICKGVN;
KLCTFSFLICKGVNK; LCTFSFLICKGVNKE; CTFSFLICKGVNKEY;
TFSFLICKGVNKEYL; FSFLICKGVNKEYLL; SFLICKGVNKEYLLY;
FLICKGVNKEYLLYS; LICKGVNKEYLLYSA; ICKGVNKEYLLYSAL;
CKGVNKEYLLYSALT; KGVNKEYLLYSALTR; GVNKEYLLYSALTRD;
VNKEYLLYSALTRDP; NKEYLLYSALTRDPY; KEYLLYSALTRDPYH;
EYLLYSALTRDPYHT; YLLYSALTRDPYHTI; LLYSALTRDPYHTIE;
LYSALTRDPYHTIEE; YSALTRDPYHTIEES; SALTRDPYHTIEESI;
ALTRDPYHTIEESIQ; LTRDPYHTIEESIQG; TRDPYHTIEESIQGG;
RDPYHTIEESIQGGL; DPYHTIEESIQGGLK; PYHTIEESIQGGLKE;
YHTIEESIQGGLKEH; HTIEESIQGGLKEHD; TIEESIQGGLKEHDF;
IEESIQGGLKEHDFS; EESIQGGLKEHDFSP; ESIQGGLKEHDFSPE;
SIQGGLKEHDFSPEE; IQGGLKEHDFSPEEP; QGGLKEHDFSPEEPE;
GGLKEHDFSPEEPEE; GLKEHDFSPEEPEET; LKEHDFSPEEPEETK;
KEHDFSPEEPEETKQ; EHDFSPEEPEETKQV; HDFSPEEPEETKQVS;
DFSPEEPEETKQVSW; FSPEEPEETKQVSWK; SPEEPEETKQVSWKL;
PEEPEETKQVSWKLI; EEPEETKQVSWKLIT; EPEETKQVSWKLITE;
PEETKQVSWKLITEY; EETKQVSWKLITEYA; ETKQVSWKLITEYAV;
TKQVSWKLITEYAVE; KQVSWKLITEYAVET; QVSWKLITEYAVETK;
VSWKLITEYAVETKC; SWKLITEYAVETKCE; WKLITEYAVETKCED;
KLITEYAVETKCEDV; LITEYAVETKCEDVF; ITEYAVETKCEDVFL;
TEYAVETKCEDVFLL; EYAVETKCEDVFLLL; YAVETKCEDVFLLLG;
AVETKCEDVFLLLGM; VETKCEDVFLLLGMY; ETKCEDVFLLLGMYL;
TKCEDVFLLLGMYLE; KCEDVFLLLGMYLEF; CEDVFLLLGMYLEFQ;
EDVFLLLGMYLEFQY; DVFLLLGMYLEFQYN; VFLLLGMYLEFQYNV;
FLLLGMYLEFQYNVE; LLLGMYLEFQYNVEE; LLGMYLEFQYNVEEC;
LGMYLEFQYNVEECK; GMYLEFQYNVEECKK; MYLEFQYNVEECKKC;
YLEFQYNVEECKKCQ; LEFQYNVEECKKCQK; EFQYNVEECKKCQKK;
FQYNVEECKKCQKKD; QYNVEECKKCQKKDQ; YNVEECKKCQKKDQP;
NVEECKKCQKKDQPY; VEECKKCQKKDQPYH; EECKKCQKKDQPYHF;
ECKKCQKKDQPYHFK; CKKCQKKDQPYHFKY; KKCQKKDQPYHFKYH;
KCQKKDQPYHFKYHE; CQKKDQPYHFKYHEK; QKKDQPYHFKYHEKH;
KKDQPYHFKYHEKHF; KDQPYHFKYHEKHFA; DQPYHFKYHEKHFAN;
QPYHFKYHEKHFANA; PYHFKYHEKHFANAI; YHFKYHEKHFANAII;
HFKYHEKHFANAIIF; FKYHEKHFANAIIFA; KYHEKHFANAIIFAE;
YHEKHFANAIIFAES; HEKHFANAIIFAESK; EKHFANAIIFAESKN;
KHFANAIIFAESKNQ; HFANAIIFAESKNQS; FANAIIFAESKNQSI;
ANAIIFAESKNQSIC; NAIIFAESKNQSICQ; AIIFAESKNQSICQQ;
IIFAESKNQSICQQQ; IFAESKNQSICQQA; FAESKNQSICQQAV;
AESKNQSICQQAVD; ESKNQSICQQAVDT; SKNQSICQQAVDTV;
KNQSICQQAVDTVL; NQSICQQAVDTVLA; QSICQQAVDTVLAK;
KSICQQAVDTVLAKK; SICQQAVDTVLAKKR; ICQQAVDTVLAKKRV;
CQQAVDTVLAKKRVD; QQAVDTVLAKKRVDT; QAVDTVLAKKRVDTL;
AVDTVLAKKRVDTLH; VDTVLAKKRVDTLHM; DTVLAKKRVDTLHMT;
TVLAKKRVDTLHMTR; VLAKKRVDTLHMTRE; LAKKRVDTLHMTREE;
AKKRVDTLHMTREEM; KKRVDTLHMTREEML; KRVDTLHMTREEMLT;
RVDTLHMTREEMLTE; VDTLHMTREEMLTER; DTLHMTREEMLTERF;
TLHMTREEMLTERFN; LHMTREEMLTERFNH; HMTREEMLTERFNHI;
MTREEMLTERFNHIL; TREEMLTERFNHILD; REEMLTERFNHILDK;
EEMLTERFNHILDKM; EMLTERFNHILDKMD; MLTERFNHILDKMDL;
LTERFNHILDKMDLI; TERFNHILDKMDLIF; ERFNHILDKMDLIFG;
RFNHILDKMDLIFGA; FNHILDKMDLIFGAH; NHILDKMDLIFGAHG;
HILDKMDLIFGAHGN; ILDKMDLIFGAHGNA; LDKMDLIFGAHGNAV;
DKMDLIFGAHGNAVL; KMDLIFGAHGNAVLE; MDLIFGAHGNAVLEQ;
DLIFGAHGNAVLEQY; LIFGAHGNAVLEQYM; IFGAHGNAVLEQYMA;
FGAHGNAVLEQYMAG; GAHGNAVLEQYMAGV; AHGNAVLEQYMAGVA;
HGNAVLEQYMAGVAW; GNAVLEQYMAGVAWL; NAVLEQYMAGVAWLH;
AVLEQYMAGVAWLHC; VLEQYMAGVAWLHCL; LEQYMAGVAWLHCLL;
EQYMAGVAWLHCLLP; QYMAGVAWLHCLLPK; YMAGVAWLHCLLPKM;
MAGVAWLHCLLPKMD; AGVAWLHCLLPKMDS; GVAWLHCLLPKMDSV;
VAWLHCLLPKMDSVI; AWLHCLLPKMDSVIF; WLHCLLPKMDSVIFD;
LHCLLPKMDSVIFDF; HCLLPKMDSVIFDFL; CLLPKMDSVIFDFLH;
LLPKMDSVIFDFLHC; LPKMDSVIFDFLHCI; PKMDSVIFDFLHCIV;
KMDSVIFDFLHCIVF; MDSVIFDFLHCIVFN; DSVIFDFLHCIVFNV;
SVIFDFLHCIVFNVP; VIFDFLHCIVFNVPK; IFDFLHCIVFNVPKR;
FDFLHCIVFNVPKRR; DFLHCIVFNVPKRRY; FLHCIVFNVPKRRYW;
LHCIVFNVPKRRYWL; HCIVFNVPKRRYWLF; CIVFNVPKRRYWLFK;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

IVFNVPKRRYWLFKG; VFNVPKRRYWLFKGP; FNVPKRRYWLFKGPI;
NVPKRRYWLFKGPID; VPKRRYWLFKGPIDS; PKRRYWLFKGPIDSG;
KRRYWLFKGPIDSGK; RRYWLFKGPIDSGKT; RYWLFKGPIDSGKTT;
YWLFKGPIDSGKTTL; WLFKGPIDSGKTTLA; LFKGPIDSGKTTLAA;
FKGPIDSGKTTLAAG; KGPIDSGKTTLAAGL; GPIDSGKTTLAAGLL;
PIDSGKTTLAAGLLD; IDSGKTTLAAGLLDL; DSGKTTLAAGLLDLC;
SGKTTLAAGLLDLCG; GKTTLAAGLLDLCGG; KTTLAAGLLDLCGGK;
TTLAAGLLDLCGGKA; TLAAGLLDLCGGKAL; LAAGLLDLCGGKALN;
AAGLLDLCGGKALNV; AGLLDLCGGKALNVN; GLLDLCGGKALNVNL;
LLDLCGGKALNVNLP; LDLCGGKALNVNLPM; DLCGGKALNVNLPME;
LCGGKALNVNLPMER; CGGKALNVNLPMERL; GGKALNVNLPMERLT;
GKALNVNLPMERLTF; KALNVNLPMERLTFE; ALNVNLPMERLTFEL;
LNVNLPMERLTFELG; NVNLPMERLTFELGV; VNLPMERLTFELGVA;
NLPMERLTFELGVAI; LPMERLTFELGVAID; PMERLTFELGVAIDQ;
MERLTFELGVAIDQY; ERLTFELGVAIDQYM; RLTFELGVAIDQYMV;
LTFELGVAIDQYMVV; TFELGVAIDQYMVVF; FELGVAIDQYMVVFE;
ELGVAIDQYMVVFED; LGVAIDQYMVVFEDV; GVAIDQYMVVFEDVK;
VAIDQYMVVFEDVKG; AIDQYMVVFEDVKGT; IDQYMVVFEDVKGTG;
DQYMVVFEDVKGTGA; QYMVVFEDVKGTGAE; YMVVFEDVKGTGAES;
MVVFEDVKGTGAESK; VVFEDVKGTGAESKD; VFEDVKGTGAESKDL;
FEDVKGTGAESKDLP; EDVKGTGAESKDLPS; DVKGTGAESKDLPSG;
VKGTGAESKDLPSGH; KGTGAESKDLPSGHG; GTGAESKDLPSGHGI;
TGAESKDLPSGHGIN; GAESKDLPSGHGINN; AESKDLPSGHGINNL;
ESKDLPSGHGINNLD; SKDLPSGHGINNLDS; KDLPSGHGINNLDSL;
DLPSGHGINNLDSLR; LPSGHGINNLDSLRD; PSGHGINNLDSLRDY;
SGHGINNLDSLRDYL; GHGINNLDSLRDYLD; HGINNLDSLRDYLDG;
GINNLDSLRDYLDGS; INNLDSLRDYLDGSV; NNLDSLRDYLDGSVK;
NLDSLRDYLDGSVKV; LDSLRDYLDGSVKVN; DSLRDYLDGSVKVNL;
SLRDYLDGSVKVNLE; LRDYLDGSVKVNLEK; RDYLDGSVKVNLEKK;
DYLDGSVKVNLEKKH; YLDGSVKVNLEKKHL; LDGSVKVNLEKKHLN;
DGSVKVNLEKKHLNK; GSVKVNLEKKHLNKR; SVKVNLEKKHLNKRT;
VKVNLEKKHLNKRTQ; KVNLEKKHLNKRTQI; VNLEKKHLNKRTQIF;
NLEKKHLNKRTQIFP; LEKKHLNKRTQIFPP; EKKHLNKRTQIFPPG;
KKHLNKRTQIFPPGL; KHLNKRTQIFPPGLV; HLNKRTQIFPPGLVT;
LNKRTQIFPPGLVTM; NKRTQIFPPGLVTMN; KRTQIFPPGLVTMNE;
RTQIFPPGLVTMNEY; TQIFPPGLVTMNEYP; QIFPPGLVTMNEYPV;
IFPPGLVTMNEYPVP; FPPGLVTMNEYPVPK; PPGLVTMNEYPVPKT;
PGLVTMNEYPVPKTL; GLVTMNEYPVPKTLQ; LVTMNEYPVPKTLQA;
VTMNEYPVPKTLQAR; TMNEYPVPKTLQARF; MNEYPVPKTLQARFV;
NEYPVPKTLQARFVR; EYPVPKTLQARFVRQ; YPVPKTLQARFVRQI;
PVPKTLQARFVRQID; VPKTLQARFVRQIDF; PKTLQARFVRQIDFR;
KTLQARFVRQIDFRP; TLQARFVRQIDFRPK; LQARFVRQIDFRPKI;
QARFVRQIDFRPKIY; ARFVRQIDFRPKIYL; RFVRQIDFRPKIYLR;
FVRQIDFRPKIYLRK; VRQIDFRPKIYLRKS; RQIDFRPKIYLRKSL;
QIDFRPKIYLRKSLQ; IDFRPKIYLRKSLQN; DFRPKIYLRKSLQNS;
FRPKIYLRKSLQNSE; RPKIYLRKSLQNSEF; PKIYLRKSLQNSEFL;
KIYLRKSLQNSEFLL; IYLRKSLQNSEFLLE; YLRKSLQNSEFLLEK;
LRKSLQNSEFLLEKR; RKSLQNSEFLLEKRI; KSLQNSEFLLEKRIL;
SLQNSEFLLEKRILQ; LQNSEFLLEKRILQS; QNSEFLLEKRILQSG;
NSEFLLEKRILQSGM; SEFLLEKRILQSGMT; EFLLEKRILQSGMTL;
FLLEKRILQSGMTLL; LLEKRILQSGMTLLL; LEKRILQSGMTLLLL;
EKRILQSGMTLLLLL; KRILQSGMTLLLLLI; RILQSGMTLLLLLIW;
ILQSGMTLLLLLIWF; LQSGMTLLLLLIWFR; QSGMTLLLLLIWFRP;
SGMTLLLLLIWFRPV; GMTLLLLLIWFRPVA; MTLLLLLIWFRPVAD;
TLLLLLIWFRPVADF; LLLLLIWFRPVADFA; LLLLIWFRPVADFAT;
LLLIWFRPVADFATD; LLIWFRPVADFATDI; LIWFRPVADFATDIQ;
IWFRPVADFATDIQS; WFRPVADFATDIQSR; FRPVADFATDIQSRI;
RPVADFATDIQSRIV; PVADFATDIQSRIVE; VADFATDIQSRIVEW;
ADFATDIQSRIVEWK; DFATDIQSRIVEWKE; FATDIQSRIVEWKER;
ATDIQSRIVEWKERL; TDIQSRIVEWKERLD; DIQSRIVEWKERLDS;
IQSRIVEWKERLDSE; QSRIVEWKERLDSEI; SRIVEWKERLDSEIS;
RIVEWKERLDSEISM; IVEWKERLDSEISMY; VEWKERLDSEISMYT;
EWKERLDSEISMYTF; WKERLDSEISMYTFS; KERLDSEISMYTFSR;
ERLDSEISMYTFSRM; RLDSEISMYTFSRMK; LDSEISMYTFSRMKY;
DSEISMYTFSRMKYN; SEISMYTFSRMKYNI; EISMYTFSRMKYNIC;
ISMYTFSRMKYNICM; SMYTFSRMKYNICMG; MYTFSRMKYNICMGK;
YTFSRMKYNICMGKC; TFSRMKYNICMGKCI; FSRMKYNICMGKCIL;
SRMKYNICMGKCILD; RMKYNICMGKCILDI; MKYNICMGKCILDIT;
KYNICMGKCILDITR; YNICMGKCILDITRE; NICMGKCILDITREE;
ICMGKCILDITREED; CMGKCILDITREEDS; MGKCILDITREEDSE;
GKCILDITREEDSET; KCILDITREEDSETE; CILDITREEDSETED;
ILDITREEDSETEDS; LDITREEDSETEDSG; DITREEDSETEDSGH;
ITREEDSETEDSGHG; TREEDSETEDSGHGS; REEDSETEDSGHGSS;
EEDSETEDSGHGSST; EDSETEDSGHGSSTE; DSETEDSGHGSSTES;
SETEDSGHGSSTESQ; ETEDSGHGSSTESQS; TEDSGHGSSTESQSQ;
EDSGHGSSTESQSQC; DSGHGSSTESQSQCS; SGHGSSTESQSQCSS;
GHGSSTESQSQCSSQ; HGSSTESQSQCSSQV; GSSTESQSQCSSQVS;
SSTESQSQCSSQVSD; STESQSQCSSQVSDT; TESQSQCSSQVSDTS;
ESQSQCSSQVSDTSA; SQSQCSSQVSDTSAP; QSQCSSQVSDTSAPA;
SQCSSQVSDTSAPAE; QCSSQVSDTSAPAED; CSSQVSDTSAPAEDS;
SSQVSDTSAPAEDSQ; SQVSDTSAPAEDSQR; QVSDTSAPAEDSQRS;
VSDTSAPAEDSQRSD; SDTSAPAEDSQRSDP; DTSAPAEDSQRSDPH;
TSAPAEDSQRSDPHS; SAPAEDSQRSDPHSQ; APAEDSQRSDPHSQE;
PAEDSQRSDPHSQEL; AEDSQRSDPHSQELH; EDSQRSDPHSQELHL;
DSQRSDPHSQELHLC; SQRSDPHSQELHLCK; QRSDPHSQELHLCKG;
RSDPHSQELHLCKGF; SDPHSQELHLCKGFQ; DPHSQELHLCKGFQC;
PHSQELHLCKGFQCF; HSQELHLCKGFQCFK; SQELHLCKGFQCFKR;
QELHLCKGFQCFKRP; ELHLCKGFQCFKRPK; LHLCKGFQCFKRPKT;
HLCKGFQCFKRPKTP; LCKGFQCFKRPKTPP; CKGFQCFKRPKTPPP;
KGFQCFKRPKTPPPK; MYMYNKSTCLKHFGL; YMYNKSTCLKHFGLQ;
MYNKSTCLKHFGLQL; YNKSTCLKHFGLQLS; NKSTCLKHFGLQLSL;
KSTCLKHFGLQLSLF; STCLKHFGLQLSLFV; TCLKHFGLQLSLFVN;
CLKHFGLQLSLFVNI; LKHFGLQLSLFVNIS; KHFGLQLSLFVNISY;
HFGLQLSLFVNISYH; FGLQLSLFVNISYHI; GLQLSLFVNISYHIW;
LQLSLFVNISYHIWV; QLSLFVNISYHIWVP; LSLFVNISYHIWVPW;
SLFVNISYHIWVPWK; LFVNISYHIWVPWKS; FVNISYHIWVPWKSF;
VNISYHIWVPWKSFC; NISYHIWVPWKSFCA; ISYHIWVPWKSFCAI;
SYHIWVPWKSFCAIK; YHIWVPWKSFCAIKH; HIWVPWKSFCAIKHP;
IWVPWKSFCAIKHPN; WVPWKSFCAIKHPNL; VPWKSFCAIKHPNLF;
PWKSFCAIKHPNLFY; WKSFCAIKHPNLFYL; KSFCAIKHPNLFYLG;
SFCAIKHPNLFYLGF; FCAIKHPNLFYLGFH; CAIKHPNLFYLGFHT;
AIKHPNLFYLGFHTI; IKHPNLFYLGFHTIH; KHPNLFYLGFHTIHR;
HPNLFYLGFHTIHRL; PNLFYLGFHTIHRLP; NLFYLGFHTIHRLPI;
LFYLGFHTIHRLPIH; FYLGFHTIHRLPIHS; YLGFHTIHRLPIHSL;
LGFHTIHRLPIHSLG; GFHTIHRLPIHSLGS; FHTIHRLPIHSLGSP;
HTIHRLPIHSLGSPV; TIHRLPIHSLGSPVY; IHRLPIHSLGSPVYK;
HRLPIHSLGSPVYKV; RLPIHSLGSPVYKVT; QKGNWVRILYRSFSQ;
KGNWVRILYRSFSQA; GNWVRILYRSFSQAD; NWVRILYRSFSQADL;
WVRILYRSFSQADLK; VRILYRSFSQADLKI; RILYRSFSQADLKIS;
ILYRSFSQADLKISC; LYRSFSQADLKISCK; YRSFSQADLKISCKA;
RSFSQADLKISCKAS; SFSQADLKISCKASP; FSQADLKISCKASPL;
SQADLKISCKASPLL; QADLKISCKASPLLC; ADLKISCKASPLLCS;
DLKISCKASPLLCSR; LKISCKASPLLCSRA; KISCKASPLLCSRAV;
ISCKASPLLCSRAVS; SCKASPLLCSRAVSK; CKASPLLCSRAVSKQ;
KASPLLCSRAVSKQA; ASPLLCSRAVSKQAT; SPLLCSRAVSKQATN;
PLLCSRAVSKQATNI; LLCSRAVSKQATNIS; LCSRAVSKQATNISS;
NIQAISFTKRPHTLF; IQAISFTKRPHTLFI; QHCGSCVGHMKYWGN;
HCGSCVGHMKYWGNI; CGSCVGHMKYWGNIF; GSCVGHMKYWGNIFP;
SCVGHMKYWGNIFPS; CVGHMKYWGNIFPSC; VGHMKYWGNIFPSCE;
GHMKYWGNIFPSCES; HMKYWGNIFPSCESP; MKYWGNIFPSCESPK;
KYWGNIFPSCESPKI; YWGNIFPSCESPKIP; WGNIFPSCESPKIPS;
GNIFPSCESPKIPSI; NIFPSCESPKIPSIF; IFPSCESPKIPSIFI;
FPSCESPKIPSIFIS; PSCESPKIPSIFIST; SCESPKIPSIFISTG;
CESPKIPSIFISTGI; ESPKIPSIFISTGIR; SPKIPSIFISTGIRY;
PKIPSIFISTGIRYP; KIPSIFISTGIRYPA; IPSIFISTGIRYPAL;
PSIFISTGIRYPALN; SIFISTGIRYPALNW; IFISTGIRYPALNWI;
FISTGIRYPALNWIS; ISTGIRYPALNWISI; STGIRYPALNWISIV;
TGIRYPALNWISIVF; GIRYPALNWISIVFV; IRYPALNWISIVFVQ;
RYPALNWISIVFVQI; YPALNWISIVFVQIG; PALNWISIVFVQIGL;
ALNWISIVFVQIGLM; LNWISIVFVQIGLMV; NWISIVFVQIGLMVS;
WISIVFVQIGLMVSI; ISIVFVQIGLMVSIH; SIVFVQIGLMVSIHY;
IVFVQIGLMVSIHYL; VFVQIGLMVSIHYLG; FVQIGLMVSIHYLGL;
VQIGLMVSIHYLGLG; QIGLMVSIHYLGLGC; IGLMVSIHYLGLGCW;
GLMVSIHYLGLGCWV; LMVSIHYLGLGCWVF; MVSIHYLGLGCWVFR;
VSIHYLGLGCWVFRG; SIHYLGLGCWVFRGY; IHYLGLGCWVFRGYS;
HYLGLGCWVFRGYST; YLGLGCWVFRGYSTI; LGLGCWVFRGYSTIR;
GLGCWVFRGYSTIRV; LGCWVFRGYSTIRVL; HSLHFQGFSTYSKEV;
SLHFQGFSTYSKEVE; LHFQGFSTYSKEVEI; HFQGFSTYSKEVEIT;
FQGFSTYSKEVEITA; QGFSTYSKEVEITAL; GFSTYSKEVEITALN;
FSTYSKEVEITALNR; STYSKEVEITALNRF; TYSKEVEITALNRFS;
YSKEVEITALNRFSS; SKEVEITALNRFSST; KEVEITALNRFSSTM;
EVEITALNRFSSTML; VEITALNRFSSTMLM; EITALNRFSSTMLMH;
ITALNRFSSTMLMHF; TALNRFSSTMLMHFL; PCMKVKHASYSNNLC;
CMKVKHASYSNNLCL; MKVKHASYSNNLCLY; KVKHASYSNNLCLYS;
VKHASYSNNLCLYSY; KHASYSNNLCLYSYS; HASYSNNLCLYSYSL;
ASYSNNLCLYSYSLP; SYSNNLCLYSYSLPH; YSNNLCLYSYSLPHQ;
IGEGNSCCAVTGKHF; GEGNSCCAVTGKHFS; EGNSCCAVTGKHFSL;
GNSCCAVTGKHFSLW; NSCCAVTGKHFSLWA; SCCAVTGKHFSLWAI;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

CCAVTGKHFSLWAIT; CAVTGKHFSLWAITA; AVTGKHFSLWAITAK;
VTGKHFSLWAITAKV; TGKHFSLWAITAKVI; GKHFSLWAITAKVIF;
KHFSLWAITAKVIFS; HFSLWAITAKVIFST; TKAPKVFIWIPHFWV;
EAFYLCNSIYPSFNF; FWHLHGFLWLFGSCP; WHLHGFLWLFGSCPW;
HLHGFLWLFGSCPWT; LHGFLWLFGSCPWTL; HGFLWLFGSCPWTLS;
GFLWLFGSCPWTLSF; FLWLFGSCPWTLSFS; LWLFGSCPWTLSFSF;
WLFGSCPWTLSFSFG; LFGSCPWTLSFSFGW; FGSCPWTLSFSFGWG;
GSCPWTLSFSFGWGH; SCPWTLSFSFGWGHL; CPWTLSFSFGWGHLH;
PWTLSFSFGWGHLHM; WTLSFSFGWGHLHML; TLSFSFGWGHLHMLQ;
LSFSFGWGHLHMLQE; SFSFGWGHLHMLQEQ; FSFGWGHLHMLQEQV;
SFGWGHLHMLQEQVL; FGWGHLHMLQEQVLQ; GWGHLHMLQEQVLQS;
WGHLHMLQEQVLQSR; GHLHMLQEQVLQSRT; HLHMLQEQVLQSRTG;
LHMLQEQVLQSRTGL; HMLQEQVLQSRTGLE; MLQEQVLQSRTGLEV;
LQEQVLQSRTGLEVK; QEQVLQSRTGLEVKA; EQVLQSRTGLEVKAT;
QVLQSRTGLEVKATS; VLQSRTGLEVKATSI; LQSRTGLEVKATSIE;
QSRTGLEVKATSIEE; SRTGLEVKATSIEEQ; RTGLEVKATSIEEQF;
TGLEVKATSIEEQFF; GLEVKATSIEEQFFD; TLLNVHFVDFLSPFF;
LLNVHFVDFLSPFFV; LLLYCQHHLYYKYGQ; LLYCQHHLYYKYGQN;
LYCQHHLYYKYGQNV; YCQHHLYYKYGQNVH; CQHHLYYKYGQNVHG;
QHHLYYKYGQNVHGY; HHLYYKYGQNVHGYL; HLYYKYGQNVHGYLP;
LYYKYGQNVHGYLPF; YYKYGQNVHGYLPFQ; YKYGQNVHGYLPFQL;
KYGQNVHGYLPFQLL; YGQNVHGYLPFQLLV; GKDQNNIVEYNYKSL;
QKYLHQETEYHSTHL; KYLHQETEYHSTHLG; TIPKPCLIADRGLQW;
IPKPCLIADRGLQWK; PKPCLIADRGLQWKL; KPCLIADRGLQWKLC;
PCLIADRGLQWKLCD; CLIADRGLQWKLCDP; LIADRGLQWKLCDPN;
IADRGLQWKLCDPNH; ADRGLQWKLCDPNHQ; DRGLQWKLCDPNHQR;
RGLQWKLCDPNHQRT; GLQWKLCDPNHQRTY; LQWKLCDPNHQRTYT;
QWKLCDPNHQRTYTL; WKLCDPNHQRTYTLL; KLCDPNHQRTYTLLE;
LCDPNHQRTYTLLEL; CDPNHQRTYTLLELR; DPNHQRTYTLLELRN;
PQEHQQLQHMFEELG; QEHQQLQHMFEELGL; QQQPPQQQFQPLKIL;
QQPPQQQFQPLKILW; QPPQQQFQPLKILWQ; PPQQQFQPLKILWQQ;
PQQQFQPLKILWQQQ; QQQFQPLKILWQQQP; QQFQPLKILWQQQPQ;
QFQPLKILWQQQPQI; FQPLKILWQQQPQIH; QPLKILWQQQPQIHW;
PLKILWQQQPQIHWQ; LKILWQQQPQIHWQL; KILWQQQPQIHWQLG;
ILWQQQPQIHWQLGP; LWQQQPQIHWQLGPP; WQQQPQIHWQLGPPK;
QQQPQIHWQLGPPKV; QQPQIHWQLGPPKVL; QPQIHWQLGPPKVLE;
PQIHWQLGPPKVLEQ; QIHWQLGPPKVLEQH; IHWQLGPPKVLEQHP;
TWKYKKKGITYLGVF; WKYKKKGITYLGVFY; KYKKKGITYLGVFYR;
YKKKGITYLGVFYRV; KKKGITYLGVFYRVF; KKGITYLGVFYRVFY;
KGITYLGVFYRVFYS; GITYLGVFYRVFYSR; SSGTFVFPVYTVFTS;
SGTFVFPVYTVFTST; GTFVFPVYTVFTSTK; TFVFPVYTVFTSTKF;
FVFPVYTVFTSTKFQ; VFPVYTVFTSTKFQQ; FPVYTVFTSTKFQQK;
PVYTVFTSTKFQQKL; NKNKNPLSSFFCSSP; KNKNPLSSFFCSSPG;
NKNPLSSFFCSSPGF; KNPLSSFFCSSPGFT; NPLSSFFCSSPGFTN;
PLSSFFCSSPGFTNF; LSSFFCSSPGFTNFH; LGTRPRFLGSQNMSV;
GTRPRFLGSQNMSVM; TRPRFLGSQNMSVMH; RPRFLGSQNMSVMHF;
PRFLGSQNMSVMHFP; RFLGSQNMSVMHFPS; AAPPCESCTFLPEVM;
APPCESCTFLPEVMV; PPCESCTFLPEVMVW; PCESCTFLPEVMVWL;
CESCTFLPEVMVWLH; ESCTFLPEVMVWLHS; SCTFLPEVMVWLHSP;
CTFLPEVMVWLHSPV; TFLPEVMVWLHSPVS; FLPEVMVWLHSPVSH;
LPEVMVWLHSPVSHA; PEVMVWLHSPVSHAL; EVMVWLHSPVSHALS;
VMVWLHSPVSHALSF; MVWLHSPVSHALSFL; VWLHSPVSHALSFLR;
WLHSPVSHALSFLRS; LHSPVSHALSFLRSW; HSPVSHALSFLRSWF;
SPVSHALSFLRSWFG; PVSHALSFLRSWFGC; VSHALSFLRSWFGCI;
SHALSFLRSWFGCIP; HALSFLRSWFGCIPW; ALSFLRSWFGCIPWV;
LSFLRSWFGCIPWVS; SFLRSWFGCIPWVSS; FLRSWFGCIPWVSSS;
LRSWFGCIPWVSSSS; RSWFGCIPWVSSSSL; SWFGCIPWVSSSSLW;
WFGCIPWVSSSSLWP; FGCIPWVSSSSLWPF; GCIPWVSSSSLWPFF;
CIPWVSSSSLWPFFL; YIRGRGRLCLHPFSQ; IRGRGRLCLHPFSQV;
RGRGRLCLHPFSQVV; GRGRLCLHPFSQVVR; RGRLCLHPFSQVVRV;
GRLCLHPFSQVVRVW; RLCLHPFSQVVRVWR; LCLHPFSQVVRVWRL;
CLHPFSQVVRVWRLF; LHPFSQVVRVWRLFL; HPFSQVVRVWRLFLR;
PFSQVVRVWRLFLRP; FSQVVRVWRLFLRPS; SQVVRVWRLFLRPSK;
QVVRVWRLFLRPSKT; VVRVWRLFLRPSKTI; VRVWRLFLRPSKTIW;
RVWRLFLRPSKTIWG; VWRLFLRPSKTIWGN; WRLFLRPSKTIWGNP;
RLFLRPSKTIWGNPY; LFLRPSKTIWGNPYS; FLRPSKTIWGNPYSF;
LRPSKTIWGNPYSFA; RPSKTIWGNPYSFAI; PSKTIWGNPYSFAIF;
SKTIWGNPYSFAIFA; KTIWGNPYSFAIFAK

16 mers:

KSCLGKSSLNEKSLFK; SCLGKSSLNEKSLFKE;
CLGKSSLNEKSLFKEV; FSSLPRYPVLQGMAYL;
SSLPRYPVLQGMAYLF; SLPRYPVLQGMAYLFQ;
LPRYPVLQGMAYLFQK; PRYPVLQGMAYLFQKA;
RYPVLQGMAYLFQKAF; YPVLQGMAYLFQKAFC;
PVLQGMAYLFQKAFCA; VLQGMAYLFQKAFCAL;
LQGMAYLFQKAFCALP; QGMAYLFQKAFCALPL;
GMAYLFQKAFCALPLH; MAYLFQKAFCALPLHA;
AYLFQKAFCALPLHAM; YLFQKAFCALPLHAMS;
LFQKAFCALPLHAMSA; KIFKKRALGLDRLLLH;
RNSAMVGPNNWRNSLQ; NSAMVGPNNWRNSLQR;
SAMVGPNNWRNSLQRS; AMVGPNNWRNSLQRSK;
MVGPNNWRNSLQRSKA; VGPNNWRNSLQRSKAL;
GPNNWRNSLQRSKALR; VPTYGTEEWESWWSSF;
PTYGTEEWESWWSSFN; TYGTEEWESWWSSFNE;
YGTEEWESWWSSFNEK; GTEEWESWWSSFNEKW;
TEEWESWWSSFNEKWD; EEWESWWSSFNEKWDE;
EWESWWSSFNEKWDED; WESWWSSFNEKWDEDL;
ESWWSSFNEKWDEDLF; SWWSSFNEKWDEDLFC;
WWSSFNEKWDEDLFCH; WSSFNEKWDEDLFCHE;
SSFNEKWDEDLFCHED; SFNEKWDEDLFCHEDM;
FNEKWDEDLFCHEDMF; NEKWDEDLFCHEDMFA;
EKWDEDLFCHEDMFAS; KWDEDLFCHEDMFASD;
WDEDLFCHEDMFASDE; DEDLFCHEDMFASDEE;
EDLFCHEDMFASDEEA; DLFCHEDMFASDEEAT;
LFCHEDMFASDEEATA; FCHEDMFASDEEATAD;
CHEDMFASDEEATADS; HEDMFASDEEATADSQ;
EDMFASDEEATADSQH; DMFASDEEATADSQHS;
MFASDEEATADSQHST; FASDEEATADSQHSTP;
ASDEEATADSQHSTPP; SDEEATADSQHSTPPK;
DEEATADSQHSTPPKK; EEATADSQHSTPPKKK;
EATADSQHSTPPKKKR; ATADSQHSTPPKKKRK;
TADSQHSTPPKKKRKV; ADSQHSTPPKKKRKVE;
DSQHSTPPKKKRKVED; SQHSTPPKKKRKVEDP;
QHSTPPKKKRKVEDPK; HSTPPKKKRKVEDPKD;
STPPKKKRKVEDPKDF; TPPKKKRKVEDPKDFP;
PPKKKRKVEDPKDFPS; PKKKRKVEDPKDFPSD;
KKKRKVEDPKDFPSDL; KKRKVEDPKDFPSDLH;
KRKVEDPKDFPSDLHQ; RKVEDPKDFPSDLHQF;
KVEDPKDFPSDLHQFL; VEDPKDFPSDLHQFLS;
EDPKDFPSDLHQFLSQ; DPKDFPSDLHQFLSQA;
PKDFPSDLHQFLSQAV; KDFPSDLHQFLSQAVF;
DFPSDLHQFLSQAVFS; FPSDLHQFLSQAVFSN;
PSDLHQFLSQAVFSNR; SDLHQFLSQAVFSNRT;
DLHQFLSQAVFSNRTL; LHQFLSQAVFSNRTLA;
HQFLSQAVFSNRTLAC; QFLSQAVFSNRTLACF;
FLSQAVFSNRTLACFA; LSQAVFSNRTLACFAV;
SQAVFSNRTLACFAVY; QAVFSNRTLACFAVYT;
AVFSNRTLACFAVYTT; VFSNRTLACFAVYTTK;
FSNRTLACFAVYTTKE; SNRTLACFAVYTTKEK;
NRTLACFAVYTTKEKA; RTLACFAVYTTKEKAQ;
TLACFAVYTTKEKAQI; LACFAVYTTKEKAQIL;
ACFAVYTTKEKAQILY; CFAVYTTKEKAQILYK;
FAVYTTKEKAQILYKK; AVYTTKEKAQILYKKL;
VYTTKEKAQILYKKLM; YTTKEKAQILYKKLME;
TTKEKAQILYKKLMEK; TKEKAQILYKKLMEKY;
KEKAQILYKKLMEKYS; EKAQILYKKLMEKYSV;
KAQILYKKLMEKYSVT; AQILYKKLMEKYSVTF;
QILYKKLMEKYSVTFI; ILYKKLMEKYSVTFIS;
LYKKLMEKYSVTFISR; YKKLMEKYSVTFISRH;
KKLMEKYSVTFISRHM; KLMEKYSVTFISRHMC;
LMEKYSVTFISRHMCA; MEKYSVTFISRHMCAG;
EKYSVTFISRHMCAGH; KYSVTFISRHMCAGHN;
YSVTFISRHMCAGHNI; SVTFISRHMCAGHNII;
VTFISRHMCAGHNIIF; TFISRHMCAGHNIIFF;
FISRHMCAGHNIIFFL; ISRHMCAGHNIIFFLT;
SRHMCAGHNIIFFLTP; RHMCAGHNIIFFLTPH;
HMCAGHNIIFFLTPHR; MCAGHNIIFFLTPHRH;
CAGHNIIFFLTPHRHR; AGHNIIFFLTPHRHRV;
GHNIIFFLTPHRHRVS; HNIIFFLTPHRHRVSA;
NIIFFLTPHRHRVSAI; IIFFLTPHRHRVSAIN;
IFFLTPHRHRVSAINN; FFLTPHRHRVSAINNF;
FLTPHRHRVSAINNFC; LTPHRHRVSAINNFCQ;
TPHRHRVSAINNFCQK; PHRHRVSAINNFCQKL;
HRHRVSAINNFCQKLC; RHRVSAINNFCQKLCT;
HRVSAINNFCQKLCTF; RVSAINNFCQKLCTFS;
VSAINNFCQKLCTFSF; SAINNFCQKLCTFSFL;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

AINNFCQKLCTFSFLI; INNFCQKLCTFSFLIC;
NNFCQKLCTFSFLICK; NFCQKLCTFSFLICKG;
FCQKLCTFSFLICKGV; CQKLCTFSFLICKGVN;
QKLCTFSFLICKGVNK; KLCTFSFLICKGVNKE;
LCTFSFLICKGVNKEY; CTFSFLICKGVNKEYL;
TFSFLICKGVNKEYLL; FSFLICKGVNKEYLLY;
SFLICKGVNKEYLLYS; FLICKGVNKEYLLYSA;
LICKGVNKEYLLYSAL; ICKGVNKEYLLYSALT;
CKGVNKEYLLYSALTR; KGVNKEYLLYSALTRD;
GVNKEYLLYSALTRDP; VNKEYLLYSALTRDPY;
NKEYLLYSALTRDPYH; KEYLLYSALTRDPYHT;
EYLLYSALTRDPYHTI; YLLYSALTRDPYHTIE;
LLYSALTRDPYHTIEE; LYSALTRDPYHTIEES;
YSALTRDPYHTIEESI; SALTRDPYHTIEESIQ;
ALTRDPYHTIEESIQG; LTRDPYHTIEESIQGG;
TRDPYHTIEESIQGGL; RDPYHTIEESIQGGLK;
DPYHTIEESIQGGLKE; PYHTIEESIQGGLKEH;
YHTIEESIQGGLKEHD; HTIEESIQGGLKEHDF;
TIEESIQGGLKEHDFS; IEESIQGGLKEHDFSP;
EESIQGGLKEHDFSPE; ESIQGGLKEHDFSPEE;
SIQGGLKEHDFSPEEP; IQGGLKEHDFSPEEPE;
QGGLKEHDFSPEEPEE; GGLKEHDFSPEEPEET;
GLKEHDFSPEEPEETK; LKEHDFSPEEPEETKQ;
KEHDFSPEEPEETKQV; EHDFSPEEPEETKQVS;
HDFSPEEPEETKQVSW; DFSPEEPEETKQVSWK;
FSPEEPEETKQVSWKL; SPEEPEETKQVSWKLI;
PEEPEETKQVSWKLIT; EEPEETKQVSWKLITE;
EPEETKQVSWKLITEY; PEETKQVSWKLITEYA;
EETKQVSWKLITEYAV; ETKQVSWKLITEYAVE;
TKQVSWKLITEYAVET; KQVSWKLITEYAVETK;
QVSWKLITEYAVETKC; VSWKLITEYAVETKCE;
SWKLITEYAVETKCED; WKLITEYAVETKCEDV;
KLITEYAVETKCEDVF; LITEYAVETKCEDVFL;
ITEYAVETKCEDVFLL; TEYAVETKCEDVFLLL;
EYAVETKCEDVFLLLG; YAVETKCEDVFLLLGM;
AVETKCEDVFLLLGMY; VETKCEDVFLLLGMYL;
ETKCEDVFLLLGMYLE; TKCEDVFLLLGMYLEF;
KCEDVFLLLGMYLEFQ; CEDVFLLLGMYLEFQY;
EDVFLLLGMYLEFQYN; DVFLLLGMYLEFQYNV;
VFLLLGMYLEFQYNVE; FLLLGMYLEFQYNVEE;
LLLGMYLEFQYNVEEC; LLGMYLEFQYNVEECK;
LGMYLEFQYNVEECKK; GMYLEFQYNVEECKKC;
MYLEFQYNVEECKKCQ; YLEFQYNVEECKKCQK;
LEFQYNVEECKKCQKK; EFQYNVEECKKCQKKD;
FQYNVEECKKCQKKDQ; QYNVEECKKCQKKDQP;
YNVEECKKCQKKDQPY; NVEECKKCQKKDQPYH;
VEECKKCQKKDQPYHF; EECKKCQKKDQPYHFK;
ECKKCQKKDQPYHFKY; CKKCQKKDQPYHFKYH;
KKCQKKDQPYHFKYHE; KCQKKDQPYHFKYHEK;
CQKKDQPYHFKYHEKH; QKKDQPYHFKYHEKHF;
KKDQPYHFKYHEKHFA; KDQPYHFKYHEKHFAN;
DQPYHFKYHEKHFANA; QPYHFKYHEKHFANAI;
PYHFKYHEKHFANAII; YHFKYHEKHFANAIIF;
HFKYHEKHFANAIIFA; FKYHEKHFANAIIFAE;
KYHEKHFANAIIFAES; YHEKHFANAIIFAESK;
HEKHFANAIIFAESKN; EKHFANAIIFAESKNQ;
KHFANAIIFAESKNQK; HFANAIIFAESKNQKS;
FANAIIFAESKNQKSI; ANAIIFAESKNQKSIC;
NAIIFAESKNQKSICQ; AIIFAESKNQKSICQQ;
IIFAESKNQKSICQQA; IFAESKNQKSICQQAV;
FAESKNQKSICQQAVD; AESKNQKSICQQAVDT;
ESKNQKSICQQAVDTV; SKNQKSICQQAVDTVL;
KNQKSICQQAVDTVLA; NQKSICQQAVDTVLAK;
QKSICQQAVDTVLAKK; KSICQQAVDTVLAKKR;
SICQQAVDTVLAKKRV; ICQQAVDTVLAKKRVD;
CQQAVDTVLAKKRVDT; QQAVDTVLAKKRVDTL;
QAVDTVLAKKRVDTLH; AVDTVLAKKRVDTLHM;
VDTVLAKKRVDTLHMT; DTVLAKKRVDTLHMTR;
TVLAKKRVDTLHMTRE; VLAKKRVDTLHMTREE;
LAKKRVDTLHMTREEM; AKKRVDTLHMTREEML;
KKRVDTLHMTREEMLT; KRVDTLHMTREEMLTE;
RVDTLHMTREEMLTER; VDTLHMTREEMLTERF;
DTLHMTREEMLTERFN; TLHMTREEMLTERFNH;
LHMTREEMLTERFNHI; HMTREEMLTERFNHIL;
MTREEMLTERFNHILD; TREEMLTERFNHILDK;
REEMLTERFNHILDKM; EEMLTERFNHILDKMD;
EMLTERFNHILDKMDL; MLTERFNHILDKMDLI;
LTERFNHILDKMDLIF; TERFNHILDKMDLIFG;
ERFNHILDKMDLIFGA; RFNHILDKMDLIFGAH;
FNHILDKMDLIFGAHG; NHILDKMDLIFGAHGN;
HILDKMDLIFGAHGNA; ILDKMDLIFGAHGNAV;
LDKMDLIFGAHGNAVL; DKMDLIFGAHGNAVLE;
KMDLIFGAHGNAVLEQ; MDLIFGAHGNAVLEQY;
DLIFGAHGNAVLEQYM; LIFGAHGNAVLEQYMA;
IFGAHGNAVLEQYMAG; FGAHGNAVLEQYMAGV;
GAHGNAVLEQYMAGVA; AHGNAVLEQYMAGVAW;
HGNAVLEQYMAGVAWL; GNAVLEQYMAGVAWLH;
NAVLEQYMAGVAWLHC; AVLEQYMAGVAWLHCL;
VLEQYMAGVAWLHCLL; LEQYMAGVAWLHCLLP;
EQYMAGVAWLHCLLPK; QYMAGVAWLHCLLPKM;
YMAGVAWLHCLLPKMD; MAGVAWLHCLLPKMDS;
AGVAWLHCLLPKMDSV; GVAWLHCLLPKMDSVI;
VAWLHCLLPKMDSVIF; AWLHCLLPKMDSVIFD;
WLHCLLPKMDSVIFDF; LHCLLPKMDSVIFDFL;
HCLLPKMDSVIFDFLH; CLLPKMDSVIFDFLHC;
LLPKMDSVIFDFLHCI; LPKMDSVIFDFLHCIV;
PKMDSVIFDFLHCIVF; KMDSVIFDFLHCIVFN;
MDSVIFDFLHCIVFNV; DSVIFDFLHCIVFNVP;
SVIFDFLHCIVFNVPK; VIFDFLHCIVFNVPKR;
IFDFLHCIVFNVPKRR; FDFLHCIVFNVPKRRY;
DFLHCIVFNVPKRRYW; FLHCIVFNVPKRRYWL;
LHCIVFNVPKRRYWLF; HCIVFNVPKRRYWLFK;
CIVFNVPKRRYWLFKG; IVFNVPKRRYWLFKGP;
VFNVPKRRYWLFKGPI; FNVPKRRYWLFKGPID;
NVPKRRYWLFKGPIDS; VPKRRYWLFKGPIDSG;
PKRRYWLFKGPIDSGK; KRRYWLFKGPIDSGKT;
RRYWLFKGPIDSGKTT; RYWLFKGPIDSGKTTL;
YWLFKGPIDSGKTTLA; WLFKGPIDSGKTTLAA;
LFKGPIDSGKTTLAAG; FKGPIDSGKTTLAAGL;
KGPIDSGKTTLAAGLL; GPIDSGKTTLAAGLLD;
PIDSGKTTLAAGLLDL; IDSGKTTLAAGLLDLC;
DSGKTTLAAGLLDLCG; SGKTTLAAGLLDLCGG;
GKTTLAAGLLDLCGGK; KTTLAAGLLDLCGGKA;
TTLAAGLLDLCGGKAL; TLAAGLLDLCGGKALN;
LAAGLLDLCGGKALNV; AAGLLDLCGGKALNVN;
AGLLDLCGGKALNVNL; GLLDLCGGKALNVNLP;
LLDLCGGKALNVNLPM; LDLCGGKALNVNLPME;
DLCGGKALNVNLPMER; LCGGKALNVNLPMERL;
CGGKALNVNLPMERLT; GGKALNVNLPMERLTF;
GKALNVNLPMERLTFE; KALNVNLPMERLTFEL;
ALNVNLPMERLTFELG; LNVNLPMERLTFELGV;
NVNLPMERLTFELGVA; VNLPMERLTFELGVAI;
NLPMERLTFELGVAID; LPMERLTFELGVAIDQ;
PMERLTFELGVAIDQY; MERLTFELGVAIDQYM;
ERLTFELGVAIDQYMV; RLTFELGVAIDQYMVV;
LTFELGVAIDQYMVVF; TFELGVAIDQYMVVFE;
FELGVAIDQYMVVFED; ELGVAIDQYMVVFEDV;
LGVAIDQYMVVFEDVK; GVAIDQYMVVFEDVKG;
VAIDQYMVVFEDVKGT; AIDQYMVVFEDVKGTG;
IDQYMVVFEDVKGTGA; DQYMVVFEDVKGTGAE;
QYMVVFEDVKGTGAES; YMVVFEDVKGTGAESK;
MVVFEDVKGTGAESKD; VVFEDVKGTGAESKDL;
VFEDVKGTGAESKDLP; FEDVKGTGAESKDLPS;
EDVKGTGAESKDLPSG; DVKGTGAESKDLPSGH;
VKGTGAESKDLPSGHG; KGTGAESKDLPSGHGI;
GTGAESKDLPSGHGIN; TGAESKDLPSGHGINN;
GAESKDLPSGHGINNL; AESKDLPSGHGINNLD;
ESKDLPSGHGINNLDS; SKDLPSGHGINNLDSL;
KDLPSGHGINNLDSLR; DLPSGHGINNLDSLRD;
LPSGHGINNLDSLRDY; PSGHGINNLDSLRDYL;
SGHGINNLDSLRDYLD; GHGINNLDSLRDYLDG;
HGINNLDSLRDYLDGS; GINNLDSLRDYLDGSV;
INNLDSLRDYLDGSVK; NNLDSLRDYLDGSVKV;
NLDSLRDYLDGSVKVN; LDSLRDYLDGSVKVNL;
DSLRDYLDGSVKVNLE; SLRDYLDGSVKVNLEK;
LRDYLDGSVKVNLEKK; RDYLDGSVKVNLEKKH;
DYLDGSVKVNLEKKHL; YLDGSVKVNLEKKHLN;
LDGSVKVNLEKKHLNK; DGSVKVNLEKKHLNKR;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

GSVKVNLEKKHLNKRT; SVKVNLEKKHLNKRTQ;
VKVNLEKKHLNKRTQI; KVNLEKKHLNKRTQIF;
VNLEKKHLNKRTQIFP; NLEKKHLNKRTQIFPP;
LEKKHLNKRTQIFPPG; EKKHLNKRTQIFPPGL;
KKHLNKRTQIFPPGLV; KHLNKRTQIFPPGLVT;
HLNKRTQIFPPGLVTM; LNKRTQIFPPGLVTMN;
NKRTQIFPPGLVTMNE; KRTQIFPPGLVTMNEY;
RTQIFPPGLVTMNEYP; TQIFPPGLVTMNEYPV;
QIFPPGLVTMNEYPVP; IFPPGLVTMNEYPVPK;
FPPGLVTMNEYPVPKT; PPGLVTMNEYPVPKTL;
PGLVTMNEYPVPKTLQ; GLVTMNEYPVPKTLQA;
LVTMNEYPVPKTLQAR; VTMNEYPVPKTLQARF;
TMNEYPVPKTLQARFV; MNEYPVPKTLQARFVR;
NEYPVPKTLQARFVRQ; EYPVPKTLQARFVRQI;
YPVPKTLQARFVRQID; PVPKTLQARFVRQIDF;
VPKTLQARFVRQIDFR; PKTLQARFVRQIDFRP;
KTLQARFVRQIDFRPK; TLQARFVRQIDFRPKI;
LQARFVRQIDFRPKIY; QARFVRQIDFRPKIYL;
ARFVRQIDFRPKIYLR; RFVRQIDFRPKIYLRK;
FVRQIDFRPKIYLRKS; VRQIDFRPKIYLRKSL;
RQIDFRPKIYLRKSLQ; QIDFRPKIYLRKSLQN;
IDFRPKIYLRKSLQNS; DFRPKIYLRKSLQNSE;
FRPKIYLRKSLQNSEF; RPKIYLRKSLQNSEFL;
PKIYLRKSLQNSEFLL; KIYLRKSLQNSEFLLE;
IYLRKSLQNSEFLLEK; YLRKSLQNSEFLLEKR;
LRKSLQNSEFLLEKRI; RKSLQNSEFLLEKRIL;
KSLQNSEFLLEKRILQ; SLQNSEFLLEKRILQS;
LQNSEFLLEKRILQSG; QNSEFLLEKRILQSGM;
NSEFLLEKRILQSGMT; SEFLLEKRILQSGMTL;
EFLLEKRILQSGMTLL; FLLEKRILQSGMTLLL;
LLEKRILQSGMTLLLL; LEKRILQSGMTLLLLL;
EKRILQSGMTLLLLLI; KRILQSGMTLLLLLIW;
RILQSGMTLLLLLIWF; ILQSGMTLLLLLIWFR;
LQSGMTLLLLLIWFRP; QSGMTLLLLLIWFRPV;
SGMTLLLLLIWFRPVA; GMTLLLLLIWFRPVAD;
MTLLLLLIWFRPVADF; TLLLLLIWFRPVADFA;
LLLLLIWFRPVADFAT; LLLLIWFRPVADFATD;
LLLIWFRPVADFATDI; LLIWFRPVADFATDIQ;
LIWFRPVADFATDIQS; IWFRPVADFATDIQSR;
WFRPVADFATDIQSRI; FRPVADFATDIQSRIV;
RPVADFATDIQSRIVE; PVADFATDIQSRIVEW;
VADFATDIQSRIVEWK; ADFATDIQSRIVEWKE;
DFATDIQSRIVEWKER; FATDIQSRIVEWKERL;
ATDIQSRIVEWKERLD; TDIQSRIVEWKERLDS;
DIQSRIVEWKERLDSE; IQSRIVEWKERLDSEI;
QSRIVEWKERLDSEIS; SRIVEWKERLDSEISM;
RIVEWKERLDSEISMY; IVEWKERLDSEISMYT;
VEWKERLDSEISMYTF; EWKERLDSEISMYTFS;
WKERLDSEISMYTFSR; KERLDSEISMYTFSRM;
ERLDSEISMYTFSRMK; RLDSEISMYTFSRMKY;
LDSEISMYTFSRMKYN; DSEISMYTFSRMKYNI;
SEISMYTFSRMKYNIC; EISMYTFSRMKYNICM;
ISMYTFSRMKYNICMG; SMYTFSRMKYNICMGK;
MYTFSRMKYNICMGKC; YTFSRMKYNICMGKCI;
TFSRMKYNICMGKCIL; FSRMKYNICMGKCILD;
SRMKYNICMGKCILDI; RMKYNICMGKCILDIT;
MKYNICMGKCILDITR; KYNICMGKCILDITRE;
YNICMGKCILDITREE; NICMGKCILDITREED;
ICMGKCILDITREEDS; CMGKCILDITREEDSE;
MGKCILDITREEDSET; GKCILDITREEDSETE;
KCILDITREEDSETED; CILDITREEDSETEDS;
ILDITREEDSETEDSG; LDITREEDSETEDSGH;
DITREEDSETEDSGHG; ITREEDSETEDSGHGS;
TREEDSETEDSGHGSS; REEDSETEDSGHGSST;
EEDSETEDSGHGSSTE; EDSETEDSGHGSSTES;
DSETEDSGHGSSTESQ; SETEDSGHGSSTESQS;
ETEDSGHGSSTESQSQ; TEDSGHGSSTESQSQC;
EDSGHGSSTESQSQCS; DSGHGSSTESQSQCSS;
SGHGSSTESQSQCSSQ; GHGSSTESQSQCSSQV;
HGSSTESQSQCSSQVS; GSSTESQSQCSSQVSD;
SSTESQSQCSSQVSDT; STESQSQCSSQVSDTS;
TESQSQCSSQVSDTSA; ESQSQCSSQVSDTSAP;
SQSQCSSQVSDTSAPA; QSQCSSQVSDTSAPAE;
SQCSSQVSDTSAPAED; QCSSQVSDTSAPAEDS;
CSSQVSDTSAPAEDSQ; SSQVSDTSAPAEDSQR;
SQVSDTSAPAEDSQRS; QVSDTSAPAEDSQRSD;
VSDTSAPAEDSQRSDP; SDTSAPAEDSQRSDPH;
DTSAPAEDSQRSDPHS; TSAPAEDSQRSDPHSQ;
SAPAEDSQRSDPHSQE; APAEDSQRSDPHSQEL;
PAEDSQRSDPHSQELH; AEDSQRSDPHSQELHL;
EDSQRSDPHSQELHLC; DSQRSDPHSQELHLCK;
SQRSDPHSQELHLCKG; QRSDPHSQELHLCKGF;
RSDPHSQELHLCKGFQ; SDPHSQELHLCKGFQC;
DPHSQELHLCKGFQCF; PHSQELHLCKGFQCFK;
HSQELHLCKGFQCFKR; SQELHLCKGFQCFKRP;
QELHLCKGFQCFKRPK; ELHLCKGFQCFKRPKT;
LHLCKGFQCFKRPKTP; HLCKGFQCFKRPKTPP;
LCKGFQCFKRPKTPPP; CKGFQCFKRPKTPPPK;
MYMYNKSTCLKHFGLQ; YMYNKSTCLKHFGLQL;
MYNKSTCLKHFGLQLS; YNKSTCLKHFGLQLSL;
NKSTCLKHFGLQLSLF; KSTCLKHFGLQLSLFV;
STCLKHFGLQLSLFVN; TCLKHFGLQLSLFVNI;
CLKHFGLQLSLFVNIS; LKHFGLQLSLFVNISY;
KHFGLQLSLFVNISYH; HFGLQLSLFVNISYHI;
FGLQLSLFVNISYHIW; GLQLSLFVNISYHIWV;
LQLSLFVNISYHIWVP; QLSLFVNISYHIWVPW;
LSLFVNISYHIWVPWK; SLFVNISYHIWVPWKS;
LFVNISYHIWVPWKSF; FVNISYHIWVPWKSFC;
VNISYHIWVPWKSFCA; NISYHIWVPWKSFCAI;
ISYHIWVPWKSFCAIK; SYHIWVPWKSFCAIKH;
YHIWVPWKSFCAIKHP; HIWVPWKSFCAIKHPN;
IWVPWKSFCAIKHPNL; WVPWKSFCAIKHPNLF;
VPWKSFCAIKHPNLFY; PWKSFCAIKHPNLFYL;
WKSFCAIKHPNLFYLG; KSFCAIKHPNLFYLGF;
SFCAIKHPNLFYLGFH; FCAIKHPNLFYLGFHT;
CAIKHPNLFYLGFHTI; AIKHPNLFYLGFHTIH;
IKHPNLFYLGFHTIHR; KHPNLFYLGFHTIHRL;
HPNLFYLGFHTIHRLP; PNLFYLGFHTIHRLPI;
NLFYLGFHTIHRLPIH; LFYLGFHTIHRLPIHS;
FYLGFHTIHRLPIHSL; YLGFHTIHRLPIHSLG;
LGFHTIHRLPIHSLGS; GFHTIHRLPIHSLGSP;
FHTIHRLPIHSLGSPV; HTIHRLPIHSLGSPVY;
TIHRLPIHSLGSPVYK; IHRLPIHSLGSPVYKV;
HRLPIHSLGSPVYKVT; QKGNWVRILYRSFSQA;
KGNWVRILYRSFSQAD; GNWVRILYRSFSQADL;
NWVRILYRSFSQADLK; WVRILYRSFSQADLKI;
VRILYRSFSQADLKIS; RILYRSFSQADLKISC;
ILYRSFSQADLKISCK; LYRSFSQADLKISCKA;
YRSFSQADLKISCKAS; RSFSQADLKISCKASP;
SFSQADLKISCKASPL; FSQADLKISCKASPLL;
SQADLKISCKASPLLC; QADLKISCKASPLLCS;
ADLKISCKASPLLCSR; DLKISCKASPLLCSRA;
LKISCKASPLLCSRAV; KISCKASPLLCSRAVS;
ISCKASPLLCSRAVSK; SCKASPLLCSRAVSKQ;
CKASPLLCSRAVSKQA; KASPLLCSRAVSKQAT;
ASPLLCSRAVSKQATN; SPLLCSRAVSKQATNI;
PLLCSRAVSKQATNIS; LLCSRAVSKQATNISS;
NIQAISFTKRPHTLFI; QHCGSCVGHMKYWGNI;
HCGSCVGHMKYWGNIF; CGSCVGHMKYWGNIFP;
GSCVGHMKYWGNIFPS; SCVGHMKYWGNIFPSC;
CVGHMKYWGNIFPSCE; VGHMKYWGNIFPSCES;
GHMKYWGNIFPSCESP; HMKYWGNIFPSCESPK;
MKYWGNIFPSCESPKI; KYWGNIFPSCESPKIP;
YWGNIFPSCESPKIPS; WGNIFPSCESPKIPSI;
GNIFPSCESPKIPSIF; NIFPSCESPKIPSIFI;
IFPSCESPKIPSIFIS; FPSCESPKIPSIFIST;
PSCESPKIPSIFISTG; SCESPKIPSIFISTGI;
CESPKIPSIFISTGIR; ESPKIPSIFISTGIRY;
SPKIPSIFISTGIRYP; PKIPSIFISTGIRYPA;
KIPSIFISTGIRYPAL; IPSIFISTGIRYPALN;
PSIFISTGIRYPALNW; SIFISTGIRYPALNWI;
IFISTGIRYPALNWIS; FISTGIRYPALNWISI;
ISTGIRYPALNWISIV; STGIRYPALNWISIVF;
TGIRYPALNWISIVFV; GIRYPALNWISIVFVQ;
IRYPALNWISIVFVQI; RYPALNWISIVFVQIG;
YPALNWISIVFVQIGL; PALNWISIVFVQIGLM;
ALNWISIVFVQIGLMV; LNWISIVFVQIGLMVS;
NWISIVFVQIGLMVSI; WISIVFVQIGLMVSIH;

TABLE O-continued

Predicted MHC class 2 BK virus peptide sequences. Prediction of 13-, 14-, 15-,16-mers from all 6 reading frames of the genome (access no #V01108) obtained using the program displayed in FIG. 2.

ISIVFVQIGLMVSIHY; SIVFVQIGLMVSIHYL;
IVFVQIGLMVSIHYLG; VFVQIGLMVSIHYLGL;
FVQIGLMVSIHYLGLG; VQIGLMVSIHYLGLGC;
QIGLMVSIHYLGLGCW; IGLMVSIHYLGLGCWV;
GLMVSIHYLGLGCWVF; LMVSIHYLGLGCWVFR;
MVSIHYLGLGCWVFRG; VSIHYLGLGCWVFRGY;
SIHYLGLGCWVFRGYS; IHYLGLGCWVFRGYST;
HYLGLGCWVFRGYSTI; YLGLGCWVFRGYSTIR;
LGLGCWVFRGYSTIRV; GLGCWVFRGYSTIRVL;
HSLHFQGFSTYSKEVE; SLHFQGFSTYSKEVEI;
LHFQGFSTYSKEVEIT; HFQGFSTYSKEVEITA;
FQGFSTYSKEVEITAL; QGFSTYSKEVEITALN;
GFSTYSKEVEITALNR; FSTYSKEVEITALNRF;
STYSKEVEITALNRFS; TYSKEVEITALNRFSS;
YSKEVEITALNRFSST; SKEVEITALNRFSSTM;
KEVEITALNRFSSTML; EVEITALNRFSSTMLM;
VEITALNRFSSTMLMH; EITALNRFSSTMLMHF;
ITALNRFSSTMLMHFL; PCMKVKHASYSNNLCL;
CMKVKHASYSNNLCLY; MKVKHASYSNNLCLYS;
KVKHASYSNNLCLYSY; VKHASYSNNLCLYSYS;
KHASYSNNLCLYSYSL; HASYSNNLCLYSYSLP;
ASYSNNLCLYSYSLPH; SYSNNLCLYSYSLPHQ;
IGEGNSCCAVTGKHFS; GEGNSCCAVTGKHFSL;
EGNSCCAVTGKHFSLW; GNSCCAVTGKHFSLWA;
NSCCAVTGKHFSLWAI; SCCAVTGKHFSLWAIT;
CCAVTGKHFSLWAITA; CAVTGKHFSLWAITAK;
AVTGKHFSLWAITAKV; VTGKHFSLWAITAKVI;
TGKHFSLWAITAKVIF; GKHFSLWAITAKVIFS;
KHFSLWAITAKVIFST; FWHLHGFLWLFGSCPW;
WHLHGFLWLFGSCPWT; HLHGFLWLFGSCPWTL;
LHGFLWLFGSCPWTLS; HGFLWLFGSCPWTLSF;
GFLWLFGSCPWTLSFS; FLWLFGSCPWTLSFSF;
LWLFGSCPWTLSFSFG; WLFGSCPWTLSFSFGW;
LFGSCPWTLSFSFGWG; FGSCPWTLSFSFGWGH;
GSCPWTLSFSFGWGHL; SCPWTLSFSFGWGHLH;
CPWTLSFSFGWGHLHM; PWTLSFSFGWGHLHML;
WTLSFSFGWGHLHMLQ; TLSFSFGWGHLHMLQE;
LSFSFGWGHLHMLQEQ; SFSFGWGHLHMLQEQV;
FSFGWGHLHMLQEQVL; SFGWGHLHMLQEQVLQ;
FGWGHLHMLQEQVLQS; GWGHLHMLQEQVLQSR;
WGHLHMLQEQVLQSRT; GHLHMLQEQVLQSRTG;
HLHMLQEQVLQSRTGL; LHMLQEQVLQSRTGLE;
HMLQEQVLQSRTGLEV; MLQEQVLQSRTGLEVK;
LQEQVLQSRTGLEVKA; QEQVLQSRTGLEVKAT;
EQVLQSRTGLEVKATS; QVLQSRTGLEVKATSI;
VLQSRTGLEVKATSIE; LQSRTGLEVKATSIEE;
QSRTGLEVKATSIEEQ; SRTGLEVKATSIEEQF;
RTGLEVKATSIEEQFF; TGLEVKATSIEEQFFD;
TLLNVHFVDFLSPFFV; LLLYCQHHLYYKYGQN;
LLYCQHHLYYKYGQNV; LYCQHHLYYKYGQNVH;
YCQHHLYYKYGQNVHG; CQHHLYYKYGQNVHGY;
QHHLYYKYGQNVHGYL; HHLYYKYGQNVHGYLP;
HLYYKYGQNVHGYLPF; LYYKYGQNVHGYLPFQ;
YYKYGQNVHGYLPFQL; YKYGQNVHGYLPFQLL;
KYGQNVHGYLPFQLLV; QKYLHQETEYHSTHLG;
TIPKPCLIADRGLQWK; IPKPCLIADRGLQWKL;
PKPCLIADRGLQWKLC; KPCLIADRGLQWKLCD;
PCLIADRGLQWKLCDP; CLIADRGLQWKLCDPN;
LIADRGLQWKLCDPNH; IADRGLQWKLCDPNHQ;
ADRGLQWKLCDPNHQR; DRGLQWKLCDPNHQRT;
RGLQWKLCDPNHQRTY; GLQWKLCDPNHQRTYT;
LQWKLCDPNHQRTYTL; QWKLCDPNHQRTYTLL;
WKLCDPNHQRTYTLLE; KLCDPNHQRTYTLLEL;
LCDPNHQRTYTLLELR; CDPNHQRTYTLLELRN;
PQEHQQLQHMFEELGL; QQQPPQQQFQPLKILW;
QQPPQQQFQPLKILWQ; QPPQQQFQPLKILWQQ;
PPQQQFQPLKILWQQQ; PQQQFQPLKILWQQQP;
QQQFQPLKILWQQQPQ; QQFQPLKILWQQQPQI;
QFQPLKILWQQQPQIH; FQPLKILWQQQPQIHW;
QPLKILWQQQPQIHWQ; PLKILWQQQPQIHWQL;
LKILWQQQPQIHWQLG; KILWQQQPQIHWQLGP;
ILWQQQPQIHWQLGPP; LWQQQPQIHWQLGPPK;
WQQQPQIHWQLGPPKV; QQQPQIHWQLGPPKVL;
QQPQIHWQLGPPKVLE; QPQIHWQLGPPKVLEQ;
PQIHWQLGPPKVLEQH; QIHWQLGPPKVLEQHP;
TWKYKKKGITYLGVFY; WKYKKKGITYLGVFYR;
KYKKKGITYLGVFYRV; YKKKGITYLGVFYRVF;
KKKGITYLGVFYRVFY; KKGITYLGVFYRVFYS;
KGITYLGVFYRVFYSR; SSGTFVFPVYTVFTST;
SGTFVFPVYTVFTSTK; GTFVFPVYTVFTSTKF;
TFVFPVYTVFTSTKFQ; FVFPVYTVFTSTKFQQ;
VFPVYTVFTSTKFQQK; FPVYTVFTSTKFQQKL;
NKNKNPLSSFFCSSPG; KNKNPLSSFFCSSPGF;
NKNPLSSFFCSSPGFT; KNPLSSFFCSSPGFTN;
NPLSSFFCSSPGFTNF; PLSSFFCSSPGFTNFH;
LGTRPRFLGSQNMSVM; GTRPRFLGSQNMSVMH;
TRPRFLGSQNMSVMHF; RPRFLGSQNMSVMHFP;
PRFLGSQNMSVMHFPS; AAPPCESCTFLPEVMV;
APPCESCTFLPEVMVW; PPCESCTFLPEVMVWL;
PCESCTFLPEVMVWLH; CESCTFLPEVMVWLHS;
ESCTFLPEVMVWLHSP; SCTFLPEVMVWLHSPV;
CTFLPEVMVWLHSPVS; TFLPEVMVWLHSPVSH;
FLPEVMVWLHSPVSHA; LPEVMVWLHSPVSHAL;
PEVMVWLHSPVSHALS; EVMVWLHSPVSHALSF;
VMVWLHSPVSHALSFL; MVWLHSPVSHALSFLR;
VWLHSPVSHALSFLRS; WLHSPVSHALSFLRSW;
LHSPVSHALSFLRSWF; HSPVSHALSFLRSWFG;
SPVSHALSFLRSWFGC; PVSHALSFLRSWFGCI;
VSHALSFLRSWFGCIP; SHALSFLRSWFGCIPW;
HALSFLRSWFGCIPWV; ALSFLRSWFGCIPWVS;
LSFLRSWFGCIPWVSS; SFLRSWFGCIPWVSSS;
FLRSWFGCIPWVSSSS; LRSWFGCIPWVSSSSL;
RSWFGCIPWVSSSSLW; SWFGCIPWVSSSSLWP;
WFGCIPWVSSSSLWPF; FGCIPWVSSSSLWPFF;
GCIPWVSSSSLWPFFL; YIRGRGRLCLHPFSQV;
IRGRGRLCLHPFSQVV; RGRGRLCLHPFSQVVR;
GRGRLCLHPFSQVVRV; RGRLCLHPFSQVVRVW;
GRLCLHPFSQVVRVWR; RLCLHPFSQVVRVWRL;
LCLHPFSQVVRVWRLF; CLHPFSQVVRVWRLFL;
LHPFSQVVRVWRLFLR; HPFSQVVRVWRLFLRP;
PFSQVVRVWRLFLRPS; FSQVVRVWRLFLRPSK;
SQVVRVWRLFLRPSKT; QVVRVWRLFLRPSKTI;
VVRVWRLFLRPSKTIW; VRVWRLFLRPSKTIWG;
RVWRLFLRPSKTIWGN; VWRLFLRPSKTIWGNP;
WRLFLRPSKTIWGNPY; RLFLRPSKTIWGNPYS;
LFLRPSKTIWGNPYSF; FLRPSKTIWGNPYSFA;
LRPSKTIWGNPYSFAI; RPSKTIWGNPYSFAIF;
PSKTIWGNPYSFAIFA; SKTIWGNPYSFAIFAK

SEQ ID NOS.: 24957-44888

Preferred BK virus fragments of VP2-3 capable of interacting with one or more MHC class 2 molecules are listed in Table P.

TABLE P

Prediction of BK virus VP2-3 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0101 | 36 AAIEVQIASLATVEG | VQIASLATV | 0.7655 | 13 | SB | BK VP2-3 |
| DRB1_0101 | 37 AIEVQIASLATVEGI | IASLATVEG | 0.7653 | 13 | SB | BK VP2-3 |
| DRB1_0101 | 38 IEVQIASLATVEGIT | IASLATVEG | 0.7535 | 14 | SB | BK VP2-3 |
| DRB1_0101 | 39 EVQIASLATVEGITT | IASLATVEG | 0.7419 | 16 | SB | BK VP2-3 |
| DRB1_0101 | 216 QDYYSNLSPIRPSMV | YSNLSPIRP | 0.7369 | 17 | SB | BK VP2-3 |
| DRB1_0101 | 258 VTQRMDLRNKESVHS | VTQRMDLRN | 0.7362 | 17 | SB | BK VP2-3 |
| DRB1_0101 | 259 TQRMDLRNKESVHSG | LRNKESVHS | 0.7390 | 17 | SB | BK VP2-3 |
| DRB1_0101 | 260 QRMDLRNKESVHSGE | LRNKESVHS | 0.7399 | 17 | SB | BK VP2-3 |
| DRB1_0101 | 261 RMDLRNKESVHSGEF | LRNKESVHS | 0.7383 | 17 | SB | BK VP2-3 |
| DRB1_0101 | 262 MDLRNKESVHSGEFI | LRNKESVHS | 0.7362 | 17 | SB | BK VP2-3 |
| DRB1_0101 | 217 DYYSNLSPIRPSMVR | YSNLSPIRP | 0.7308 | 18 | SB | BK VP2-3 |
| DRB1_0101 | 82 AALIQTVTGISSLAQ | IQTVTGISS | 0.7316 | 18 | SB | BK VP2-3 |
| DRB1_0101 | 83 ALIQTVTGISSLAQV | VTGISSLAQ | 0.7288 | 19 | SB | BK VP2-3 |
| DRB1_0101 | 40 VQIASLATVEGITTT | IASLATVEG | 0.7231 | 20 | SB | BK VP2-3 |
| DRB1_0101 | 66 QTYAVIAGAPGAIAG | IAGAPGAIA | 0.7250 | 20 | SB | BK VP2-3 |
| DRB1_0101 | 65 PQTYAVIAGAPGAIA | VIAGAPGAI | 0.7203 | 21 | SB | BK VP2-3 |
| DRB1_0101 | 67 TYAVIAGAPGAIAGF | IAGAPGAIA | 0.7196 | 21 | SB | BK VP2-3 |
| DRB1_0101 | 68 YAVIAGAPGAIAGFA | IAGAPGAIA | 0.7188 | 21 | SB | BK VP2-3 |
| DRB1_0101 | 213 NYIQDYYSNLSPIRP | YYSNLSPIR | 0.7087 | 23 | SB | BK VP2-3 |
| DRB1_0101 | 214 YIQDYYSNLSPIRPS | YSNLSPIRP | 0.7104 | 23 | SB | BK VP2-3 |
| DRB1_0101 | 215 IQDYYSNLSPIRPSM | YSNLSPIRP | 0.7116 | 23 | SB | BK VP2-3 |
| DRB1_0101 | 219 YSNLSPIRPSMVRQV | YSNLSPIRP | 0.7018 | 25 | SB | BK VP2-3 |
| DRB1_0101 | 84 LIQTVTGISSLAQVG | VTGISSLAQ | 0.7012 | 25 | SB | BK VP2-3 |
| DRB1_0101 | 69 AVIAGAPGAIAGFAA | IAGAPGAIA | 0.6972 | 26 | SB | BK VP2-3 |
| DRB1_0101 | 85 IQTVTGISSLAQVGY | VTGISSLAQ | 0.7004 | 26 | SB | BK VP2-3 |
| DRB1_0101 | 24 FSVAEIAAGEAAAAI | IAAGEAAAA | 0.6947 | 27 | SB | BK VP2-3 |
| DRB1_0101 | 26 VAEIAAGEAAAAIEV | IAAGEAAAA | 0.6967 | 27 | SB | BK VP2-3 |
| DRB1_0101 | 27 AEIAAGEAAAAIEVQ | IAAGEAAAA | 0.6963 | 27 | SB | BK VP2-3 |
| DRB1_0101 | 25 SVAEIAAGEAAAAIE | IAAGEAAAA | 0.6933 | 28 | SB | BK VP2-3 |
| DRB1_0101 | 34 AAAAIEVQIASLATV | EVQIASLAT | 0.6919 | 28 | SB | BK VP2-3 |
| DRB1_0101 | 35 AAAIEVQIASLATVE | VQIASLATV | 0.6928 | 28 | SB | BK VP2-3 |
| DRB1_0101 | 23 GFSVAEIAAGEAAAA | VAEIAAGEA | 0.6867 | 30 | SB | BK VP2-3 |
| DRB1_0101 | 292 QWMLPLLLGLYGTVT | QWMLPLLLG | 0.6800 | 32 | SB | BK VP2-3 |
| DRB1_0101 | 1 MGAALALLGDLVASV | MGAALALLG | 0.6779 | 33 | SB | BK VP2-3 |
| DRB1_0101 | 296 PLLLGLYGTVTPALE | LLGLYGTVT | 0.6771 | 33 | SB | BK VP2-3 |
| DRB1_0101 | 289 TAPQWMLPLLLGLYG | PQWMLPLLL | 0.6746 | 34 | SB | BK VP2-3 |
| DRB1_0101 | 295 LPLLLGLYGTVTPAL | LLGLYGTVT | 0.6709 | 35 | SB | BK VP2-3 |
| DRB1_0101 | 218 YYSNLSPIRPSMVRQ | YSNLSPIRP | 0.6689 | 36 | SB | BK VP2-3 |
| DRB1_0101 | 293 WMLPLLLGLYGTVTP | LLGLYGTVT | 0.6559 | 41 | SB | BK VP2-3 |
| DRB1_0101 | 294 MLPLLLGLYGTVTPA | LLGLYGTVT | 0.6545 | 42 | SB | BK VP2-3 |
| DRB1_0101 | 220 SNLSPIRPSMVRQVA | IRPSMVRQV | 0.6515 | 43 | SB | BK VP2-3 |
| DRB1_0101 | 288 RTAPQWMLPLLLGLY | PQWMLPLLL | 0.6514 | 43 | SB | BK VP2-3 |
| DRB1_0101 | 86 QTVTGISSLAQVGGAATG | VTGISSLAQ | 0.6515 | 43 | SB | BK VP2-3 |
| DRB1_0101 | 9 GDLVASVSEAAATG | LVASVSEAA | 0.6476 | 45 | SB | BK VP2-3 |
| DRB1_0101 | 287 QRTAPQWMLPLLLGL | PQWMLPLLL | 0.6469 | 46 | SB | BK VP2-3 |
| DRB1_0101 | 290 APQWMLPLLLGLYGT | QWMLPLLLG | 0.6444 | 47 | SB | BK VP2-3 |
| DRB1_0101 | 263 DLRNKESVHSGEFIE | LRNKESVHS | 0.6362 | 51 | WB | BK VP2-3 |
| DRB1_0101 | 264 LRNKESVHSGEFIEK | LRNKESVHS | 0.6346 | 52 | WB | BK VP2-3 |
| DRB1_0101 | 42 IASLATVEGITTTSE | IASLATVEG | 0.6326 | 53 | WB | BK VP2-3 |
| DRB1_0101 | 5 LALLGDLVASVSEAA | LGDLVASVS | 0.6322 | 53 | WB | BK VP2-3 |
| DRB1_0101 | 170 RDDIPAITSQELQRR | IPAITSQEL | 0.6313 | 54 | WB | BK VP2-3 |
| DRB1_0101 | 171 DDIPAITSQELQRRT | IPAITSQEL | 0.6309 | 54 | WB | BK VP2-3 |
| DRB1_0101 | 186 ERFFRDSLARFLEET | FRDSLARFL | 0.6320 | 54 | WB | BK VP2-3 |
| DRB1_0101 | 184 RTERFFRDSLARFLE | FRDSLARFL | 0.6295 | 55 | WB | BK VP2-3 |
| DRB1_0101 | 185 TERFFRDSLARFLEE | FRDSLARFL | 0.6304 | 55 | WB | BK VP2-3 |
| DRB1_0101 | 183 RRTERFFRDSLARFL | FFRDSLARF | 0.6285 | 56 | WB | BK VP2-3 |
| DRB1_0101 | 187 RFFRDSLARFLEETT | FRDSLARFL | 0.6286 | 56 | WB | BK VP2-3 |
| DRB1_0101 | 70 VIAGAPGAIAGFAAL | IAGAPGAIA | 0.6277 | 56 | WB | BK VP2-3 |
| DRB1_0101 | 75 PGAIAGFAALIQTVT | IAGFAALIQ | 0.6288 | 56 | WB | BK VP2-3 |
| DRB1_0101 | 76 GAIAGFAALIQTVTG | FAALIQTVT | 0.6280 | 56 | WB | BK VP2-3 |
| DRB1_0101 | 41 QIASLATVEGITTTS | IASLATVEG | 0.6263 | 57 | WB | BK VP2-3 |
| DRB1_0101 | 6 ALLGDLVASVSEAAA | LVASVSEAA | 0.6253 | 58 | WB | BK VP2-3 |
| DRB1_0101 | 221 NLSPIRPSMVRQVAE | IRPSMVRQV | 0.6218 | 60 | WB | BK VP2-3 |
| DRB1_0101 | 297 LLGLYGTVTPALEAY | LLGLYGTVT | 0.6216 | 60 | WB | BK VP2-3 |
| DRB1_0101 | 222 LSPIRPSMVRQVAER | IRPSMVRQV | 0.6206 | 61 | WB | BK VP2-3 |
| DRB1_0101 | 291 PQWMLPLLLGLYGTV | PQWMLPLLL | 0.6197 | 61 | WB | BK VP2-3 |
| DRB1_0101 | 298 LLGLYGTVTPALEAY | LLGLYGTVT | 0.6201 | 61 | WB | BK VP2-3 |
| DRB1_0101 | 79 AGFAALIQTVTGISS | FAALIQTVT | 0.6202 | 61 | WB | BK VP2-3 |
| DRB1_0101 | 8 LGDLVASVSEAAAAT | LVASVSEAA | 0.6196 | 61 | WB | BK VP2-3 |
| DRB1_0101 | 155 PSLFATISQALWHVI | LFATISQAL | 0.6154 | 64 | WB | BK VP2-3 |
| DRB1_0101 | 28 EIAAGEAAAAIEVQI | IAAGEAAAA | 0.6146 | 65 | WB | BK VP2-3 |
| DRB1_0101 | 286 NQRTAPQWMLPLLLG | PQWMLPLLL | 0.6139 | 65 | WB | BK VP2-3 |
| DRB1_0101 | 151 RHWGPSLFATISQAL | RHWGPSLFA | 0.6126 | 66 | WB | BK VP2-3 |

TABLE P-continued

Prediction of BK virus VP2-3 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. Identity |
|---|---|---|---|---|---|
| DRB1_0101 | 275 FIEKTIAPGGANQRT | IAPGGANQR | 0.6093 | 69 | WB BK VP2-3 |
| DRB1_0101 | 29 IAAGEAAAAIEVQIA | IAAGEAAAA | 0.6093 | 69 | WB BK VP2-3 |
| DRB1_0101 | 7 LLGDLVASVSEAAAA | LVASVSEAA | 0.6068 | 70 | WB BK VP2-3 |
| DRB1_0101 | 11 LVASVSEAAAATGFS | VSEAAAATG | 0.6048 | 72 | WB BK VP2-3 |
| DRB1_0101 | 152 HWGPSLFATISQALW | LFATISQAL | 0.6052 | 72 | WB BK VP2-3 |
| DRB1_0101 | 276 IEKTIAPGGANQRTA | IAPGGANQR | 0.6053 | 72 | WB BK VP2-3 |
| DRB1_0101 | 154 GPSLFATISQALWHV | LFATISQAL | 0.6040 | 73 | WB BK VP2-3 |
| DRB1_0101 | 111 TVGLYQQSGMALELF | LYQQSGMAL | 0.6024 | 74 | WB BK VP2-3 |
| DRB1_0101 | 10 DLVASVSEAAAATGF | VSEAAAATG | 0.6015 | 75 | WB BK VP2-3 |
| DRB1_0101 | 112 VGLYQQSGMALELFN | LYQQSGMAL | 0.6010 | 75 | WB BK VP2-3 |
| DRB1_0101 | 277 EKTIAPGGANQRTAP | IAPGGANQR | 0.6011 | 75 | WB BK VP2-3 |
| DRB1_0101 | 71 IAGAPGAIAGFAALI | IAGAPGAIA | 0.6015 | 75 | WB BK VP2-3 |
| DRB1_0101 | 153 WGPSLFATISQALWH | LFATISQAL | 0.5994 | 76 | WB BK VP2-3 |
| DRB1_0101 | 223 SPIRPSMVRQVAERE | IRPSMVRQV | 0.6003 | 76 | WB BK VP2-3 |
| DRB1_0101 | 110 STVGLYQQSGMALEL | LYQQSGMAL | 0.5977 | 78 | WB BK VP2-3 |
| DRB1_0101 | 78 IAGFAALIQTVTGIS | FAALIQTVT | 0.5963 | 79 | WB BK VP2-3 |
| DRB1_0101 | 77 AIAGFAALIQTVTGI | FAALIQTVT | 0.5949 | 80 | WB BK VP2-3 |
| DRB1_0101 | 278 KTIAPGGANQRTAPQ | IAPGGANQR | 0.5943 | 81 | WB BK VP2-3 |
| DRB1_0101 | 2 GAALALLGDLVASVS | LALLGDLVA | 0.5930 | 82 | WB BK VP2-3 |
| DRB1_0101 | 3 AALALLGDLVASVSE | LGDLVASVS | 0.5912 | 83 | WB BK VP2-3 |
| DRB1_0101 | 81 FAALIQTVTGISSLA | IQTVTGISS | 0.5912 | 83 | WB BK VP2-3 |
| DRB1_0101 | 173 IPAITSQELQRRTER | ITSQELQRR | 0.5853 | 89 | WB BK VP2-3 |
| DRB1_0101 | 172 DIPAITSQELQRRTE | ITSQELQRR | 0.5840 | 90 | WB BK VP2-3 |
| DRB1_0101 | 88 VTGISSLAQVGYRFF | VTGISSLAQ | 0.5828 | 91 | WB BK VP2-3 |
| DRB1_0101 | 80 GFAALIQTVTGISSL | IQTVTGISS | 0.5817 | 92 | WB BK VP2-3 |
| DRB1_0101 | 274 EFIEKTIAPGGANQR | IEKTIAPGG | 0.5781 | 96 | WB BK VP2-3 |
| DRB1_0101 | 320 KRRVSRGSSQKAKGT | VSRGSSQKA | 0.5786 | 96 | WB BK VP2-3 |
| DRB1_0101 | 167 HVIRDDIPAITSQEL | IRDDIPAIT | 0.5761 | 98 | WB BK VP2-3 |
| DRB1_0101 | 109 VSTVGLYQQSGMALE | LYQQSGMAL | 0.5756 | 99 | WB BK VP2-3 |
| DRB1_0101 | 64 TPQTYAVIAGAPGAI | YAVIAGAPG | 0.5756 | 99 | WB BK VP2-3 |
| DRB1_0101 | 321 RRVSRGSSQKAKGTR | VSRGSSQKA | 0.5746 | 100 | WB BK VP2-3 |
| DRB1_0101 | 323 VSRGSSQKAKGTRAS | VSRGSSQKA | 0.5730 | 101 | WB BK VP2-3 |
| DRB1_0101 | 319 KKRRVSRGSSQKAKG | VSRGSSQKA | 0.5712 | 104 | WB BK VP2-3 |
| DRB1_0101 | 318 QKKRRVSRGSSQKAK | VSRGSSQKA | 0.5695 | 105 | WB BK VP2-3 |
| DRB1_0101 | 87 TVTGISSLAQVGYRF | VTGISSLAQ | 0.5702 | 105 | WB BK VP2-3 |
| DRB1_0101 | 299 LGLYGTVTPALEAYE | LYGTVTPAL | 0.5689 | 106 | WB BK VP2-3 |
| DRB1_0101 | 4 ALALLGDLVASVSEA | LGDLVASVS | 0.5688 | 106 | WB BK VP2-3 |
| DRB1_0101 | 317 NQKKRRVSRGSSQKA | RVSRGSSQK | 0.5685 | 107 | WB BK VP2-3 |
| DRB1_0101 | 12 VASVSEAAAATGFSV | VSEAAAATG | 0.5666 | 109 | WB BK VP2-3 |
| DRB1_0101 | 169 IRDDIPAITSQELQR | IPAITSQEL | 0.5628 | 113 | WB BK VP2-3 |
| DRB1_0101 | 285 ANQRTAPQWMLPLLL | RTAPQWMLP | 0.5629 | 113 | WB BK VP2-3 |
| DRB1_0101 | 33 EAAAAIEVQIASLAT | IEVQIASLA | 0.5628 | 113 | WB BK VP2-3 |
| DRB1_0101 | 74 APGAIAGFAALIQTV | IAGFAALIQ | 0.5631 | 113 | WB BK VP2-3 |
| DRB1_0101 | 168 VIRDDIPAITSQELQ | IPAITSQEL | 0.5596 | 117 | WB BK VP2-3 |
| DRB1_0101 | 212 YNYIQDYYSNLSPIR | IQDYYSNLS | 0.5601 | 117 | WB BK VP2-3 |
| DRB1_0101 | 72 AGAPGAIAGFAALIQ | AIAGFAALI | 0.5598 | 117 | WB BK VP2-3 |
| DRB1_0101 | 73 GAPGAIAGFAALIQT | IAGFAALIQ | 0.5602 | 117 | WB BK VP2-3 |
| DRB1_0101 | 108 KVSTVGLYQQSGMAL | TVGLYQQSG | 0.5550 | 123 | WB BK VP2-3 |
| DRB1_0101 | 156 SLFATISQALWHVIR | LFATISQAL | 0.5526 | 127 | WB BK VP2-3 |
| DRB1_0101 | 13 ASVSEAAAATGFSVA | VSEAAAATG | 0.5482 | 133 | WB BK VP2-3 |
| DRB1_0101 | 113 GLYQQSGMALELFNP | LYQQSGMAL | 0.5426 | 141 | WB BK VP2-3 |
| DRB1_0101 | 157 LFATISQALWHVIRD | LFATISQAL | 0.5415 | 143 | WB BK VP2-3 |
| DRB1_0101 | 188 FFRDSLARFLEETTW | FRDSLARFL | 0.5345 | 154 | WB BK VP2-3 |
| DRB1_0101 | 43 ASLATVEGITTTSEA | LATVEGITT | 0.5345 | 154 | WB BK VP2-3 |
| DRB1_0101 | 149 DPRHWGPSLFATISQ | RHWGPSLFA | 0.5298 | 162 | WB BK VP2-3 |
| DRB1_0101 | 148 LDPRHWGPSLFATIS | RHWGPSLFA | 0.5294 | 163 | WB BK VP2-3 |
| DRB1_0101 | 57 AIAAIGLTPQTYAVI | IAAIGLTPQ | 0.5280 | 165 | WB BK VP2-3 |
| DRB1_0101 | 189 FRDSLARFLEETTWT | FRDSLARFL | 0.5271 | 167 | WB BK VP2-3 |
| DRB1_0101 | 279 TIAPGGANQRTAPQW | IAPGGANQR | 0.5252 | 170 | WB BK VP2-3 |
| DRB1_0101 | 174 PAITSQELQRRTERF | ITSQELQRR | 0.5214 | 177 | WB BK VP2-3 |
| DRB1_0101 | 114 LYQQSGMALELFNPD | LYQQSGMAL | 0.5213 | 178 | WB BK VP2-3 |
| DRB1_0101 | 199 ETTWTIVNAPINFYN | IVNAPINFY | 0.5209 | 178 | WB BK VP2-3 |
| DRB1_0101 | 58 IAAIGLTPQTYAVIA | LTPQTYAVI | 0.5203 | 180 | WB BK VP2-3 |
| DRB1_0101 | 147 YLDPRHWGPSLFATI | RHWGPSLFA | 0.5192 | 182 | WB BK VP2-3 |
| DRB1_0101 | 56 EAIAAIGLTPQTYAV | IAAIGLTPQ | 0.5190 | 182 | WB BK VP2-3 |
| DRB1_0101 | 200 TTWTIVNAPINFYNY | IVNAPINFY | 0.5185 | 183 | WB BK VP2-3 |
| DRB1_0101 | 198 EETTWTIVNAPINFY | WTIVNAPIN | 0.5179 | 184 | WB BK VP2-3 |
| DRB1_0101 | 224 PIRPSMVRQVAEREG | IRPSMVRQV | 0.5170 | 186 | WB BK VP2-3 |
| DRB1_0101 | 63 LTPQTYAVIAGAPGA | YAVIAGAPG | 0.5172 | 186 | WB BK VP2-3 |
| DRB1_0101 | 225 IRPSMVRQVAEREGT | IRPSMVRQV | 0.5152 | 190 | WB BK VP2-3 |
| DRB1_0101 | 209 INFYNYIQDYYSNLS | YNYIQDYYS | 0.5135 | 193 | WB BK VP2-3 |
| DRB1_0101 | 55 SEAIAAIGLTPQTYA | IAAIGLTPQ | 0.5133 | 194 | WB BK VP2-3 |
| DRB1_0101 | 210 NFYNYIQDYYSNLSP | IQDYYSNLS | 0.5129 | 195 | WB BK VP2-3 |

TABLE P-continued

Prediction of BK virus VP2-3 protein specific MHC class 2, 15-mer
peptide binders for 14 MHC class 2 alleles (see

TABLE P-continued

Prediction of BK virus VP2-3 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0401 | 217 DYYSNLSPIRPSMVR | YSNLSPIR | 0.4779 | 284 | WB | BK VP2-3 |
| DRB1_0401 | 83 ALIQTVTGISSLAQV | VTGISSLAQ | 0.4763 | 289 | WB | BK VP2-3 |
| DRB1_0401 | 84 LIQTVTGISSLAQVG | VTGISSLAQ | 0.4711 | 306 | WB | BK VP2-3 |
| DRB1_0401 | 218 YYSNLSPIRPSMVRQ | YSNLSPIR | 0.4694 | 312 | WB | BK VP2-3 |
| DRB1_0401 | 198 EETTWTIVNAPINFY | WTIVNAPIN | 0.4557 | 361 | WB | BK VP2-3 |
| DRB1_0401 | 199 ETTWTIVNAPINFYN | IVNAPINFY | 0.4556 | 362 | WB | BK VP2-3 |
| DRB1_0401 | 200 TTWTIVNAPINFYNY | IVNAPINFY | 0.4527 | 373 | WB | BK VP2-3 |
| DRB1_0401 | 85 IQTVTGISSLAQVGY | VTGISSLAQ | 0.4432 | 414 | WB | BK VP2-3 |
| DRB1_0401 | 202 WTIVNAPINFYNYIQ | IVNAPINFY | 0.4421 | 418 | WB | BK VP2-3 |
| DRB1_0401 | 201 TWTIVNAPINFYNYI | IVNAPINFY | 0.4401 | 427 | WB | BK VP2-3 |
| DRB1_0401 | 81 FAALIQTVTGISSLA | LIQTVTGIS | 0.4399 | 428 | WB | BK VP2-3 |
| DRB1_0401 | 36 AAIEVQIASLATVEG | IEVQIASLA | 0.4327 | 463 | WB | BK VP2-3 |
| DRB1_0401 | 132 DILFPGVNTFVNNIQ | GVNTFVNNI | 0.4289 | 483 | WB | BK VP2-3 |
| DRB1_0404 | 213 NYIQDYYSNLSPIRP | IQDYYSNLS | 0.5128 | 195 | WB | BK VP2-3 |
| DRB1_0404 | 82 AALIQTVTGISSLAQ | LIQTVTGIS | 0.4868 | 258 | WB | BK VP2-3 |
| DRB1_0404 | 198 EETTWTIVNAPINFY | TTWTIVNAP | 0.4822 | 271 | WB | BK VP2-3 |
| DRB1_0404 | 215 IQDYYSNLSPIRPSM | IQDYYSNLS | 0.4815 | 273 | WB | BK VP2-3 |
| DRB1_0404 | 295 LPLLLGLYGTVTPAL | LLGLYGTVT | 0.4754 | 292 | WB | BK VP2-3 |
| DRB1_0404 | 214 YIQDYYSNLSPIRPS | IQDYYSNLS | 0.4645 | 328 | WB | BK VP2-3 |
| DRB1_0404 | 296 PLLLGLYGTVTPALE | LLGLYGTVT | 0.4620 | 337 | WB | BK VP2-3 |
| DRB1_0404 | 293 WMLPLLLGLYGTVTP | LLGLYGTVT | 0.4571 | 356 | WB | BK VP2-3 |
| DRB1_0404 | 294 MLPLLLGLYGTVTPA | LLGLYGTVT | 0.4547 | 365 | WB | BK VP2-3 |
| DRB1_0404 | 36 AAIEVQIASLATVEG | IEVQIASLA | 0.4515 | 378 | WB | BK VP2-3 |
| DRB1_0404 | 200 TTWTIVNAPINFYNY | IVNAPINFY | 0.4472 | 396 | WB | BK VP2-3 |
| DRB1_0404 | 194 ARFLEETTWTIVNAP | FLEETTWTI | 0.4467 | 398 | WB | BK VP2-3 |
| DRB1_0404 | 212 YNYIQDYYSNLSPIR | IQDYYSNLS | 0.4449 | 406 | WB | BK VP2-3 |
| DRB1_0404 | 199 ETTWTIVNAPINFYN | IVNAPINFY | 0.4444 | 408 | WB | BK VP2-3 |
| DRB1_0404 | 81 FAALIQTVTGISSLA | LIQTVTGIS | 0.4428 | 415 | WB | BK VP2-3 |
| DRB1_0404 | 292 QWMLPLLLGLYGTVT | MLPLLLGLY | 0.4376 | 439 | WB | BK VP2-3 |
| DRB1_0404 | 297 LLLGLYGTVTPALEA | LGLYGTVTP | 0.4365 | 445 | WB | BK VP2-3 |
| DRB1_0404 | 84 LIQTVTGISSLAQVG | LIQTVTGIS | 0.4287 | 483 | WB | BK VP2-3 |
| DRB1_0404 | 38 IEVQIASLATVEGIT | IASLATVEG | 0.4281 | 487 | WB | BK VP2-3 |
| DRB1_0404 | 78 IAGFAALIQTVTGIS | AALIQTVTG | 0.4270 | 493 | WB | BK VP2-3 |
| DRB1_0404 | 196 FLEETTWTIVNAPIN | TTWTIVNAP | 0.4258 | 499 | WB | BK VP2-3 |
| DRB1_0405 | 213 NYIQDYYSNLSPIRP | IQDYYSNLS | 0.5630 | 113 | WB | BK VP2-3 |
| DRB1_0405 | 212 YNYIQDYYSNLSPIR | IQDYYSNLS | 0.5391 | 146 | WB | BK VP2-3 |
| DRB1_0405 | 209 INFYNYIQDYYSNLS | YNYIQDYYS | 0.5339 | 155 | WB | BK VP2-3 |
| DRB1_0405 | 96 QVGYRFFSDWDHKVS | YRFFSDWDH | 0.5285 | 164 | WB | BK VP2-3 |
| DRB1_0405 | 210 NFYNYIQDYYSNLSP | IQDYYSNLS | 0.5274 | 166 | WB | BK VP2-3 |
| DRB1_0405 | 196 FLEETTWTIVNAPIN | EETTWTIVN | 0.5259 | 169 | WB | BK VP2-3 |
| DRB1_0405 | 214 YIQDYYSNLSPIRPS | IQDYYSNLS | 0.5183 | 184 | WB | BK VP2-3 |
| DRB1_0405 | 215 IQDYYSNLSPIRPSM | IQDYYSNLS | 0.5155 | 189 | WB | BK VP2-3 |
| DRB1_0405 | 135 FPGVNTFVNNIQYLD | VNTFVNNIQ | 0.5129 | 194 | WB | BK VP2-3 |
| DRB1_0405 | 211 FYNYIQDYYSNLSPI | IQDYYSNLS | 0.5093 | 202 | WB | BK VP2-3 |
| DRB1_0405 | 198 EETTWTIVNAPINFY | WTIVNAPIN | 0.5089 | 203 | WB | BK VP2-3 |
| DRB1_0405 | 136 PGVNTFVNNIQYLDP | VNTFVNNIQ | 0.5073 | 207 | WB | BK VP2-3 |
| DRB1_0405 | 95 AQVGYRFFSDWDHKV | YRFFSDWDH | 0.5059 | 210 | WB | BK VP2-3 |
| DRB1_0405 | 132 DILFPGVNTFVNNIQ | FPGVNTFVN | 0.5008 | 222 | WB | BK VP2-3 |
| DRB1_0405 | 133 ILFPGVNTFVNNIQY | VNTFVNNIQ | 0.4983 | 228 | WB | BK VP2-3 |
| DRB1_0405 | 97 VGYRFFSDWDHKVST | YRFFSDWDH | 0.4930 | 241 | WB | BK VP2-3 |
| DRB1_0405 | 194 ARFLEETTWTIVNAP | EETTWTIVN | 0.4887 | 253 | WB | BK VP2-3 |
| DRB1_0405 | 197 LEETTWTIVNAPINF | WTIVNAPIN | 0.4832 | 268 | WB | BK VP2-3 |
| DRB1_0405 | 199 ETTWTIVNAPINFYN | WTIVNAPIN | 0.4813 | 274 | WB | BK VP2-3 |
| DRB1_0405 | 195 RFLEETTWTIVNAPI | EETTWTIVN | 0.4799 | 278 | WB | BK VP2-3 |
| DRB1_0405 | 94 LAQVGYRFFSDWDHK | GYRFFSDWD | 0.4772 | 286 | WB | BK VP2-3 |
| DRB1_0405 | 93 SLAQVGYRFFSDWDH | GYRFFSDWD | 0.4758 | 291 | WB | BK VP2-3 |
| DRB1_0405 | 134 LFPGVNTFVNNIQYL | VNTFVNNIQ | 0.4752 | 292 | WB | BK VP2-3 |
| DRB1_0405 | 193 LARFLEETTWTIVNA | EETTWTIVN | 0.4694 | 312 | WB | BK VP2-3 |
| DRB1_0405 | 158 FATISQALWHVIRDD | QALWHVIRD | 0.4626 | 335 | WB | BK VP2-3 |
| DRB1_0405 | 157 LFATISQALWHVIRD | SQALWHVIR | 0.4616 | 339 | WB | BK VP2-3 |
| DRB1_0405 | 200 TTWTIVNAPINFYNY | IVNAPINFY | 0.4599 | 345 | WB | BK VP2-3 |
| DRB1_0405 | 98 GYRFFSDWDHKVSTV | YRFFSDWDH | 0.4557 | 361 | WB | BK VP2-3 |
| DRB1_0405 | 192 SLARFLEETTWTIVN | FLEETTWTI | 0.4451 | 405 | WB | BK VP2-3 |
| DRB1_0405 | 137 GVNTFVNNIQYLDPR | VNTFVNNIQ | 0.4315 | 469 | WB | BK VP2-3 |
| DRB1_0405 | 138 VNTFVNNIQYLDPRH | VNTFVNNIQ | 0.4315 | 469 | WB | BK VP2-3 |
| DRB1_0701 | 155 PSLFATISQALWHVI | LFATISQAL | 0.6499 | 44 | SB | BK VP2-3 |
| DRB1_0701 | 154 GPSLFATISQALWHV | LFATISQAL | 0.6324 | 53 | WB | BK VP2-3 |
| DRB1_0701 | 153 WGPSLFATISQALWH | LFATISQAL | 0.6252 | 58 | WB | BK VP2-3 |
| DRB1_0701 | 152 HWGPSLFATISQALW | LFATISQAL | 0.6229 | 59 | WB | BK VP2-3 |
| DRB1_0701 | 151 RHWGPSLFATISQAL | WGPSLFATI | 0.6204 | 61 | WB | BK VP2-3 |

TABLE P-continued

Prediction of BK virus VP2-3 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0701 | 219 YSNLSPIRPSMVRQV | LSPIRPSMV | 0.6186 | 62 | WB | BK VP2-3 |
| DRB1_0701 | 220 SNLSPIRPSMVRQVA | LSPIRPSMV | 0.6184 | 62 | WB | BK VP2-3 |
| DRB1_0701 | 216 QDYYSNLSPIRPSMV | YYSNLSPIR | 0.6145 | 65 | WB | BK VP2-3 |
| DRB1_0701 | 217 DYYSNLSPIRPSMVR | LSPIRPSMV | 0.6117 | 67 | WB | BK VP2-3 |
| DRB1_0701 | 218 YYSNLSPIRPSMVRQ | LSPIRPSMV | 0.6108 | 67 | WB | BK VP2-3 |
| DRB1_0701 | 194 ARFLEETTWTIVNAP | FLEETTWTI | 0.6047 | 72 | WB | BK VP2-3 |
| DRB1_0701 | 191 DSLARFLEETTWTIV | FLEETTWTI | 0.6040 | 73 | WB | BK VP2-3 |
| DRB1_0701 | 193 LARFLEETTWTIVNA | FLEETTWTI | 0.6028 | 73 | WB | BK VP2-3 |
| DRB1_0701 | 192 SLARFLEETTWTIVN | FLEETTWTI | 0.6024 | 74 | WB | BK VP2-3 |
| DRB1_0701 | 156 SLFATISQALWHVIR | LFATISQAL | 0.5732 | 101 | WB | BK VP2-3 |
| DRB1_0701 | 157 LFATISQALWHVIRD | LFATISQAL | 0.5709 | 104 | WB | BK VP2-3 |
| DRB1_0701 | 195 RFLEETTWTIVNAPI | LEETTWTIV | 0.5523 | 127 | WB | BK VP2-3 |
| DRB1_0701 | 221 NLSPIRPSMVRQVAE | LSPIRPSMV | 0.5258 | 169 | WB | BK VP2-3 |
| DRB1_0701 | 222 LSPIRPSMVRQVAER | LSPIRPSMV | 0.5249 | 171 | WB | BK VP2-3 |
| DRB1_0701 | 196 FLEETTWTIVNAPIN | FLEETTWTI | 0.5082 | 205 | WB | BK VP2-3 |
| DRB1_0701 | 58 IAAIGLTPQTYAVIA | LTPQTYAVI | 0.4999 | 224 | WB | BK VP2-3 |
| DRB1_0701 | 57 AIAAIGLTPQTYAVI | AIGLTPQTY | 0.4992 | 226 | WB | BK VP2-3 |
| DRB1_0701 | 59 AAIGLTPQTYAVIAG | LTPQTYAVI | 0.4959 | 234 | WB | BK VP2-3 |
| DRB1_0701 | 60 AIGLTPQTYAVIAGA | LTPQTYAVI | 0.4955 | 235 | WB | BK VP2-3 |
| DRB1_0701 | 61 IGLTPQTYAVIAGAP | LTPQTYAVI | 0.4924 | 243 | WB | BK VP2-3 |
| DRB1_0701 | 190 RDSLARFLEETTWTI | RDSLARFLE | 0.4903 | 248 | WB | BK VP2-3 |
| DRB1_0701 | 167 HVIRDDIPAITSQEL | VIRDDIPAI | 0.4747 | 294 | WB | BK VP2-3 |
| DRB1_0701 | 131 YDILFPGVNTFVNNI | LFPGVNTFV | 0.4730 | 299 | WB | BK VP2-3 |
| DRB1_0701 | 168 VIRDDIPAITSQELQ | IPAITSQEL | 0.4729 | 300 | WB | BK VP2-3 |
| DRB1_0701 | 132 DILFPGVNTFVNNIQ | LFPGVNTFV | 0.4725 | 301 | WB | BK VP2-3 |
| DRB1_0701 | 169 IRDDIPAITSQELQR | IPAITSQEL | 0.4681 | 316 | WB | BK VP2-3 |
| DRB1_0701 | 170 RDDIPAITSQELQRR | IPAITSQEL | 0.4671 | 319 | WB | BK VP2-3 |
| DRB1_0701 | 171 DDIPAITSQELQRRT | IPAITSQEL | 0.4635 | 332 | WB | BK VP2-3 |
| DRB1_0701 | 129 EYYDILFPGVNTFVN | LFPGVNTFV | 0.4503 | 383 | WB | BK VP2-3 |
| DRB1_0701 | 130 YYDILFPGVNTFVNN | FPGVNTFVN | 0.4488 | 389 | WB | BK VP2-3 |
| DRB1_0701 | 133 ILFPGVNTFVNNIQY | FPGVNTFVN | 0.4334 | 459 | WB | BK VP2-3 |
| DRB1_0701 | 158 FATISQALWHVIRDD | ISQALWHVI | 0.4279 | 488 | WB | BK VP2-3 |
| DRB1_0802 | 214 YIQDYYSNLSPIRPS | YSNLSPIRP | 0.4370 | 442 | WB | BK VP2-3 |
| DRB1_0802 | 213 NYIQDYYSNLSPIRP | YYSNLSPIR | 0.4360 | 447 | WB | BK VP2-3 |
| DRB1_0802 | 215 IQDYYSNLSPIRPSM | YSNLSPIRP | 0.4360 | 447 | WB | BK VP2-3 |
| DRB1_0802 | 216 QDYYSNLSPIRPSMV | YSNLSPIRP | 0.4358 | 448 | WB | BK VP2-3 |
| DRB1_0901 | 110 STVGLYQQSGMALEL | YQQSGMALE | 0.4827 | 270 | WB | BK VP2-3 |
| DRB1_0901 | 111 TVGLYQQSGMALELF | YQQSGMALE | 0.4750 | 293 | WB | BK VP2-3 |
| DRB1_0901 | 112 VGLYQQSGMALELFN | YQQSGMALE | 0.4750 | 293 | WB | BK VP2-3 |
| DRB1_0901 | 109 VSTVGLYQQSGMALE | LYQQSGMAL | 0.4737 | 297 | WB | BK VP2-3 |
| DRB1_0901 | 36 AAIEVQIASLATVEG | VQIASLATV | 0.4709 | 306 | WB | BK VP2-3 |
| DRB1_0901 | 35 AAAIEVQIASLATVE | VQIASLATV | 0.4664 | 322 | WB | BK VP2-3 |
| DRB1_0901 | 198 EETTWTIVNAPINFY | WTIVNAPIN | 0.4656 | 324 | WB | BK VP2-3 |
| DRB1_0901 | 199 ETTWTIVNAPINFYN | WTIVNAPIN | 0.4657 | 324 | WB | BK VP2-3 |
| DRB1_0901 | 37 AIEVQIASLATVEGI | VQIASLATV | 0.4650 | 326 | WB | BK VP2-3 |
| DRB1_0901 | 34 AAAAIEVQIASLATV | IEVQIASLA | 0.4647 | 328 | WB | BK VP2-3 |
| DRB1_0901 | 38 IEVQIASLATVEGIT | VQIASLATV | 0.4639 | 331 | WB | BK VP2-3 |
| DRB1_0901 | 297 LLLGLYGTVTPALEA | LYGTVTPAL | 0.4627 | 335 | WB | BK VP2-3 |
| DRB1_0901 | 200 TTWTIVNAPINFYNY | WTIVNAPIN | 0.4612 | 340 | WB | BK VP2-3 |
| DRB1_0901 | 296 PLLLGLYGTVTPALE | LYGTVTPAL | 0.4611 | 341 | WB | BK VP2-3 |
| DRB1_0901 | 299 LGLYGTVTPALEAYE | LYGTVTPAL | 0.4598 | 346 | WB | BK VP2-3 |
| DRB1_0901 | 298 LLGLYGTVTPALEAY | LYGTVTPAL | 0.4531 | 372 | WB | BK VP2-3 |
| DRB1_0901 | 113 GLYQQSGMALELFNP | YQQSGMALE | 0.4451 | 405 | WB | BK VP2-3 |
| DRB1_0901 | 183 RRTERFFRDSLARFL | FFRDSLARF | 0.4413 | 422 | WB | BK VP2-3 |
| DRB1_0901 | 184 RTERFFRDSLARFLE | FRDSLARFL | 0.4404 | 426 | WB | BK VP2-3 |
| DRB1_0901 | 186 ERFFRDSLARFLEET | FRDSLARFL | 0.4393 | 431 | WB | BK VP2-3 |
| DRB1_0901 | 185 TERFFRDSLARFLEE | FRDSLARFL | 0.4382 | 436 | WB | BK VP2-3 |
| DRB1_0901 | 187 RFFRDSLARFLEETT | FRDSLARFL | 0.4306 | 474 | WB | BK VP2-3 |
| DRB1_0901 | 295 LPLLLGLYGTVTPAL | LGLYGTVTP | 0.4290 | 482 | WB | BK VP2-3 |
| DRB1_0901 | 65 PQTYAVIAGAPGAIA | VIAGAPGAI | 0.4281 | 487 | WB | BK VP2-3 |
| DRB1_0901 | 66 QTYAVIAGAPGAIAG | VIAGAPGAI | 0.4279 | 488 | WB | BK VP2-3 |
| DRB1_0901 | 67 TYAVIAGAPGAIAGF | VIAGAPGAI | 0.4259 | 499 | WB | BK VP2-3 |
| DRB1_1302 | 135 FPGVNTFVNNIQYLD | VNTFVNNIQ | 0.7008 | 25 | SB | BK VP2-3 |
| DRB1_1302 | 136 PGVNTFVNNIQYLDP | FVNNIQYLD | 0.6940 | 27 | SB | BK VP2-3 |
| DRB1_1302 | 137 GVNTFVNNIQYLDPR | FVNNIQYLD | 0.6861 | 30 | SB | BK VP2-3 |
| DRB1_1302 | 138 VNTFVNNIQYLDPRH | FVNNIQYLD | 0.6825 | 31 | SB | BK VP2-3 |
| DRB1_1302 | 139 NTFVNNIQYLDPRHW | FVNNIQYLD | 0.6608 | 39 | SB | BK VP2-3 |
| DRB1_1302 | 213 NYIQDYYSNLSPIRP | IQDYYSNLS | 0.6338 | 53 | WB | BK VP2-3 |
| DRB1_1302 | 216 QDYYSNLSPIRPSMV | YSNLSPIRP | 0.6265 | 57 | WB | BK VP2-3 |
| DRB1_1302 | 215 IQDYYSNLSPIRPSM | YSNLSPIRP | 0.6245 | 58 | WB | BK VP2-3 |

TABLE P-continued

Prediction of BK virus VP2-3 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. Identity |
|---|---|---|---|---|---|
| DRB1_1302 | 214 YIQDYYSNLSPIRPS | YSNLSPIRP | 0.6230 | 59 | WB BK VP2-3 |
| DRB1_1302 | 217 DYYSNLSPIRPSMVR | YSNLSPIRP | 0.6216 | 60 | WB BK VP2-3 |
| DRB1_1302 | 293 WMLPLLLGLYGTVTP | LLGLYGTVT | 0.6200 | 61 | WB BK VP2-3 |
| DRB1_1302 | 296 PLLLGLYGTVTPALE | LGLYGTVTP | 0.6167 | 63 | WB BK VP2-3 |
| DRB1_1302 | 294 MLPLLLGLYGTVTPA | LGLYGTVTP | 0.6126 | 66 | WB BK VP2-3 |
| DRB1_1302 | 295 LPLLLGLYGTVTPAL | LGLYGTVTP | 0.6083 | 69 | WB BK VP2-3 |
| DRB1_1302 | 297 LLLGLYGTVTPALEA | LGLYGTVTP | 0.6067 | 70 | WB BK VP2-3 |
| DRB1_1302 | 140 TFVNNIQYLDPRHWG | FVNNIQYLD | 0.5962 | 79 | WB BK VP2-3 |
| DRB1_1302 | 36 AAIEVQIASLATVEG | VQIASLATV | 0.5884 | 86 | WB BK VP2-3 |
| DRB1_1302 | 141 FVNNIQYLDPRHWGP | FVNNIQYLD | 0.5710 | 104 | WB BK VP2-3 |
| DRB1_1302 | 37 AIEVQIASLATVEGI | VQIASLATV | 0.5647 | 111 | WB BK VP2-3 |
| DRB1_1302 | 38 IEVQIASLATVEGIT | VQIASLATV | 0.5646 | 111 | WB BK VP2-3 |
| DRB1_1302 | 218 YYSNLSPIRPSMVRQ | YSNLSPIRP | 0.5481 | 133 | WB BK VP2-3 |
| DRB1_1302 | 199 ETTWTIVNAPINFYN | IVNAPINFY | 0.5463 | 135 | WB BK VP2-3 |
| DRB1_1302 | 200 TTWTIVNAPINFYNY | IVNAPINFY | 0.5452 | 137 | WB BK VP2-3 |
| DRB1_1302 | 198 EETTWTIVNAPINFY | WTIVNAPIN | 0.5445 | 138 | WB BK VP2-3 |
| DRB1_1302 | 298 LLGLYGTVTPALEAY | LGLYGTVTP | 0.5383 | 148 | WB BK VP2-3 |
| DRB1_1302 | 219 YSNLSPIRPSMVRQV | YSNLSPIRP | 0.5366 | 150 | WB BK VP2-3 |
| DRB1_1302 | 201 TWTIVNAPINFYNYI | IVNAPINFY | 0.5349 | 153 | WB BK VP2-3 |
| DRB1_1302 | 79 AGFAALIQTVTGISS | FAALIQTVT | 0.5306 | 161 | WB BK VP2-3 |
| DRB1_1302 | 34 AAAAIEVQIASLATV | IEVQIASLA | 0.5257 | 169 | WB BK VP2-3 |
| DRB1_1302 | 202 WTIVNAPINFYNYIQ | IVNAPINFY | 0.5240 | 172 | WB BK VP2-3 |
| DRB1_1302 | 35 AAAIEVQIASLATVE | VQIASLATV | 0.5233 | 174 | WB BK VP2-3 |
| DRB1_1302 | 299 LGLYGTVTPALEAYE | LGLYGTVTP | 0.5095 | 202 | WB BK VP2-3 |
| DRB1_1302 | 40 VQIASLATVEGITTT | IASLATVEG | 0.5094 | 202 | WB BK VP2-3 |
| DRB1_1302 | 80 GFAALIQTVTGISSL | IQTVTGISS | 0.5080 | 205 | WB BK VP2-3 |
| DRB1_1302 | 39 EVQIASLATVEGITT | IASLATVEG | 0.5076 | 206 | WB BK VP2-3 |
| DRB1_1302 | 81 FAALIQTVTGISSLA | IQTVTGISS | 0.5054 | 211 | WB BK VP2-3 |
| DRB1_1302 | 78 IAGFAALIQTVTGIS | FAALIQTVT | 0.4783 | 283 | WB BK VP2-3 |
| DRB1_1302 | 82 AALIQTVTGISSLAQ | IQTVTGISS | 0.4693 | 312 | WB BK VP2-3 |
| DRB1_1302 | 83 ALIQTVTGISSLAQV | IQTVTGISS | 0.4437 | 411 | WB BK VP2-3 |
| DRB1_1302 | 109 VSTVGLYQQSGMALE | VGLYQQSGM | 0.4417 | 420 | WB BK VP2-3 |
| DRB1_1302 | 132 DILFPGVNTFVNNIQ | FPGVNTFVN | 0.4394 | 431 | WB BK VP2-3 |
| DRB1_1302 | 133 ILFPGVNTFVNNIQY | VNTFVNNIQ | 0.4339 | 457 | WB BK VP2-3 |
| DRB1_1302 | 203 TIVNAPINFYNYIQD | IVNAPINFY | 0.4317 | 468 | WB BK VP2-3 |
| DRB1_1302 | 110 STVGLYQQSGMALEL | VGLYQQSGM | 0.4274 | 490 | WB BK VP2-3 |
| DRB1_1501 | 259 TQRMDLRNKESVHSG | LRNKESVHS | 0.5055 | 211 | WB BK VP2-3 |
| DRB1_1501 | 258 VTQRMDLRNKESVHS | TQRMDLRNK | 0.4963 | 233 | WB BK VP2-3 |
| DRB1_1501 | 260 QRMDLRNKESVHSGE | LRNKESVHS | 0.4888 | 252 | WB BK VP2-3 |
| DRB1_1501 | 261 RMDLRNKESVHSGEF | LRNKESVHS | 0.4818 | 272 | WB BK VP2-3 |
| DRB1_1501 | 292 QWMLPLLLGLYGTVT | MLPLLLGLY | 0.4818 | 272 | WB BK VP2-3 |
| DRB1_1501 | 293 WMLPLLLGLYGTVTP | LLGLYGTVT | 0.4703 | 308 | WB BK VP2-3 |
| DRB1_1501 | 262 MDLRNKESVHSGEFI | LRNKESVHS | 0.4652 | 326 | WB BK VP2-3 |
| DRB1_1501 | 294 MLPLLLGLYGTVTPA | LLGLYGTVT | 0.4567 | 357 | WB BK VP2-3 |
| DRB1_1501 | 295 LPLLLGLYGTVTPAL | LLGLYGTVT | 0.4514 | 378 | WB BK VP2-3 |
| DRB1_1501 | 296 PLLLGLYGTVTPALE | LLGLYGTVT | 0.4387 | 434 | WB BK VP2-3 |
| DRB4_0101 | 213 NYIQDYYSNLSPIRP | IQDYYSNLS | 0.4336 | 458 | WB BK VP2-3 |
| DRB5_0101 | 216 QDYYSNLSPIRPSMV | YYSNLSPIR | 0.5417 | 142 | WB BK VP2-3 |
| DRB5_0101 | 214 YIQDYYSNLSPIRPS | YSNLSPIRP | 0.5315 | 159 | WB BK VP2-3 |
| DRB5_0101 | 215 IQDYYSNLSPIRPSM | YSNLSPIRP | 0.5316 | 159 | WB BK VP2-3 |
| DRB5_0101 | 213 NYIQDYYSNLSPIRP | YYSNLSPIR | 0.5308 | 160 | WB BK VP2-3 |
| DRB5_0101 | 217 DYYSNLSPIRPSMVR | YSNLSPIRP | 0.5081 | 205 | WB BK VP2-3 |
| DRB5_0101 | 218 YYSNLSPIRPSMVRQ | YYSNLSPIR | 0.4623 | 336 | WB BK VP2-3 |
| DRB5_0101 | 174 PAITSQELQRRTERF | ITSQELQRR | 0.4449 | 406 | WB BK VP2-3 |
| DRB5_0101 | 173 IPAITSQELQRRTER | ITSQELQRR | 0.4422 | 418 | WB BK VP2-3 |

SEQ ID NOS.: 58312-59135

Preferred BK virus fragments of VP1 capable of interacting with one or more MHC class 2 molecules are listed in Table Q.

TABLE Q

Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB1_0101 | 164 QGVLMNYRTKYPQGT | LMNYRTKYP | 0.7782 | 11 | SB | VP1 |
| DRB1_0101 | 165 GVLMNYRTKYPQGTI | YRTKYPQGT | 0.7768 | 11 | SB | VP1 |
| DRB1_0101 | 166 VLMNYRTKYPQGTIT | YRTKYPQGT | 0.7796 | 11 | SB | VP1 |
| DRB1_0101 | 167 LMNYRTKYPQGTITP | YRTKYPQGT | 0.7798 | 11 | SB | VP1 |
| DRB1_0101 | 168 MNYRTKYPQGTITPK | YRTKYPQGT | 0.7778 | 11 | SB | VP1 |
| DRB1_0101 | 118 KTEVIGITSMLNLHA | VIGITSMLN | 0.7623 | 13 | SB | VP1 |
| DRB1_0101 | 119 TEVIGITSMLNLHAG | VIGITSMLN | 0.7621 | 13 | SB | VP1 |
| DRB1_0101 | 233 PPVLHVTNTATTVLL | VTNTATTVL | 0.7280 | 19 | SB | VP1 |
| DRB1_0101 | 234 PVLHVTNTATTVLLD | VTNTATTVL | 0.7252 | 20 | SB | VP1 |
| DRB1_0101 | 235 VLHVTNTATTVLLDE | VTNTATTVL | 0.7244 | 20 | SB | VP1 |
| DRB1_0101 | 232 VPPVLHVTNTATTVL | VLHVTNTAT | 0.7197 | 21 | SB | VP1 |
| DRB1_0101 | 236 LHVTNTATTVLLDEQ | VTNTATTVL | 0.7207 | 21 | SB | VP1 |
| DRB1_0101 | 121 VIGITSMLNLHAGSQ | VIGITSMLN | 0.7107 | 23 | SB | VP1 |
| DRB1_0101 | 120 EVIGITSMLNLHAGS | VIGITSMLN | 0.7035 | 25 | SB | VP1 |
| DRB1_0101 | 266 ADICGLFTNSSGTQQ | ICGLFTNSS | 0.7009 | 25 | SB | VP1 |
| DRB1_0101 | 262 YVSAADICGLFTNSS | YVSAADICG | 0.6956 | 27 | SB | VP1 |
| DRB1_0101 | 117 VKTEVIGITSMLNLH | VIGITSMLN | 0.6913 | 28 | SB | VP1 |
| DRB1_0101 | 116 TVKTEVIGITSMLNL | VIGITSMLN | 0.6903 | 29 | SB | VP1 |
| DRB1_0101 | 115 VTVKTEVIGITSMLN | EVIGITSML | 0.6842 | 30 | SB | VP1 |
| DRB1_0101 | 169 NYRTKYPQGTITPKN | YRTKYPQGT | 0.6853 | 30 | SB | VP1 |
| DRB1_0101 | 265 AADICGLFTNSSGTQ | ICGLFTNSS | 0.6859 | 30 | SB | VP1 |
| DRB1_0101 | 170 YRTKYPQGTITPKNP | YRTKYPQGT | 0.6835 | 31 | SB | VP1 |
| DRB1_0101 | 264 SAADICGLFTNSSGT | ICGLFTNSS | 0.6829 | 31 | SB | VP1 |
| DRB1_0101 | 263 VSAADICGLFTNSSG | ICGLFTNSS | 0.6809 | 32 | SB | VP1 |
| DRB1_0101 | 305 FLLSDLINRRTQKVD | LINRRTQKV | 0.6730 | 34 | SB | VP1 |
| DRB1_0101 | 304 SFLLSDLINRRTQKV | LSDLINRRT | 0.6723 | 35 | SB | VP1 |
| DRB1_0101 | 105 TCGNLLMWEAVTVKT | LLMWEAVTV | 0.6651 | 37 | SB | VP1 |
| DRB1_0101 | 106 CGNLLMWEAVTVKTE | LLMWEAVTV | 0.6660 | 37 | SB | VP1 |
| DRB1_0101 | 107 GNLLMWEAVTVKTEV | LLMWEAVTV | 0.6675 | 37 | SB | VP1 |
| DRB1_0101 | 306 LLSDLINRRTQKVDG | LINRRTQKV | 0.6610 | 39 | SB | VP1 |
| DRB1_0101 | 307 LSDLINRRTQKVDGQ | LINRRTQKV | 0.6620 | 39 | SB | VP1 |
| DRB1_0101 | 308 SDLINRRTQKVDGQP | LINRRTQKV | 0.6493 | 44 | SB | VP1 |
| DRB1_0101 | 122 IGITSMLNLHAGSQK | ITSMLNLHA | 0.6472 | 45 | SB | VP1 |
| DRB1_0101 | 108 NLLMWEAVTVKTEVI | MWEAVTVKT | 0.6381 | 50 | WB | VP1 |
| DRB1_0101 | 237 HVTNTATTVLLDEQG | VTNTATTVL | 0.6362 | 51 | WB | VP1 |
| DRB1_0101 | 267 DICGLFTNSSGTQQW | ICGLFTNSS | 0.6283 | 56 | WB | VP1 |
| DRB1_0101 | 268 ICGLFTNSSGTQQWR | ICGLFTNSS | 0.6286 | 56 | WB | VP1 |
| DRB1_0101 | 104 LTCGNLLMWEAVTVK | LLMWEAVTV | 0.6269 | 57 | WB | VP1 |
| DRB1_0101 | 317 KVDGQPMYGMESQVE | VDGQPMYGM | 0.6232 | 59 | WB | VP1 |
| DRB1_0101 | 318 VDGQPMYGMESQVEE | MYGMESQVE | 0.6230 | 59 | WB | VP1 |

TABLE Q-continued

Prediction of BK virus VP1 protein specific MHC class 2, 15-mer peptide binders for 14 MHC class 2 alleles (see TABLE Q-continued Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB1_0101 | 295 RSVKNPYPIS-FLLSD | VKNPYPISF | 0.5161 | 188 | WB | VP1 |
| DRB1_0101 | 312 NRRTQKVDGQP-MYGM | KVDGQPMYG | 0.5163 | 188 | WB | VP1 |
| DRB1_0101 | 160 PLEMQGVLM-NYRTKY | MQGVLMNYR | 0.5148 | 190 | WB | VP1 |
| DRB1_0101 | 269 CGLFTNSS-GTQQWRG | FTNSSGTQQ | 0.5138 | 193 | WB | VP1 |
| DRB1_0101 | 292 LRKRSVKNPYP-ISFL | VKNPYPISF | 0.5094 | 202 | WB | VP1 |
| DRB1_0101 | 163 MQGVLMNYRT-KYPQG | LMNYRTKYP | 0.5072 | 207 | WB | VP1 |
| DRB1_0101 | 230 ENVPPVLHVTNT-ATT | VLHVTNTAT | 0.5053 | 211 | WB | VP1 |
| DRB1_0101 | 293 RKRSVKNPYPIS-FLL | VKNPYPISF | 0.5053 | 211 | WB | VP1 |
| DRB1_0101 | 270 GLFTNSS-GTQQWRGL | FTNSSGTQQ | 0.5035 | 215 | WB | VP1 |
| DRB1_0101 | 175 PQGTITP-KNPTAQSQ | ITPKNPTAQ | 0.5026 | 217 | WB | VP1 |
| DRB1_0101 | 176 QGTITP-KNPTAQSQV | ITPKNPTAQ | 0.5007 | 222 | WB | VP1 |
| DRB1_0101 | 291 RLRKRSVKNPYP-ISF | LRKRSVKNP | 0.5005 | 222 | WB | VP1 |
| DRB1_0101 | 125 TSMLNLHAGSQK-VHE | MLNLHAGSQ | 0.4968 | 231 | WB | VP1 |
| DRB1_0101 | 62 DNLRGYSQHL-SAENA | LRGYSQHLS | 0.4929 | 241 | WB | VP1 |
| DRB1_0101 | 83 DRKMLPCYSTAR-IPL | MLPCYSTAR | 0.4902 | 249 | WB | VP1 |
| DRB1_0101 | 87 LPCYSTAR-IPLPNLN | YSTARIPLP | 0.4891 | 252 | WB | VP1 |
| DRB1_0101 | 85 KMLPCYSTAR-IPLPN | YSTARIPLP | 0.4865 | 259 | WB | VP1 |
| DRB1_0101 | 349 IRYIDRQGQLQT-KMV | YIDRQGQLQ | 0.4856 | 261 | WB | VP1 |
| DRB1_0101 | 111 MWEAVTVKTE-VIGIT | MWEAVTVKT | 0.4847 | 264 | WB | VP1 |
| DRB1_0101 | 88 PCYSTARIPLPN-LNE | YSTARIPLP | 0.4819 | 272 | WB | VP1 |
| DRB1_0101 | 86 MLPCYSTAR-IPLPNL | YSTARIPLP | 0.4817 | 273 | WB | VP1 |
| DRB1_0101 | 23 VQVPKLLIKG-GVEVL | LLIKGGVEV | 0.4803 | 277 | WB | VP1 |
| DRB1_0101 | 61 DDNLRGYSQHL-SAEN | LRGYSQHLS | 0.4800 | 278 | WB | VP1 |
| DRB1_0101 | 179 ITP-KNPTAQSVMNT | ITPKNPTAQ | 0.4786 | 282 | WB | VP1 |
| DRB1_0101 | 285 ARYFKIRLRKRS-VKN | FKIRLRKRS | 0.4787 | 282 | WB | VP1 |
| DRB1_0101 | 155 AVGGDPLEMQGV-LMN | GDPLEMQGV | 0.4780 | 284 | WB | VP1 |
| DRB1_0101 | 284 LARYFKIRL-RKRSVK | FKIRLRKRS | 0.4764 | 289 | WB | VP1 |
| DRB1_0101 | 178 TITP-KNPTAQSVMN | ITPKNPTAQ | 0.4755 | 291 | WB | VP1 |
| DRB1_0101 | 282 RGLARYFKIRL-RKRS | YFKIRLRKR | 0.4754 | 292 | WB | VP1 |
| DRB1_0101 | 283 GLARYFKIRL-RKRSV | FKIRLRKRS | 0.4744 | 295 | WB | VP1 |
| DRB1_0101 | 173 KYPQGTITP-KNPTAQ | PQGTITPKN | 0.4716 | 304 | WB | VP1 |
| DRB1_0101 | 174 YPQGTITP-KNPTAQS | ITPKNPTAQ | 0.4716 | 304 | WB | VP1 |
| DRB1_0101 | 224 GTYTGGENVPPV-LHV | YTGGENVPP | 0.4697 | 310 | WB | VP1 |
| DRB1_0101 | 322 PMYGMESQVEEVRVF | MYGMESQVE | 0.4691 | 312 | WB | VP1 |
| DRB1_0101 | 156 VGGDPLEMQGV-LMNY | LEMQGVLMN | 0.4685 | 314 | WB | VP1 |
| DRB1_0101 | 25 VPKLLIKGGVEV-LEV | LLIKGGVEV | 0.4678 | 317 | WB | VP1 |
| DRB1_0101 | 24 QVPKLLIKG-GVEVLE | LLIKGGVEV | 0.4674 | 318 | WB | VP1 |
| DRB1_0101 | 22 PVQVPKLLIKG-GVEV | VPKLLIKGG | 0.4668 | 320 | WB | VP1 |
| DRB1_0101 | 261 LYVSAADICGLFTNS | YVSAADICG | 0.4665 | 321 | WB | VP1 |
| DRB1_0101 | 26 PKLLIKGGVEV-LEVK | LLIKGGVEV | 0.4633 | 332 | WB | VP1 |

TABLE Q-continued

Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB1_0101 | 151 FHFFAVGGD-PLEMQG | VGGDPLEMQ | 0.4633 | 333 | WB | VP1 |
| DRB1_0101 | 323 MYGMESQVEEVRVFDMYGMESQVE | | 0.4626 | 335 | WB | VP1 |
| DRB1_0101 | 150 NFHFFAVGGD-PLEMQ | AVGGDPLEM | 0.4611 | 340 | WB | VP1 |
| DRB1_0101 | 223 FGTYTGGENVP-PVLH | YTGGENVPP | 0.4596 | 346 | WB | VP1 |
| DRB1_0101 | 297 VKNPYPISFLLS-DLI | VKNPYPISF | 0.4588 | 349 | WB | VP1 |
| DRB1_0101 | 63 NLRGYSQHLSAE-NAF | YSQHLSAEN | 0.4583 | 351 | WB | VP1 |
| DRB1_0101 | 152 HFFAVGGD-PLEMQGV | VGGDPLEMQ | 0.4576 | 354 | WB | VP1 |
| DRB1_0101 | 286 RYFKIRLRKRS-VKNP | FKIRLRKRS | 0.4564 | 358 | WB | VP1 |
| DRB1_0101 | 64 LRGYSQHLSAE-NAFE | YSQHLSAEN | 0.4559 | 360 | WB | VP1 |
| DRB1_0101 | 220 TRYFGTYTGGEN-VPP | YFGTYTGGE | 0.4546 | 365 | WB | VP1 |
| DRB1_0101 | 301 YPISFLLSDLIN-RRT | ISFLLSDLI | 0.4540 | 368 | WB | VP1 |
| DRB1_0101 | 126 SMLNLHAGSQK-VHEN | MLNLHAGSQ | 0.4520 | 376 | WB | VP1 |
| DRB1_0101 | 34 VEVLEVKTGV-DAITE | VKTGVDAIT | 0.4507 | 381 | WB | VP1 |
| DRB1_0101 | 33 GVEVLEVKTGV-DAIT | VEVLEVKTG | 0.4499 | 385 | WB | VP1 |
| DRB1_0101 | 226 YTGGENVPPVL-HVTN | YTGGENVPP | 0.4471 | 397 | WB | VP1 |
| DRB1_0101 | 303 ISFLLSDLIN-RRTQK | LSDLINRRT | 0.4468 | 397 | WB | VP1 |
| DRB1_0101 | 153 FFAVGGD-PLEMQGVL | VGGDPLEMQ | 0.4446 | 407 | WB | VP1 |
| DRB1_0101 | 225 TYTGGENVPPVL-HVT | YTGGENVPP | 0.4439 | 410 | WB | VP1 |
| DRB1_0101 | 302 PISFLLSDLIN-RRTQ | LSDLINRRT | 0.4439 | 411 | WB | VP1 |
| DRB1_0101 | 36 VLEVKTGVDAIT-EVE | VKTGVDAIT | 0.4399 | 429 | WB | VP1 |
| DRB1_0101 | 35 EVLEVKTGV-DAITEV | VKTGVDAIT | 0.4395 | 430 | WB | VP1 |
| DRB1_0101 | 37 LEVKTGVDAIT-EVEC | VKTGVDAIT | 0.4381 | 437 | WB | VP1 |
| DRB1_0101 | 127 MLNLHAGSQK-VHENG | MLNLHAGSQ | 0.4375 | 440 | WB | VP1 |
| DRB1_0101 | 229 GENVPPVL-HVTNTAT | NVPPVLHVT | 0.4368 | 443 | WB | VP1 |
| DRB1_0101 | 60 PDDNLRGYSQHL-SAE | LRGYSQHLS | 0.4346 | 454 | WB | VP1 |
| DRB1_0101 | 59 DPDDNLR-GYSQHLSA | LRGYSQHLS | 0.4337 | 458 | WB | VP1 |
| DRB1_0101 | 65 RGYSQHLSAE-NAFES | YSQHLSAEN | 0.4335 | 459 | WB | VP1 |
| DRB1_0101 | 27 KLLIKGGVEV-LEVKT | LIKGGVEVL | 0.4331 | 461 | WB | VP1 |
| DRB1_0101 | 221 RYFGTYTGGEN-VPPV | YTGGENVPP | 0.4318 | 468 | WB | VP1 |
| DRB1_0101 | 296 SVKNPYPIS-FLLSDL | VKNPYPISF | 0.4317 | 468 | WB | VP1 |
| DRB1_0101 | 222 YFGTYTGGENVP-PVL | YTGGENVPP | 0.4313 | 470 | WB | VP1 |
| DRB1_0101 | 271 LFTNSSGTQQWR-GLA | FTNSSGTQQ | 0.4313 | 470 | WB | VP1 |
| DRB1_0101 | 58 GDPDDNLR-GYSQHLS | NLRGYSQHL | 0.4305 | 474 | WB | VP1 |
| DRB1_0101 | 281 WRGLARYFKIRL-RKR | WRGLARYFK | 0.4285 | 485 | WB | VP1 |
| DRB1_0101 | 276 SGTQQWRGLARY-FKI | WRGLARYFK | 0.4263 | 496 | WB | VP1 |
| DRB1_0101 | 154 FAVGGD-PLEMQGVLM | VGGDPLEMQ | 0.4261 | 498 | WB | VP1 |
| DRB1_0101 | 277 GTQQWRGLARY-FKIR | WRGLARYFK | 0.4259 | 498 | WB | VP1 |
| DRB1_0101 | 275 SSGTQQWR-GLARYFK | QQWRGLARY | 0.4258 | 499 | WB | VP1 |
| DRB1_0401 | 118 KTEVIGITSMLN-LHA | VIGITSMLN | 0.5278 | 165 | WB | VP1 |

TABLE Q-continued

Prediction of BK virus VP1 protein specific MHC class 2, 15-mer peptide binders for 14 MHC class 2 alleles (see TABLE Q-continued Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB1_0404 | 265 AADICGLFTNSSGTQ | ICGLFTNSS | 0.5081 | 205 | WB | VP1 |
| DRB1_0404 | 167 LMNYRTKYPQGTITP | LMNYRTKYP | 0.5069 | 208 | WB | VP1 |
| DRB1_0404 | 304 SFLLSDLINRRTQKV | LLSDLINRR | 0.4931 | 241 | WB | VP1 |
| DRB1_0404 | 301 YPISFLLSDLINRRT | LLSDLINRR | 0.4876 | 256 | WB | VP1 |
| DRB1_0404 | 119 TEVIGITSMLNLHAG | ITSMLNLHA | 0.4851 | 263 | WB | VP1 |
| DRB1_0404 | 302 PISFLLSDLINRRTQ | LLSDLINRR | 0.4821 | 271 | WB | VP1 |
| DRB1_0404 | 303 ISFLLSDLINRRTQK | LLSDLINRR | 0.4816 | 273 | WB | VP1 |
| DRB1_0404 | 118 KTEVIGITSMLNLHA | VIGITSMLN | 0.4807 | 275 | WB | VP1 |
| DRB1_0404 | 46 ITEVECFLNPEMGDP | TEVECFLNP | 0.4807 | 275 | WB | VP1 |
| DRB1_0404 | 47 TEVECFLNPEMGDPD | FLNPEMGDP | 0.4801 | 277 | WB | VP1 |
| DRB1_0404 | 48 EVECFLNPEMGDPDD | FLNPEMGDP | 0.4754 | 292 | WB | VP1 |
| DRB1_0404 | 50 ECFLNPEMGDPDDNL | FLNPEMGDP | 0.4751 | 293 | WB | VP1 |
| DRB1_0404 | 49 VECFLNPEMGDPDDN | FLNPEMGDP | 0.4745 | 295 | WB | VP1 |
| DRB1_0404 | 267 DICGLFTNSSGTQQW | LFTNSSGTQ | 0.4682 | 315 | WB | VP1 |
| DRB1_0404 | 268 ICGLFTNSSGTQQWR | LFTNSSGTQ | 0.4665 | 321 | WB | VP1 |
| DRB1_0404 | 84 RKMLPCYSTARIPLP | MLPCYSTAR | 0.4629 | 334 | WB | VP1 |
| DRB1_0404 | 105 TCGNLLMWEAVTVKT | LMWEAVTVK | 0.4618 | 338 | WB | VP1 |
| DRB1_0404 | 106 CGNLLMWEAVTVKTE | LMWEAVTVK | 0.4597 | 346 | WB | VP1 |
| DRB1_0404 | 232 VPPVLHVTNTATTVL | LHVTNTATT | 0.4584 | 351 | WB | VP1 |
| DRB1_0404 | 300 PYPISFLLSDLINRR | FLLSDLINR | 0.4582 | 351 | WB | VP1 |
| DRB1_0404 | 120 EVIGITSMLNLHAGS | ITSMLNLHA | 0.4575 | 354 | WB | VP1 |
| DRB1_0404 | 107 GNLLMWEAVTVKTEV | LMWEAVTVK | 0.4552 | 363 | WB | VP1 |
| DRB1_0404 | 233 PPVLHVTNTATTVLL | LHVTNTATT | 0.4466 | 398 | WB | VP1 |
| DRB1_0404 | 230 ENVPPVLHVTNTATT | VLHVTNTAT | 0.4465 | 399 | WB | VP1 |
| DRB1_0404 | 108 NLLMWEAVTVKTEVI | LMWEAVTVK | 0.4456 | 403 | WB | VP1 |
| DRB1_0404 | 305 FLLSDLINRRTQKVD | LLSDLINRR | 0.4431 | 414 | WB | VP1 |
| DRB1_0404 | 192 NTDHKAYLDKNNAYP | KAYLDKNNA | 0.4422 | 418 | WB | VP1 |
| DRB1_0404 | 193 TDHKAYLDKNNAYPV | YLDKNNAYP | 0.4402 | 427 | WB | VP1 |
| DRB1_0404 | 231 NVPPVLHVTNTATTV | LHVTNTATT | 0.4401 | 428 | WB | VP1 |
| DRB1_0404 | 194 DHKAYLDKNNAYPVE | YLDKNNAYP | 0.4393 | 431 | WB | VP1 |
| DRB1_0404 | 85 KMLPCYSTARIPLPN | YSTARIPLP | 0.4335 | 459 | WB | VP1 |
| DRB1_0404 | 234 PVLHVTNTATTVLLD | LHVTNTATT | 0.4328 | 463 | WB | VP1 |
| DRB1_0404 | 195 HKAYLDKNNAYPVEC | YLDKNNAYP | 0.4303 | 476 | WB | VP1 |
| DRB1_0404 | 196 KAYLDKNNAYPVECW | YLDKNNAYP | 0.4288 | 483 | WB | VP1 |
| DRB1_0404 | 104 LTCGNLLMWEAVTVK | LLMWEAVTV | 0.4272 | 492 | WB | VP1 |
| DRB1_0405 | 205 YPVECWIPDPSRNEN | WIPDPSRNE | 0.4758 | 291 | WB | VP1 |
| DRB1_0405 | 204 AYPVECWIPDPSRNE | ECWIPDPSR | 0.4737 | 297 | WB | VP1 |
| DRB1_0405 | 118 KTEVIGITSMLNLHA | VIGITSMLN | 0.4649 | 327 | WB | VP1 |

TABLE Q-continued

Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB1_0405 | 119 TEVIGITSMLNLHAG | VIGITSMLN | 0.4617 | 338 | WB | VP1 |
| DRB1_0405 | 88 PCYSTARIPLPNLNE | YSTARIPLP | 0.4515 | 378 | WB | VP1 |
| DRB1_0405 | 206 PVECWIPDPSRNENT | WIPDPSRNE | 0.4387 | 434 | WB | VP1 |
| DRB1_0405 | 115 VTVKTEVIGITSMLN | TVKTEVIGI | 0.4272 | 492 | WB | VP1 |
| DRB1_0701 | 232 VPPVLHVTNTATTVL | VLHVTNTAT | 0.7832 | 10 | SB | VP1 |
| DRB1_0701 | 233 PPVLHVTNTATTVLL | VTNTATTVL | 0.7867 | 10 | SB | VP1 |
| DRB1_0701 | 234 PVLHVTNTATTVLLD | VTNTATTVL | 0.7821 | 11 | SB | VP1 |
| DRB1_0701 | 235 VLHVTNTATTVLLDE | VTNTATTVL | 0.7792 | 11 | SB | VP1 |
| DRB1_0701 | 236 LHVTNTATTVLLDEQ | VTNTATTVL | 0.7807 | 11 | SB | VP1 |
| DRB1_0701 | 237 HVTNTATTVLLDEQG | VTNTATTVL | 0.6865 | 30 | SB | VP1 |
| DRB1_0701 | 238 VTNTATTVLLDEQGV | VTNTATTVL | 0.6833 | 31 | SB | VP1 |
| DRB1_0701 | 304 SFLLSDLINRRTQKV | LSDLINRRT | 0.5382 | 148 | WB | VP1 |
| DRB1_0701 | 308 SDLINRRTQKVDGQP | LINRRTQKV | 0.5370 | 150 | WB | VP1 |
| DRB1_0701 | 305 FLLSDLINRRTQKVD | LINRRTQKV | 0.5365 | 151 | WB | VP1 |
| DRB1_0701 | 306 LLSDLINRRTQKVDG | LINRRTQKV | 0.5340 | 155 | WB | VP1 |
| DRB1_0701 | 307 LSDLINRRTQKVDGQ | LINRRTQKV | 0.5332 | 156 | WB | VP1 |
| DRB1_0701 | 231 NVPPVLHVTNTATTV | VLHVTNTAT | 0.4751 | 293 | WB | VP1 |
| DRB1_0701 | 107 GNLLMWEAVTVKTEV | LLMWEAVTV | 0.4593 | 347 | WB | VP1 |
| DRB1_0701 | 105 TCGNLLMWEAVTVKT | LLMWEAVTV | 0.4539 | 368 | WB | VP1 |
| DRB1_0701 | 106 CGNLLMWEAVTVKTE | LLMWEAVTV | 0.4530 | 372 | WB | VP1 |
| DRB1_0701 | 104 LTCGNLLMWEAVTVK | LLMWEAVTV | 0.4517 | 377 | WB | VP1 |
| DRB1_0701 | 103 DLTCGNLLMWEAVTV | LTCGNLLMW | 0.4475 | 395 | WB | VP1 |
| DRB1_0701 | 230 ENVPPVLHVTNTATT | VLHVTNTAT | 0.4461 | 401 | WB | VP1 |
| DRB1_0701 | 309 DLINRRTQKVDGQPM | LINRRTQKV | 0.4383 | 436 | WB | VP1 |
| DRB1_0701 | 310 LINRRTQKVDGQPMY | LINRRTQKV | 0.4370 | 442 | WB | VP1 |
| DRB1_0701 | 285 ARYFKIRLRKRSVKN | YFKIRLRKR | 0.4289 | 483 | WB | VP1 |
| DRB1_0701 | 249 EQGVGPLCKADSLYV | PLCKADSLY | 0.4260 | 498 | WB | VP1 |
| DRB1_0802 | 282 RGLARYFKIRLRKRS | RGLARYFKI | 0.5826 | 91 | WB | VP1 |
| DRB1_0802 | 283 GLARYFKIRLRKRSV | FKIRLRKRS | 0.5827 | 91 | WB | VP1 |
| DRB1_0802 | 284 LARYFKIRLRKRSVK | FKIRLRKRS | 0.5824 | 92 | WB | VP1 |
| DRB1_0802 | 285 ARYFKIRLRKRSVKN | FKIRLRKRS | 0.5816 | 92 | WB | VP1 |
| DRB1_0802 | 286 RYFKIRLRKRSVKNP | FKIRLRKRS | 0.5825 | 92 | WB | VP1 |
| DRB1_0802 | 287 YFKIRLRKRSVKNPY | FKIRLRKRS | 0.4907 | 247 | WB | VP1 |
| DRB1_0802 | 288 FKIRLRKRSVKNPYP | FKIRLRKRS | 0.4905 | 248 | WB | VP1 |
| DRB1_0901 | 84 RKMLPCYSTARIPLP | LPCYSTARI | 0.5150 | 190 | WB | VP1 |
| DRB1_0901 | 85 KMLPCYSTARIPLPN | YSTARIPLP | 0.5124 | 195 | WB | VP1 |
| DRB1_0901 | 86 MLPCYSTARIPLPNL | YSTARIPLP | 0.4991 | 226 | WB | VP1 |
| DRB1_0901 | 87 LPCYSTARIPLPNLN | YSTARIPLP | 0.4968 | 231 | WB | VP1 |

TABLE Q-continued

Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB1_0901 | 88 PCYSTARIPLPN-LNE | YSTARIPLP | 0.4598 | 345 | WB | VP1 |
| DRB1_1101 | 276 SGTQQWRGLARY-FKI | WRGLARYFK | 0.5202 | 180 | WB | VP1 |
| DRB1_1101 | 277 GTQQWRGLARY-FKIR | WRGLARYFK | 0.5200 | 180 | WB | VP1 |
| DRB1_1101 | 278 TQQWRGLARY-FKIRL | WRGLARYFK | 0.5165 | 187 | WB | VP1 |
| DRB1_1101 | 275 SSGTQQWR-GLARYFK | QQWRGLARY | 0.5148 | 191 | WB | VP1 |
| DRB1_1101 | 279 QQWRGLARY-FKIRLR | WRGLARYFK | 0.5146 | 191 | WB | VP1 |
| DRB1_1101 | 281 WRGLARYFKIRL-RKR | WRGLARYFK | 0.4569 | 357 | WB | VP1 |
| DRB1_1101 | 280 QWRGLARY-FKIRLRK | WRGLARYFK | 0.4404 | 426 | WB | VP1 |
| DRB1_1302 | 161 LEMQGVLMNYRT-KYP | VLMNYRTKY | 0.6366 | 51 | WB | VP1 |
| DRB1_1302 | 162 EMQGVLMNYRT-KYPQ | VLMNYRTKY | 0.6357 | 51 | WB | VP1 |
| DRB1_1302 | 163 MQGVLMNYRT-KYPQG | VLMNYRTKY | 0.6190 | 62 | WB | VP1 |
| DRB1_1302 | 164 QGVLMNYRT-KYPQGT | VLMNYRTKY | 0.6178 | 63 | WB | VP1 |
| DRB1_1302 | 160 PLEMQGVLM-NYRTKY | QGVLMNYRT | 0.6118 | 67 | WB | VP1 |
| DRB1_1302 | 233 PPVLHVTNTATT-VLL | VTNTATTVL | 0.6016 | 75 | WB | VP1 |
| DRB1_1302 | 234 PVLHVTNTATTV-LLD | VTNTATTVL | 0.5831 | 91 | WB | VP1 |
| DRB1_1302 | 232 VPPVLHVTNTAT-TVL | VLHVTNTAT | 0.5808 | 93 | WB | VP1 |
| DRB1_1302 | 235 VLHVTNTATTV-LLDE | VTNTATTVL | 0.5658 | 110 | WB | VP1 |
| DRB1_1302 | 284 LARYFKIRL-RKRSVK | FKIRLRKRS | 0.5521 | 127 | WB | VP1 |
| DRB1_1302 | 165 GVLMNYRT-KYPQGTI | VLMNYRTKY | 0.5482 | 133 | WB | VP1 |
| DRB1_1302 | 285 ARYFKIRLRKRS-VKN | FKIRLRKRS | 0.5453 | 137 | WB | VP1 |
| DRB1_1302 | 286 RYFKIRLRKRS-VKNP | FKIRLRKRS | 0.5448 | 138 | WB | VP1 |
| DRB1_1302 | 287 YFKIRLRKRS-VKNPY | IRLRKRSVK | 0.5427 | 141 | WB | VP1 |
| DRB1_1302 | 236 LHVTNTATTVLL-DEQ | VTNTATTVL | 0.5416 | 143 | WB | VP1 |
| DRB1_1302 | 288 FKIRLRKRSVKN-PYP | IRLRKRSVK | 0.5351 | 153 | WB | VP1 |
| DRB1_1302 | 117 VKTEVIG-ITSMLNLH | IGITSMLNL | 0.5226 | 175 | WB | VP1 |
| DRB1_1302 | 166 VLMNYRT-KYPQGTIT | VLMNYRTKY | 0.5220 | 176 | WB | VP1 |
| DRB1_1302 | 116 TVKTEVIG-ITSMLNL | EVIGITSML | 0.5120 | 196 | WB | VP1 |
| DRB1_1302 | 282 RGLARYFKIRL-RKRS | LARYFKIRL | 0.4951 | 236 | WB | VP1 |
| DRB1_1302 | 118 KTEVIGITSMLN-LHA | IGITSMLNL | 0.4947 | 237 | WB | VP1 |
| DRB1_1302 | 283 GLARYFKIRL-RKRSV | FKIRLRKRS | 0.4916 | 245 | WB | VP1 |
| DRB1_1302 | 304 SFLLSDLIN-RRTQKV | LLSDLINRR | 0.4893 | 251 | WB | VP1 |
| DRB1_1302 | 305 FLLSDLIN-RRTQKVD | LINRRTQKV | 0.4877 | 255 | WB | VP1 |
| DRB1_1302 | 119 TEVIGITSMLNL-HAG | IGITSMLNL | 0.4792 | 280 | WB | VP1 |
| DRB1_1302 | 120 EVIGITSMLNL-HAGS | IGITSMLNL | 0.4786 | 282 | WB | VP1 |
| DRB1_1302 | 91 STARIPLPN-LNEDLT | ARIPLPNLN | 0.4726 | 301 | WB | VP1 |
| DRB1_1302 | 237 HVTNTATTVLLD-EQG | VTNTATTVL | 0.4703 | 308 | WB | VP1 |
| DRB1_1302 | 95 IPLPN-LNEDLTCGNL | LPNLNEDLT | 0.4680 | 316 | WB | VP1 |
| DRB1_1302 | 93 ARIPLPN-LNEDLTCG | LPNLNEDLT | 0.4675 | 318 | WB | VP1 |

TABLE Q-continued

Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB1_1302 | 94 RIPLPNLNEDLTCGN | LPNLNEDLT | 0.4673 | 318 | WB | VP1 |
| DRB1_1302 | 159 DPLEMQGVLMNYRTK | QGVLMNYRT | 0.4669 | 320 | WB | VP1 |
| DRB1_1302 | 92 TARIPLPNLNEDLTC | LPNLNEDLT | 0.4645 | 328 | WB | VP1 |
| DRB1_1302 | 158 GDPLEMQGVLMNYRT | LEMQGVLMN | 0.4643 | 329 | WB | VP1 |
| DRB1_1302 | 289 KIRLRKRSVKNPYPI | RKRSVKNPY | 0.4576 | 354 | WB | VP1 |
| DRB1_1302 | 290 IRLRKRSVKNPYPIS | RKRSVKNPY | 0.4565 | 358 | WB | VP1 |
| DRB1_1302 | 306 LLSDLINRRTQKVDG | LINRRTQKV | 0.4527 | 373 | WB | VP1 |
| DRB1_1302 | 122 IGITSMLNLHAGSQK | IGITSMLNL | 0.4502 | 383 | WB | VP1 |
| DRB1_1302 | 115 VTVKTEVIGITSMLN | VKTEVIGIT | 0.4481 | 392 | WB | VP1 |
| DRB1_1302 | 114 AVTVKTEVIGITSML | VKTEVIGIT | 0.4425 | 417 | WB | VP1 |
| DRB1_1302 | 238 VTNTATTVLLDEQGV | VTNTATTVL | 0.4366 | 444 | WB | VP1 |
| DRB1_1302 | 307 LSDLINRRTQKVDGQ | LINRRTQKV | 0.4354 | 450 | WB | VP1 |
| DRB1_1302 | 23 VQVPKLLIKGGVEVL | LLIKGGVEV | 0.4322 | 466 | WB | VP1 |
| DRB1_1302 | 266 ADICGLFTNSSGTQQ | LFTNSSGTQ | 0.4320 | 466 | WB | VP1 |
| DRB1_1302 | 267 DICGLFTNSSGTQQW | FTNSSGTQQ | 0.4291 | 481 | WB | VP1 |
| DRB1_1501 | 283 GLARYFKIRLRKRSV | YFKIRLRKR | 0.6573 | 41 | SB | VP1 |
| DRB1_1501 | 282 RGLARYFKIRLRKRS | YFKIRLRKR | 0.6478 | 45 | SB | VP1 |
| DRB1_1501 | 284 LARYFKIRLRKRSVK | YFKIRLRKR | 0.6478 | 45 | SB | VP1 |
| DRB1_1501 | 285 ARYFKIRLRKRSVKN | YFKIRLRKR | 0.6480 | 45 | SB | VP1 |
| DRB1_1501 | 281 WRGLARYFKIRLRKR | ARYFKIRLR | 0.6307 | 54 | WB | VP1 |
| DRB1_1501 | 286 RYFKIRLRKRSVKNP | YFKIRLRKR | 0.5738 | 101 | WB | VP1 |
| DRB1_1501 | 279 QQWRGLARYFKIRLR | WRGLARYFK | 0.5664 | 109 | WB | VP1 |
| DRB1_1501 | 287 YFKIRLRKRSVKNPY | YFKIRLRKR | 0.5644 | 111 | WB | VP1 |
| DRB1_1501 | 301 YPISFLLSDLINRRT | FLLSDLINR | 0.5442 | 139 | WB | VP1 |
| DRB1_1501 | 280 QWRGLARYFKIRLRK | ARYFKIRLR | 0.5432 | 140 | WB | VP1 |
| DRB1_1501 | 302 PISFLLSDLINRRTQ | FLLSDLINR | 0.5326 | 157 | WB | VP1 |
| DRB1_1501 | 303 ISFLLSDLINRRTQK | FLLSDLINR | 0.5312 | 160 | WB | VP1 |
| DRB1_1501 | 304 SFLLSDLINRRTQKV | LLSDLINRR | 0.5284 | 165 | WB | VP1 |
| DRB1_1501 | 300 PYPISFLLSDLINRR | FLLSDLINR | 0.5247 | 171 | WB | VP1 |
| DRB1_1501 | 305 FLLSDLINRRTQKVD | FLLSDLINR | 0.5067 | 208 | WB | VP1 |
| DRB1_1501 | 104 LTCGNLLMWEAVTVK | LLMWEAVTV | 0.5050 | 212 | WB | VP1 |
| DRB1_1501 | 105 TCGNLLMWEAVTVKT | LLMWEAVTV | 0.5048 | 212 | WB | VP1 |
| DRB1_1501 | 107 GNLLMWEAVTVKTEV | LLMWEAVTV | 0.5033 | 216 | WB | VP1 |
| DRB1_1501 | 106 CGNLLMWEAVTVKTE | LLMWEAVTV | 0.5029 | 217 | WB | VP1 |
| DRB1_1501 | 161 LEMQGVLMNYRTKYP | MQGVLMNYR | 0.4970 | 231 | WB | VP1 |
| DRB1_1501 | 278 TQQWRGLARYFKIRL | WRGLARYFK | 0.4915 | 245 | WB | VP1 |
| DRB1_1501 | 275 SSGTQQWRGLARYFK | TQQWRGLAR | 0.4823 | 271 | WB | VP1 |
| DRB1_1501 | 276 SGTQQWRGLARYFKI | TQQWRGLAR | 0.4818 | 272 | WB | VP1 |

TABLE Q-continued

Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB1_1501 | 163 MQGVLMNYRT-KYPQG | MQGVLMNYR | 0.4769 | 287 | WB | VP1 |
| DRB1_1501 | 299 NPYPISFLLS-DLINR | ISFLLSDLI | 0.4742 | 296 | WB | VP1 |
| DRB1_1501 | 162 EMQGVLMNYRT-KYPQ | MQGVLMNYR | 0.4707 | 307 | WB | VP1 |
| DRB1_1501 | 288 FKIRLRKRSVKN-PYP | IRLRKRSVK | 0.4578 | 353 | WB | VP1 |
| DRB1_1501 | 277 GTQQWRGLARY-FKIR | WRGLARYFK | 0.4564 | 358 | WB | VP1 |
| DRB1_1501 | 108 NLLMWEAVTVK-TEVI | LLMWEAVTV | 0.4524 | 374 | WB | VP1 |
| DRB1_1501 | 160 PLEMQGVLM-NYRTKY | MQGVLMNYR | 0.4445 | 408 | WB | VP1 |
| DRB1_1501 | 122 IGITSMLNLHAG-SQK | ITSMLNLHA | 0.4316 | 469 | WB | VP1 |
| DRB4_0101 | 205 YPVECWIP-DPSRNEN | VECWIPDPS | 0.5233 | 174 | WB | VP1 |
| DRB4_0101 | 203 NAYPVECWIP-DPSRN | VECWIPDPS | 0.5154 | 189 | WB | VP1 |
| DRB4_0101 | 204 AYPVECWIP-DPSRNE | VECWIPDPS | 0.5145 | 191 | WB | VP1 |
| DRB4_0101 | 202 NNAYPVECWIP-DPSR | VECWIPDPS | 0.5002 | 223 | WB | VP1 |
| DRB4_0101 | 201 KNNAYPVECWIP-DPS | YPVECWIPD | 0.4824 | 271 | WB | VP1 |
| DRB4_0101 | 206 PVECWIPDPSR-NENT | VECWIPDPS | 0.4517 | 377 | WB | VP1 |
| DRB4_0101 | 207 VECWIPDPSR-NENTR | VECWIPDPS | 0.4492 | 388 | WB | VP1 |
| DRB5_0101 | 285 ARYFKIRLRKRS-VKN | FKIRLRKRS | 0.6288 | 55 | WB | VP1 |
| DRB5_0101 | 284 LARYFKIRL-RKRSVK | FKIRLRKRS | 0.6287 | 56 | WB | VP1 |
| DRB5_0101 | 282 RGLARYFKIRL-RKRS | YFKIRLRKR | 0.6211 | 60 | WB | VP1 |
| DRB5_0101 | 283 GLARYFKIRL-RKRSV | FKIRLRKRS | 0.6196 | 61 | WB | VP1 |
| DRB5_0101 | 286 RYFKIRLRKRS-VKNP | FKIRLRKRS | 0.5991 | 77 | WB | VP1 |
| DRB5_0101 | 287 YFKIRLRKRS-VKNPY | FKIRLRKRS | 0.5403 | 145 | WB | VP1 |
| DRB5_0101 | 281 WRGLARYFKIRL-RKR | WRGLARYFK | 0.4956 | 235 | WB | VP1 |
| DRB5_0101 | 288 FKIRLRKRSVKN-PYP | FKIRLRKRS | 0.4834 | 267 | WB | VP1 |
| DRB5_0101 | 164 QGVLMNYRT-KYPQGT | LMNYRTKYP | 0.4622 | 337 | WB | VP1 |
| DRB5_0101 | 165 GVLMNYRT-KYPQGTI | YRTKYPQGT | 0.4558 | 361 | WB | VP1 |
| DRB5_0101 | 177 GTITP-KNPTAQSQVM | ITPKNPTAQ | 0.4497 | 386 | WB | VP1 |
| DRB5_0101 | 71 LSAENAFESDSP-DRK | AFESDSPDR | 0.4477 | 394 | WB | VP1 |
| DRB5_0101 | 72 SAENAFESDSP-DRKM | FESDSPDRK | 0.4472 | 396 | WB | VP1 |
| DRB5_0101 | 73 AENAFESDSP-DRKML | FESDSPDRK | 0.4469 | 397 | WB | VP1 |
| DRB5_0101 | 173 KYPQGTITP-KNPTAQ | QGTITPKNP | 0.4468 | 398 | WB | VP1 |
| DRB5_0101 | 74 ENAFESDSPDRK-MLP | FESDSPDRK | 0.4464 | 400 | WB | VP1 |
| DRB5_0101 | 275 SSGTQQWR-GLARYFK | TQQWRGLAR | 0.4455 | 403 | WB | VP1 |
| DRB5_0101 | 174 YPQGTITP-KNPTAQS | ITPKNPTAQ | 0.4442 | 409 | WB | VP1 |
| DRB5_0101 | 276 SGTQQWRGLARY-FKI | WRGLARYFK | 0.4440 | 410 | WB | VP1 |
| DRB5_0101 | 279 QQWRGLARY-FKIRLR | WRGLARYFK | 0.4423 | 417 | WB | VP1 |
| DRB5_0101 | 277 GTQQWRGLARY-FKIR | WRGLARYFK | 0.4408 | 424 | WB | VP1 |
| DRB5_0101 | 278 TQQWRGLARY-FKIRL | WRGLARYFK | 0.4408 | 424 | WB | VP1 |
| DRB5_0101 | 176 QGTITP-KNPTAQSQV | ITPKNPTAQ | 0.4392 | 432 | WB | VP1 |

TABLE Q-continued

Prediction of BK virus VP1 protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allel | pospeptide | core | 1-log50k(aff) | aff(nM) | Bind level | Identity |
|---|---|---|---|---|---|---|
| DRB5_0101 | 175 PQGTITP-KNPTAQSQ | ITPKNPTAQ | 0.4390 | 433 | WB | VP1 |
| DRB5_0101 | 166 VLMNYRT-KYPQGTIT | YRTKYPQGT | 0.4344 | 455 | WB | VP1 |
| DRB5_0101 | 168 MNYRT-KYPQGTITPK | YRTKYPQGT | 0.4342 | 456 | WB | VP1 |
| DRB5_0101 | 75 NAFESDSPDRKM-LPC | FESDSPDRK | 0.4294 | 480 | WB | VP1 |

SEQ ID NOS.: 59136-59917

Preferred BK virus fragments of small T antigen capable of interacting with one or more MHC class 2 molecules are listed in Table R.

TABLE R

Prediction of BK virus small t protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0101 | 21 RAAWGNLPLMR-KAYL | WGNLPLMRK | 0.6972 | 26 | SB | Small t |
| DRB1_0101 | 19 LERAAWGNLPLM-RKA | WGNLPLMRK | 0.6958 | 27 | SB | Small t |
| DRB1_0101 | 20 ERAAWGNLPLMR-KAY | WGNLPLMRK | 0.6940 | 27 | SB | Small t |
| DRB1_0101 | 22 AAWGNLPLMR-KAYLK | WGNLPLMRK | 0.6954 | 27 | SB | Small t |
| DRB1_0101 | 18 GLERAAWGNL-PLMRK | ERAAWGNLP | 0.6928 | 28 | SB | Small t |
| DRB1_0101 | 24 WGNLPLMRKAY-LKKC | WGNLPLMRK | 0.6020 | 74 | WB | Small t |
| DRB1_0101 | 23 AWGNLPLMRKAY-LKK | WGNLPLMRK | 0.6000 | 76 | WB | Small t |
| DRB1_0101 | 110 PCMLCQLRLRHL-NRK | LCQLRLRHL | 0.5884 | 86 | WB | Small t |
| DRB1_0101 | 111 CMLCQLRLRHLN-RKF | LCQLRLRHL | 0.5833 | 91 | WB | Small t |
| DRB1_0101 | 108 HCPCMLCQLRL-RHLN | LCQLRLRHL | 0.5732 | 101 | WB | Small t |
| DRB1_0101 | 107 VHCPCMLCQLRL-RHL | PCMLCQLRL | 0.5712 | 104 | WB | Small t |
| DRB1_0101 | 109 CPCMLCQLRL-RHLNR | LCQLRLRHL | 0.5711 | 104 | WB | Small t |
| DRB1_0101 | 11 MELMDLLGLER-AAWG | MDLLGLERA | 0.5102 | 200 | WB | Small t |
| DRB1_0101 | 113 LCQLRLRHLNRK-FLR | LCQLRLRHL | 0.5082 | 205 | WB | Small t |
| DRB1_0101 | 112 MLCQLRLRHLN-RKFL | LCQLRLRHL | 0.5077 | 206 | WB | Small t |
| DRB1_0101 | 121 LNRKFLRKE-PLVWID | LRKEPLVWI | 0.4900 | 249 | WB | Small t |
| DRB1_0101 | 120 HLNRKFLRKE-PLVWI | FLRKEPLVW | 0.4888 | 252 | WB | Small t |
| DRB1_0101 | 12 ELMDLLGLER-AAWGN | MDLLGLERA | 0.4876 | 256 | WB | Small t |
| DRB1_0101 | 122 NRKFLRKE-PLVWIDC | LRKEPLVWI | 0.4836 | 267 | WB | Small t |
| DRB1_0101 | 8 EESMELMDLL-GLERA | LMDLLGLER | 0.4834 | 268 | WB | Small t |
| DRB1_0101 | 123 RKFLRKE-PLVWIDCY | LRKEPLVWI | 0.4822 | 271 | WB | Small t |
| DRB1_0101 | 9 ESMELMDLL-GLERAA | LMDLLGLER | 0.4823 | 271 | WB | Small t |
| DRB1_0101 | 48 DEDKMKRMNT-LYKKM | MKRMNTLYK | 0.4796 | 279 | WB | Small t |
| DRB1_0101 | 47 GDEDKMKRMNT-LYKK | MKRMNTLYK | 0.4754 | 292 | WB | Small t |
| DRB1_0101 | 10 SMELMDLLGLER-AAW | MDLLGLERA | 0.4730 | 299 | WB | Small t |

TABLE R-continued

Prediction of BK virus small t protein specific MHC class 2, 15-mer peptide binders for 14 MHC class 2 alleles (see TABLE R-continued Prediction of BK virus small t protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0405 | 18 GLERAAWGNLPLMRK | RAAWGNLPL | 0.5095 | 202 | WB | Small t |
| DRB1_0405 | 19 LERAAWGNLPLMRKA | RAAWGNLPL | 0.4956 | 235 | WB | Small t |
| DRB1_0405 | 137 YCIDCFTQWFGLDLT | FTQWFGLDL | 0.4951 | 236 | WB | Small t |
| DRB1_0405 | 139 IDCFTQWFGLDLTEE | TQWFGLDLT | 0.4864 | 259 | WB | Small t |
| DRB1_0405 | 51 KMKRMNTLYKKMEQD | MKRMNTLYK | 0.4857 | 261 | WB | Small t |
| DRB1_0405 | 52 MKRMNTLYKKMEQDV | MKRMNTLYK | 0.4857 | 261 | WB | Small t |
| DRB1_0405 | 138 CIDCFTQWFGLDLTE | TQWFGLDLT | 0.4851 | 263 | WB | Small t |
| DRB1_0405 | 155 LQWWVQIIGETPFRD | LQWWVQIIG | 0.4691 | 312 | WB | Small t |
| DRB1_0405 | 140 DCFTQWFGLDLTEET | TQWFGLDLT | 0.4671 | 319 | WB | Small t |
| DRB1_0405 | 69 AHQPDFGTWNSSEVC | FGTWNSSEV | 0.4648 | 327 | WB | Small t |
| DRB1_0405 | 68 VAHQPDFGTWNSSEV | QPDFGTWNS | 0.4624 | 336 | WB | Small t |
| DRB1_0405 | 20 ERAAWGNLPLMRKAY | WGNLPLMRK | 0.4570 | 356 | WB | Small t |
| DRB1_0405 | 71 QPDFGTWNSSEVCAD | FGTWNSSEV | 0.4550 | 364 | WB | Small t |
| DRB1_0405 | 17 LGLERAAWGNLPLMR | RAAWGNLPL | 0.4515 | 378 | WB | Small t |
| DRB1_0405 | 70 HQPDFGTWNSSEVCA | FGTWNSSEV | 0.4467 | 398 | WB | Small t |
| DRB1_0405 | 154 TLQWWVQIIGETPFR | LQWWVQIIG | 0.4465 | 399 | WB | Small t |
| DRB1_0405 | 16 LLGLERAAWGNLPLM | RAAWGNLPL | 0.4465 | 399 | WB | Small t |
| DRB1_0405 | 15 DLLGLERAAWGNLPL | ERAAWGNLP | 0.4401 | 427 | WB | Small t |
| DRB1_0405 | 136 CYCIDCFTQWFGLDL | IDCFTQWFG | 0.4322 | 465 | WB | Small t |
| DRB1_0405 | 141 CFTQWFGLDLTEETL | TQWFGLDLT | 0.4323 | 465 | WB | Small t |
| DRB1_0405 | 72 PDFGTWNSSEVCADF | FGTWNSSEV | 0.4300 | 477 | WB | Small t |
| DRB1_0701 | 95 CKEWPICSKKPSVHC | ICSKKPSVH | 0.4880 | 255 | WB | Small t |
| DRB1_0701 | 96 KEWPICSKKPSVHCP | ICSKKPSVH | 0.4829 | 269 | WB | Small t |
| DRB1_0701 | 97 EWPICSKKPSVHCPC | ICSKKPSVH | 0.4823 | 271 | WB | Small t |
| DRB1_0701 | 98 WPICSKKPSVHCPCM | ICSKKPSVH | 0.4807 | 276 | WB | Small t |
| DRB1_0701 | 94 YCKEWPICSKKPSVH | PICSKKPSV | 0.4738 | 297 | WB | Small t |
| DRB1_0701 | 70 HQPDFGTWNSSEVCA | FGTWNSSEV | 0.4721 | 303 | WB | Small t |
| DRB1_0701 | 71 QPDFGTWNSSEVCAD | FGTWNSSEV | 0.4716 | 304 | WB | Small t |
| DRB1_0701 | 68 VAHQPDFGTWNSSEV | DFGTWNSSE | 0.4709 | 306 | WB | Small t |
| DRB1_0701 | 69 AHQPDFGTWNSSEVC | FGTWNSSEV | 0.4705 | 308 | WB | Small t |
| DRB1_0701 | 72 PDFGTWNSSEVCADF | FGTWNSSEV | 0.4685 | 314 | WB | Small t |
| DRB1_1101 | 47 GDEDKMKRMNTLYKK | MKRMNTLYK | 0.4550 | 364 | WB | Small t |
| DRB1_1101 | 49 EDKMKRMNTLYKKME | MKRMNTLYK | 0.4498 | 385 | WB | Small t |
| DRB1_1101 | 48 DEDKMKRMNTLYKKM | MKRMNTLYK | 0.4495 | 386 | WB | Small t |
| DRB1_1101 | 50 DKMKRMNTLYKKMEQ | MKRMNTLYK | 0.4483 | 391 | WB | Small t |
| DRB1_1101 | 46 GGDEDKMKRMNTLYK | EDKMKRMNT | 0.4433 | 413 | WB | Small t |
| DRB1_1101 | 18 GLERAAWGNLPLMRK | AWGNLPLMR | 0.4312 | 471 | WB | Small t |
| DRB1_1101 | 19 LERAAWGNLPLMRKA | WGNLPLMRK | 0.4311 | 471 | WB | Small t |

TABLE R-continued

Prediction of BK virus small t protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. | Identity |
|---|---|---|---|---|---|---|
| DRB1_1101 | 21 RAAWGNLPLMR-KAYL | WGNLPLMRK | 0.4288 | 483 | WB | Small t |
| DRB1_1101 | 20 ERAAWGNLPLMR-KAY | WGNLPLMRK | 0.4279 | 488 | WB | Small t |
| DRB1_1302 | 18 GLERAAWGNL-PLMRK | LERAAWGNL | 0.5752 | 99 | WB | Small t |
| DRB1_1302 | 21 RAAWGNLPLMR-KAYL | WGNLPLMRK | 0.5714 | 103 | WB | Small t |
| DRB1_1302 | 22 AAWGNLPLMR-KAYLK | WGNLPLMRK | 0.5704 | 104 | WB | Small t |
| DRB1_1302 | 19 LERAAWGNLPLM-RKA | WGNLPLMRK | 0.5702 | 105 | WB | Small t |
| DRB1_1302 | 20 ERAAWGNLPLMR-KAY | WGNLPLMRK | 0.5531 | 126 | WB | Small t |
| DRB1_1302 | 48 DEDKMKRMNT-LYKKM | MKRMNTLYK | 0.5012 | 221 | WB | Small t |
| DRB1_1302 | 49 EDKMKRMNTLYK-KME | MKRMNTLYK | 0.4986 | 227 | WB | Small t |
| DRB1_1302 | 50 DKMKRMNTLYK-KMEQ | MKRMNTLYK | 0.4966 | 232 | WB | Small t |
| DRB1_1302 | 47 GDEDKMKRMNT-LYKK | MKRMNTLYK | 0.4940 | 239 | WB | Small t |
| DRB1_1302 | 24 WGNLPLMRKAY-LKKC | WGNLPLMRK | 0.4926 | 242 | WB | Small t |
| DRB1_1302 | 23 AWGNLPLMRKAY-LKK | WGNLPLMRK | 0.4885 | 253 | WB | Small t |
| DRB1_1302 | 153 ETLQWWVQI-IGETPF | WWVQIIGET | 0.4827 | 270 | WB | Small t |
| DRB1_1302 | 46 GGDEDKMKRMNT-LYK | DKMKRMNTL | 0.4800 | 278 | WB | Small t |
| DRB1_1302 | 155 LQWWVQIIGETP-FRD | VQIIGETPF | 0.4679 | 317 | WB | Small t |
| DRB1_1302 | 154 TLQWWVQIIGET-PFR | VQIIGETPF | 0.4659 | 323 | WB | Small t |
| DRB1_1302 | 113 LCQLRLRHLNRK-FLR | LRLRHLNRK | 0.4607 | 342 | WB | Small t |
| DRB1_1302 | 112 MLCQLRLRHLN-RKFL | LRLRHLNRK | 0.4561 | 360 | WB | Small t |
| DRB1_1302 | 114 CQLRLRHLNRK-FLRK | LRLRHLNRK | 0.4549 | 364 | WB | Small t |
| DRB1_1302 | 156 QWWVQIIGETP-FRDL | VQIIGETPF | 0.4401 | 427 | WB | Small t |
| DRB1_1302 | 51 KMKRMNTLYK-KMEQD | MKRMNTLYK | 0.4272 | 492 | WB | Small t |
| DRB1_1501 | 111 CMLCQLRLRHLN-RKF | LRLRHLNRK | 0.5327 | 157 | WB | Small t |
| DRB1_1501 | 110 PCMLCQLRLRHL-NRK | QLRLRHLNR | 0.5274 | 166 | WB | Small t |
| DRB1_1501 | 48 DEDKMKRMNT-LYKKM | MKRMNTLYK | 0.5229 | 174 | WB | Small t |
| DRB1_1501 | 49 EDKMKRMNTLYK-KME | MKRMNTLYK | 0.5190 | 182 | WB | Small t |
| DRB1_1501 | 24 WGNLPLMRKAY-LKKC | LMRKAYLKK | 0.5176 | 185 | WB | Small t |
| DRB1_1501 | 113 LCQLRLRHLNRK-FLR | LRLRHLNRK | 0.5166 | 187 | WB | Small t |
| DRB1_1501 | 50 DKMKRMNTLYK-KMEQ | MKRMNTLYK | 0.5153 | 190 | WB | Small t |
| DRB1_1501 | 47 GDEDKMKRMNT-LYKK | MKRMNTLYK | 0.5147 | 191 | WB | Small t |
| DRB1_1501 | 112 MLCQLRLRHLN-RKFL | LRLRHLNRK | 0.5140 | 192 | WB | Small t |
| DRB1_1501 | 23 AWGNLPLMRKAY-LKK | LPLMRKAYL | 0.5076 | 206 | WB | Small t |
| DRB1_1501 | 25 GNLPLMRKAYLK-KCK | LMRKAYLKK | 0.5063 | 209 | WB | Small t |
| DRB1_1501 | 46 GGDEDKMKRMNT-LYK | DKMKRMNTL | 0.5026 | 217 | WB | Small t |
| DRB1_1501 | 26 NLPLMRKAYLK-KCKE | LMRKAYLKK | 0.4961 | 233 | WB | Small t |
| DRB1_1501 | 114 CQLRLRHLNRK-FLRK | LRLRHLNRK | 0.4919 | 244 | WB | Small t |
| DRB1_1501 | 27 LPLMRKAYLK-KCKEF | LMRKAYLKK | 0.4850 | 263 | WB | Small t |
| DRB1_1501 | 13 LMDLLGLER-AAWGNL | LMDLLGLER | 0.4683 | 315 | WB | Small t |

TABLE R-continued

Prediction of BK virus small t protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k(aff) | aff(nM) | B.L. | Identity |
|---|---|---|---|---|---|---|
| DRB1_1501 | 11 MELMDLLGLER-AAWG | LMDLLGLER | 0.4651 | 326 | WB | Small t |
| DRB1_1501 | 115 QLRLRHLNRKFL-RKE | LRLRHLNRK | 0.4643 | 329 | WB | Small t |
| DRB1_1501 | 120 HLNRKFLRKE-PLVWI | FLRKEPLVW | 0.4621 | 337 | WB | Small t |
| DRB1_1501 | 121 LNRKFLRKE-PLVWID | FLRKEPLVW | 0.4374 | 440 | WB | Small t |
| DRB1_1501 | 28 PLMRKAYLKKCK-EFH | LMRKAYLKK | 0.4332 | 461 | WB | Small t |
| DRB1_1501 | 51 KMKRMNTLYK-KMEQD | MKRMNTLYK | 0.4331 | 461 | WB | Small t |
| DRB1_1501 | 123 RKFLRKE-PLVWIDCY | FLRKEPLVW | 0.4300 | 477 | WB | Small t |
| DRB1_1501 | 10 SMELMDLLGLER-AAW | LMDLLGLER | 0.4261 | 497 | WB | Small t |
| DRB4_0101 | 94 YCKEWPICSK-KPSVH | YCKEWPICS | 0.5706 | 104 | WB | Small t |
| DRB4_0101 | 112 MLCQLRLRHLN-RKFL | LRLRHLNRK | 0.5364 | 151 | WB | Small t |
| DRB4_0101 | 113 LCQLRLRHLNRK-FLR | LRLRHLNRK | 0.5342 | 155 | WB | Small t |
| DRB4_0101 | 111 CMLCQLRLRHLN-RKF | LRLRHLNRK | 0.5331 | 156 | WB | Small t |
| DRB4_0101 | 110 PCMLCQLRLRHL-NRK | LCQLRLRHL | 0.5322 | 158 | WB | Small t |
| DRB4_0101 | 95 CKEWPICSKKPS-VHC | ICSKKPSVH | 0.5323 | 158 | WB | Small t |
| DRB4_0101 | 114 CQLRLRHLNRK-FLRK | LRLRHLNRK | 0.5291 | 163 | WB | Small t |
| DRB4_0101 | 96 KEWPICSKKPS-VHCP | ICSKKPSVH | 0.5267 | 167 | WB | Small t |
| DRB4_0101 | 97 EWPICSKKPSVH-CPC | ICSKKPSVH | 0.5247 | 171 | WB | Small t |
| DRB4_0101 | 98 WPICSKKPSVH-CPCM | ICSKKPSVH | 0.5172 | 186 | WB | Small t |
| DRB4_0101 | 115 QLRLRHLNRKFL-RKE | LRLRHLNRK | 0.4556 | 361 | WB | Small t |
| DRB4_0101 | 116 LRLRHLNRKFL-RKEP | LRLRHLNRK | 0.4510 | 380 | WB | Small t |
| DRB4_0101 | 100 ICSKKPSVHCPC-MLC | ICSKKPSVH | 0.4432 | 413 | WB | Small t |
| DRB4_0101 | 99 PICSKKPSVHCP-CML | ICSKKPSVH | 0.4374 | 440 | WB | Small t |
| DRB5_0101 | 49 EDKMKRMNTLYK-KME | MKRMNTLYK | 0.4763 | 289 | WB | Small t |
| DRB5_0101 | 50 DKMKRMNTLYK-KMEQ | MKRMNTLYK | 0.4758 | 290 | WB | Small t |
| DRB5_0101 | 48 DEDKMKRMNT-LYKKM | MKRMNTLYK | 0.4726 | 301 | WB | Small t |
| DRB5_0101 | 47 GDEDKMKRMNT-LYKK | MKRMNTLYK | 0.4617 | 338 | WB | Small t |
| DRB5_0101 | 46 GGDEDKMKRMNT-LYK | DKMKRMNTL | 0.4567 | 357 | WB | Small t |
| DRB5_0101 | 112 MLCQLRLRHLN-RKFL | LRLRHLNRK | 0.4397 | 429 | WB | Small t |
| DRB5_0101 | 114 CQLRLRHLNRK-FLRK | LRHLNRKFL | 0.4398 | 429 | WB | Small t |
| DRB5_0101 | 53 KRMNTLYK-KMEQDVK | KRMNTLYKK | 0.4284 | 485 | WB | Small t |
| DRB5_0101 | 22 AAWGNLPLMR-KAYLK | WGNLPLMRK | 0.4268 | 494 | WB | Small t |

SEQ ID NOS.: 59918-60257

Preferred BK virus fragments of large T antigen capable of interacting with one or more MHC class 2 molecules are listed in Table S.

TABLE S

Prediction of BK virus Large T protein specific MHC class 2, 15-mer peptide binders for 14 MHC class 2 alleles (see FIG. 11) using the www.cbs.dtu.dk/services/NetMHCII/database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0101 | 566 LEKRILQSGMTLLLL | LQSGMTLLL | 0.7526 | 15 | SB | Large T |
| DRB1_0101 | 567 EKRILQSGMTLLLLL | LQSGMTLLL | 0.7519 | 15 | SB | Large T |
| DRB1_0101 | 568 KRILQSGMTLLLLLI | LQSGMTLLL | 0.7525 | 15 | SB | Large T |
| DRB1_0101 | 569 RILQSGMTLLLLLIW | LQSGMTLLL | 0.7504 | 15 | SB | Large T |
| DRB1_0101 | 565 LLEKRILQSGMTLLL | KRILQSGMT | 0.7441 | 16 | SB | Large T |
| DRB1_0101 | 21 RAAWGNLPLMRKAYL | WGNLPLMRK | 0.6972 | 26 | SB | Large T |
| DRB1_0101 | 19 LERAAWGNLPLMRKA | WGNLPLMRK | 0.6958 | 27 | SB | Large T |
| DRB1_0101 | 20 ERAAWGNLPLMRKAY | WGNLPLMRK | 0.6940 | 27 | SB | Large T |
| DRB1_0101 | 22 AAWGNLPLMRKAYLK | WGNLPLMRK | 0.6954 | 27 | SB | Large T |
| DRB1_0101 | 18 GLERAAWGNLPLMRK | ERAAWGNLP | 0.6928 | 28 | SB | Large T |
| DRB1_0101 | 570 ILQSGMTLLLLLIWF | LQSGMTLLL | 0.6646 | 38 | SB | Large T |
| DRB1_0101 | 571 LQSGMTLLLLLIWFR | LQSGMTLLL | 0.6561 | 41 | SB | Large T |
| DRB1_0101 | 383 NAVLEQYMAGVAWLH | EQYMAGVAW | 0.6528 | 43 | SB | Large T |
| DRB1_0101 | 387 EQYMAGVAWLHCLLP | YMAGVAWLH | 0.6516 | 43 | SB | Large T |
| DRB1_0101 | 385 VLEQYMAGVAWLHCL | YMAGVAWLH | 0.6507 | 44 | SB | Large T |
| DRB1_0101 | 384 AVLEQYMAGVAWLHC | YMAGVAWLH | 0.6486 | 45 | SB | Large T |
| DRB1_0101 | 386 LEQYMAGVAWLHCLL | YMAGVAWLH | 0.6483 | 45 | SB | Large T |
| DRB1_0101 | 441 LLDLCGGKALNVNLP | LCGGKALNV | 0.6340 | 52 | WB | Large T |
| DRB1_0101 | 144 LHQFLSQAVFSNRTL | LHQFLSQAV | 0.6329 | 53 | WB | Large T |
| DRB1_0101 | 143 DLHQFLSQAVFSNRT | LHQFLSQAV | 0.6318 | 54 | WB | Large T |
| DRB1_0101 | 442 LDLCGGKALNVNLPM | LCGGKALNV | 0.6310 | 54 | WB | Large T |
| DRB1_0101 | 439 AGLLDLCGGKALNVN | LCGGKALNV | 0.6263 | 57 | WB | Large T |
| DRB1_0101 | 440 GLLDLCGGKALNVNL | LCGGKALNV | 0.6223 | 60 | WB | Large T |
| DRB1_0101 | 438 AAGLLDLCGGKALNV | LLDLCGGKA | 0.6207 | 61 | WB | Large T |
| DRB1_0101 | 142 SDLHQFLSQAVFSNR | LHQFLSQAV | 0.6178 | 62 | WB | Large T |
| DRB1_0101 | 141 PSDLHQFLSQAVFSN | LHQFLSQAV | 0.6165 | 63 | WB | Large T |
| DRB1_0101 | 533 YPVPKTLQARFVRQI | PKTLQARFV | 0.6160 | 64 | WB | Large T |
| DRB1_0101 | 534 PVPKTLQARFVRQID | LQARFVRQI | 0.6136 | 65 | WB | Large T |
| DRB1_0101 | 140 FPSDLHQFLSQAVFS | LHQFLSQAV | 0.6083 | 69 | WB | Large T |
| DRB1_0101 | 138 KDFPSDLHQFLSQAV | FPSDLHQFL | 0.6036 | 73 | WB | Large T |
| DRB1_0101 | 139 DFPSDLHQFLSQAVF | LHQFLSQAV | 0.6019 | 74 | WB | Large T |
| DRB1_0101 | 24 WGNLPLMRKAYLKKC | WGNLPLMRK | 0.6020 | 74 | WB | Large T |
| DRB1_0101 | 23 AWGNLPLMRKAYLKK | WGNLPLMRK | 0.6000 | 76 | WB | Large T |
| DRB1_0101 | 517 NKRTQIFPPGLVTMN | IFPPGLVTM | 0.5951 | 80 | WB | Large T |
| DRB1_0101 | 518 KRTQIFPPGLVTMNE | IFPPGLVTM | 0.5907 | 84 | WB | Large T |
| DRB1_0101 | 428 GPIDSGKTTLAAGLL | IDSGKTTLA | 0.5880 | 86 | WB | Large T |
| DRB1_0101 | 519 RTQIFPPGLVTMNEY | IFPPGLVTM | 0.5871 | 87 | WB | Large T |
| DRB1_0101 | 520 TQIFPPGLVTMNEYP | IFPPGLVTM | 0.5843 | 90 | WB | Large T |
| DRB1_0101 | 268 KQVSWKLITEYAVET | WKLITEYAV | 0.5795 | 95 | WB | Large T |
| DRB1_0101 | 269 QVSWKLITEYAVETK | LITEYAVET | 0.5780 | 96 | WB | Large T |
| DRB1_0101 | 284 CEDVFLLLGMYLEFQ | VFLLLGMYL | 0.5771 | 97 | WB | Large T |
| DRB1_0101 | 285 EDVFLLLGMYLEFQY | VFLLLGMYL | 0.5774 | 97 | WB | Large T |
| DRB1_0101 | 535 VPKTLQARFVRQIDF | LQARFVRQI | 0.5743 | 100 | WB | Large T |
| DRB1_0101 | 536 PKTLQARFVRQIDFR | LQARFVRQI | 0.5746 | 100 | WB | Large T |
| DRB1_0101 | 270 VSWKLITEYAVETKC | LITEYAVET | 0.5715 | 103 | WB | Large T |
| DRB1_0101 | 147 FLSQAVFSNRTLACF | SQAVFSNRT | 0.5698 | 105 | WB | Large T |
| DRB1_0101 | 388 QYMAGVAWLHCLLPK | YMAGVAWLH | 0.5680 | 107 | WB | Large T |
| DRB1_0101 | 603 ERLDSEISMYTFSRM | LDSEISMYT | 0.5669 | 108 | WB | Large T |
| DRB1_0101 | 389 YMAGVAWLHCLLPKM | YMAGVAWLH | 0.5664 | 109 | WB | Large T |
| DRB1_0101 | 448 KALNVNLPMERLTFE | LNVNLPMER | 0.5655 | 110 | WB | Large T |
| DRB1_0101 | 444 LCGGKALNVNLPMER | LCGGKALNV | 0.5641 | 112 | WB | Large T |
| DRB1_0101 | 446 GGKALNVNLPMERLT | LNVNLPMER | 0.5640 | 112 | WB | Large T |
| DRB1_0101 | 425 LFKGPIDSGKTTLAA | IDSGKTTLA | 0.5627 | 113 | WB | Large T |
| DRB1_0101 | 447 GKALNVNLPMERLTF | LNVNLPMER | 0.5619 | 114 | WB | Large T |
| DRB1_0101 | 427 KGPIDSGKTTLAAGL | IDSGKTTLA | 0.5613 | 115 | WB | Large T |
| DRB1_0101 | 599 VEWKERLDSEISMYT | KERLDSEIS | 0.5611 | 115 | WB | Large T |
| DRB1_0101 | 445 CGGKALNVNLPMERL | LNVNLPMER | 0.5598 | 117 | WB | Large T |
| DRB1_0101 | 490 GHGINNLDSLRDYLD | INNLDSLRD | 0.5597 | 117 | WB | Large T |
| DRB1_0101 | 271 SWKLITEYAVETKCE | LITEYAVET | 0.5583 | 119 | WB | Large T |
| DRB1_0101 | 489 SGHGINNLDSLRDYL | INNLDSLRD | 0.5574 | 120 | WB | Large T |
| DRB1_0101 | 491 HGINNLDSLRDYLDG | INNLDSLRD | 0.5573 | 120 | WB | Large T |
| DRB1_0101 | 424 WLFKGPIDSGKTTLA | KGPIDSGKT | 0.5567 | 121 | WB | Large T |
| DRB1_0101 | 487 LPSGHGINNLDSLRD | LPSGHGINN | 0.5568 | 121 | WB | Large T |
| DRB1_0101 | 530 MNEYPVPKTLQARFV | YPVPKTLQA | 0.5570 | 121 | WB | Large T |
| DRB1_0101 | 426 FKGPIDSGKTTLAAG | IDSGKTTLA | 0.5562 | 122 | WB | Large T |
| DRB1_0101 | 600 EWKERLDSEISMYTF | LDSEISMYT | 0.5562 | 122 | WB | Large T |
| DRB1_0101 | 602 KERLDSEISMYTFSR | LDSEISMYT | 0.5560 | 122 | WB | Large T |
| DRB1_0101 | 488 PSGHGINNLDSLRDY | INNLDSLRD | 0.5554 | 123 | WB | Large T |
| DRB1_0101 | 601 WKERLDSEISMYTFS | LDSEISMYT | 0.5538 | 125 | WB | Large T |
| DRB1_0101 | 272 WKLITEYAVETKCED | LITEYAVET | 0.5514 | 128 | WB | Large T |
| DRB1_0101 | 531 NEYPVPKTLQARFVR | PKTLQARFV | 0.5518 | 128 | WB | Large T |
| DRB1_0101 | 521 QIFPPGLVTMNEYPV | FPPGLVTMN | 0.5507 | 129 | WB | Large T |
| DRB1_0101 | 443 DLCGGKALNVNLPME | LCGGKALNV | 0.5488 | 132 | WB | Large T |

TABLE S-continued

Prediction of BK virus Large T protein specific MHC class 2, 15-mer peptide binders for 14 MHC class 2 alleles (see FIG. 11) using the www.cbs.dtu.dk/services/NetMHCII/database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0101 | 228 VNKEYLLYSALTRDP | YLLYSALTR | 0.5454 | 137 | WB | Large T |
| DRB1_0101 | 145 HQFLSQAVFSNRTLA | SQAVFSNRT | 0.5437 | 139 | WB | Large T |
| DRB1_0101 | 374 MDLIFGAHGNAVLEQ | IFGAHGNAV | 0.5440 | 139 | WB | Large T |
| DRB1_0101 | 375 DLIFGAHGNAVLEQY | IFGAHGNAV | 0.5439 | 139 | WB | Large T |
| DRB1_0101 | 229 NKEYLLYSALTRDPY | LYSALTRDP | 0.5434 | 140 | WB | Large T |
| DRB1_0101 | 146 QFLSQAVFSNRTLAC | SQAVFSNRT | 0.5423 | 141 | WB | Large T |
| DRB1_0101 | 373 KMDLIFGAHGNAVLE | IFGAHGNAV | 0.5366 | 150 | WB | Large T |
| DRB1_0101 | 564 FLLEKRILQSGMTLL | KRILQSGMT | 0.5369 | 150 | WB | Large T |
| DRB1_0101 | 372 DKMDLIFGAHGNAVL | IFGAHGNAV | 0.5366 | 151 | WB | Large T |
| DRB1_0101 | 230 KEYLLYSALTRDPYH | LYSALTRDP | 0.5334 | 156 | WB | Large T |
| DRB1_0101 | 449 ALNVNLPMERLTFEL | NVNLPMERL | 0.5320 | 158 | WB | Large T |
| DRB1_0101 | 286 DVFLLLGMYLEFQYN | LLGMYLEFQ | 0.5310 | 160 | WB | Large T |
| DRB1_0101 | 232 YLLYSALTRDPYHII | LYSALTRDP | 0.5298 | 162 | WB | Large T |
| DRB1_0101 | 338 ICQQAVDTVLAKKRV | QQAVDTVLA | 0.5273 | 166 | WB | Large T |
| DRB1_0101 | 430 IDSGKTTLAAGLLDL | IDSGKTTLA | 0.5269 | 167 | WB | Large T |
| DRB1_0101 | 149 SQAVFSNRTLACFAV | FSNRTLACF | 0.5259 | 169 | WB | Large T |
| DRB1_0101 | 337 SICQQAVDTVLAKKR | QQAVDTVLA | 0.5252 | 170 | WB | Large T |
| DRB1_0101 | 148 LSQAVFSNRTLACFA | FSNRTLACF | 0.5244 | 172 | WB | Large T |
| DRB1_0101 | 231 EYLLYSALTRDPYHI | LYSALTRDP | 0.5238 | 173 | WB | Large T |
| DRB1_0101 | 522 IFPPGLVTMNEYPVP | IFPPGLVTM | 0.5236 | 173 | WB | Large T |
| DRB1_0101 | 532 EYPVPKTLQARFVRQ | PKTLQARFV | 0.5222 | 176 | WB | Large T |
| DRB1_0101 | 429 PIDSGKTTLAAGLLD | IDSGKTTLA | 0.5198 | 180 | WB | Large T |
| DRB1_0101 | 516 LNKRTQIFPPGLVTM | RTQIFPPGL | 0.5156 | 189 | WB | Large T |
| DRB1_0101 | 287 VFLLLGMYLEFQYNV | VFLLLGMYL | 0.5144 | 191 | WB | Large T |
| DRB1_0101 | 11 MELMDLLGLERAAWG | MDLLGLERA | 0.5102 | 200 | WB | Large T |
| DRB1_0101 | 473 VFEDVKGTGAESKDL | VKGTGAESK | 0.5100 | 201 | WB | Large T |
| DRB1_0101 | 474 FEDVKGTGAESKDLP | VKGTGAESK | 0.5088 | 203 | WB | Large T |
| DRB1_0101 | 537 KTLQARFVRQIDFRP | LQARFVRQI | 0.5092 | 203 | WB | Large T |
| DRB1_0101 | 475 EDVKGTGAESKDLPS | VKGTGAESK | 0.5068 | 208 | WB | Large T |
| DRB1_0101 | 195 NIIFFLTPHRHRVSA | IFFLTPHRH | 0.5062 | 209 | WB | Large T |
| DRB1_0101 | 335 QKSICQQAVDTVLAK | ICQQAVDTV | 0.5063 | 209 | WB | Large T |
| DRB1_0101 | 194 HNIIFFLTPHRHRVS | IFFLTPHRH | 0.5053 | 211 | WB | Large T |
| DRB1_0101 | 336 KSICQQAVDTVLAKK | ICQQAVDTV | 0.5051 | 212 | WB | Large T |
| DRB1_0101 | 334 NQKSICQQAVDTVLA | ICQQAVDTV | 0.5035 | 215 | WB | Large T |
| DRB1_0101 | 450 LNVNLPMERLTFELG | NVNLPMERL | 0.5031 | 216 | WB | Large T |
| DRB1_0101 | 527 LVTMNEYPVPKTLQA | MNEYPVPKT | 0.5027 | 217 | WB | Large T |
| DRB1_0101 | 528 VTMNEYPVPKTLQAR | YPVPKTLQA | 0.5012 | 221 | WB | Large T |
| DRB1_0101 | 371 LDKMDLIFGAHGNAV | LDKMDLIFG | 0.4990 | 226 | WB | Large T |
| DRB1_0101 | 572 QSGMTLLLLLIWFRP | MTLLLLLIW | 0.4975 | 230 | WB | Large T |
| DRB1_0101 | 282 TKCEDVFLLLGMYLE | VFLLLGMYL | 0.4937 | 239 | WB | Large T |
| DRB1_0101 | 283 KCEDVFLLLGMYLEF | VFLLLGMYL | 0.4920 | 244 | WB | Large T |
| DRB1_0101 | 376 LIFGAHGNAVLEQYM | FGAHGNAVL | 0.4919 | 244 | WB | Large T |
| DRB1_0101 | 394 AWLHCLLPKMDSVIF | LLPKMDSVI | 0.4910 | 246 | WB | Large T |
| DRB1_0101 | 604 RLDSEISMYTFSRMK | LDSEISMYT | 0.4900 | 249 | WB | Large T |
| DRB1_0101 | 605 LDSEISMYTFSRMKY | LDSEISMYT | 0.4889 | 252 | WB | Large T |
| DRB1_0101 | 12 ELMDLLGLERAAWGN | MDLLGLERA | 0.4876 | 256 | WB | Large T |
| DRB1_0101 | 472 VVFEDVKGTGAESKD | VKGTGAESK | 0.4858 | 261 | WB | Large T |
| DRB1_0101 | 471 MVVFEDVKGTGAESK | FEDVKGTGA | 0.4853 | 262 | WB | Large T |
| DRB1_0101 | 340 QQAVDTVLAKKRVDT | VDTVLAKKR | 0.4843 | 265 | WB | Large T |
| DRB1_0101 | 172 ILYKKLMEKYSVTFI | YKKLMEKYS | 0.4836 | 267 | WB | Large T |
| DRB1_0101 | 339 CQQAVDTVLAKKRVD | VDTVLAKKR | 0.4837 | 267 | WB | Large T |
| DRB1_0101 | 8 EESMELMDLLGLERA | LMDLLGLER | 0.4834 | 268 | WB | Large T |
| DRB1_0101 | 9 ESMELMDLLGLERAA | LMDLLGLER | 0.4823 | 271 | WB | Large T |
| DRB1_0101 | 395 WLHCLLPKMDSVIFD | LPKMDSVIF | 0.4815 | 273 | WB | Large T |
| DRB1_0101 | 256 EHDFNPEEPEETKQV | FNPEEPEET | 0.4804 | 276 | WB | Large T |
| DRB1_0101 | 152 VFSNRTLACFAVYTT | TLACFAVYT | 0.4803 | 277 | WB | Large T |
| DRB1_0101 | 257 HDFNPEEPEETKQVS | FNPEEPEET | 0.4796 | 279 | WB | Large T |
| DRB1_0101 | 48 DEDKMKRMNTLYKKM | MKRMNTLYK | 0.4796 | 279 | WB | Large T |
| DRB1_0101 | 255 KEHDFNPEEPEETKQ | FNPEEPEET | 0.4792 | 280 | WB | Large T |
| DRB1_0101 | 396 LHCLLPKMDSVIFDF | LPKMDSVIF | 0.4778 | 284 | WB | Large T |
| DRB1_0101 | 254 LKEHDFNPEEPEETK | FNPEEPEET | 0.4775 | 285 | WB | Large T |
| DRB1_0101 | 150 QAVFSNRTLACFAVY | FSNRTLACF | 0.4767 | 288 | WB | Large T |
| DRB1_0101 | 563 EFLLEKRILQSGMTL | KRILQSGMT | 0.4767 | 288 | WB | Large T |
| DRB1_0101 | 226 KGVNKEYLLYSALTR | EYLLYSALT | 0.4763 | 289 | WB | Large T |
| DRB1_0101 | 548 DFRPKIYLRKSLQNS | FRPKIYLRK | 0.4755 | 291 | WB | Large T |
| DRB1_0101 | 47 GDEDKMKRMNTLYKK | MKRMNTLYK | 0.4754 | 292 | WB | Large T |
| DRB1_0101 | 549 FRPKIYLRKSLQNSE | YLRKSLQNS | 0.4751 | 293 | WB | Large T |
| DRB1_0101 | 171 QILYKKLMEKYSVTF | YKKLMEKYS | 0.4745 | 295 | WB | Large T |
| DRB1_0101 | 253 GLKEHDFNPEEPEET | GLKEHDFNP | 0.4744 | 295 | WB | Large T |
| DRB1_0101 | 196 IIFFLTPHRHRVSAI | LTPHRHRVS | 0.4734 | 298 | WB | Large T |
| DRB1_0101 | 397 HCLLPKMDSVIFDFL | LPKMDSVIF | 0.4735 | 298 | WB | Large T |
| DRB1_0101 | 10 SMELMDLLGLERAAW | MDLLGLERA | 0.4730 | 299 | WB | Large T |
| DRB1_0101 | 578 LLLLIWFRPVADFSK | LIWFRPVAD | 0.4729 | 300 | WB | Large T |

TABLE S-continued

Prediction of BK virus Large T protein specific MHC class 2, 15-mer peptide binders for 14 MHC class 2 alleles (see FIG. 11) using the www.cbs.dtu.dk/services/NetMHCII/database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0101 | 49 EDKMKRMNTLYKKME | MKRMNTLYK | 0.4724 | 302 | WB | Large T |
| DRB1_0101 | 562 SEFLLEKRILQSGMT | LEKRILQSG | 0.4722 | 302 | WB | Large T |
| DRB1_0101 | 579 LLLIWFRPVADFSKD | LIWFRPVAD | 0.4723 | 302 | WB | Large T |
| DRB1_0101 | 551 PKIYLRKSLQNSEFL | YLRKSLQNS | 0.4719 | 303 | WB | Large T |
| DRB1_0101 | 523 FPPGLVTMNEYPVPK | FPPGLVTMN | 0.4709 | 306 | WB | Large T |
| DRB1_0101 | 197 IFFLTPHRHRVSAIN | LTPHRHRVS | 0.4697 | 310 | WB | Large T |
| DRB1_0101 | 50 DKMKRMNTLYKKMEQ | MKRMNTLYK | 0.4699 | 310 | WB | Large T |
| DRB1_0101 | 550 RPKIYLRKSLQNSEF | YLRKSLQNS | 0.4698 | 310 | WB | Large T |
| DRB1_0101 | 46 GGDEDKMKRMNTLYK | DKMKRMNTL | 0.4690 | 313 | WB | Large T |
| DRB1_0101 | 2 DKVLNREESMELMDL | LNREESMEL | 0.4683 | 315 | WB | Large T |
| DRB1_0101 | 577 LLLLLIWFRPVADFS | LIWFRPVAD | 0.4684 | 315 | WB | Large T |
| DRB1_0101 | 153 FSNRTLACFAVYTTK | LACFAVYTT | 0.4677 | 317 | WB | Large T |
| DRB1_0101 | 3 KVLNREESMELMDLL | LNREESMEL | 0.4672 | 319 | WB | Large T |
| DRB1_0101 | 281 ETKCEDVFLLLGMYL | EDVFLLLGM | 0.4666 | 321 | WB | Large T |
| DRB1_0101 | 573 SGMTLLLLLIWFRPV | MTLLLLLIW | 0.4649 | 327 | WB | Large T |
| DRB1_0101 | 493 INNLDSLRDYLDGSV | INNLDSLRD | 0.4638 | 331 | WB | Large T |
| DRB1_0101 | 524 PPGLVTMNEYPVPKT | LVTMNEYPV | 0.4635 | 332 | WB | Large T |
| DRB1_0101 | 525 PGLVTMNEYPVPKTL | MNEYPVPKT | 0.4633 | 333 | WB | Large T |
| DRB1_0101 | 151 AVFSNRTLACFAVYT | FSNRTLACF | 0.4625 | 336 | WB | Large T |
| DRB1_0101 | 492 GINNLDSLRDYLDGS | INNLDSLRD | 0.4622 | 336 | WB | Large T |
| DRB1_0101 | 227 GVNKEYLLYSALTRD | YLLYSALTR | 0.4619 | 338 | WB | Large T |
| DRB1_0101 | 529 TMNEYPVPKTLQARF | YPVPKTLQA | 0.4598 | 345 | WB | Large T |
| DRB1_0101 | 459 LTFELGVAIDQYMVV | LGVAIDQYM | 0.4589 | 349 | WB | Large T |
| DRB1_0101 | 457 ERLTFELGVAIDQYM | LTFELGVAI | 0.4584 | 351 | WB | Large T |
| DRB1_0101 | 398 CLLPKMDSVIFDFLH | LPKMDSVIF | 0.4578 | 353 | WB | Large T |
| DRB1_0101 | 552 KIYLRKSLQNSEFLL | YLRKSLQNS | 0.4575 | 354 | WB | Large T |
| DRB1_0101 | 13 LMDLLGLERAAWGNL | LGLERAAWG | 0.4572 | 355 | WB | Large T |
| DRB1_0101 | 575 MTLLLLLIWFRPVAD | MTLLLLLIW | 0.4574 | 355 | WB | Large T |
| DRB1_0101 | 451 NVNLPMERLTFELGV | NVNLPMERL | 0.4555 | 362 | WB | Large T |
| DRB1_0101 | 193 GHNIIFFLTPHRHRV | IFFLTPHRH | 0.4529 | 372 | WB | Large T |
| DRB1_0101 | 1 MDKVLNREESMELMD | LNREESMEL | 0.4521 | 376 | WB | Large T |
| DRB1_0101 | 432 SGKTTLAAGLLDLCG | KTTLAAGLL | 0.4504 | 382 | WB | Large T |
| DRB1_0101 | 233 LLYSALTRDPYHIIE | LYSALTRDP | 0.4500 | 384 | WB | Large T |
| DRB1_0101 | 377 IFGAHGNAVLEQYMA | IFGAHGNAV | 0.4493 | 387 | WB | Large T |
| DRB1_0101 | 273 KLITEYAVETKCEDV | LITEYAVET | 0.4490 | 388 | WB | Large T |
| DRB1_0101 | 458 RLTFELGVAIDQYMV | LGVAIDQYM | 0.4476 | 394 | WB | Large T |
| DRB1_0101 | 234 LYSALTRDPYHIIEE | LYSALTRDP | 0.4472 | 396 | WB | Large T |
| DRB1_0101 | 422 RYWLFKGPIDSGKTT | WLFKGPIDS | 0.4473 | 396 | WB | Large T |
| DRB1_0101 | 421 RRYWLFKGPIDSGKT | WLFKGPIDS | 0.4465 | 399 | WB | Large T |
| DRB1_0101 | 274 LITEYAVETKCEDVF | LITEYAVET | 0.4460 | 401 | WB | Large T |
| DRB1_0101 | 14 MDLLGLERAAWGNLP | LGLERAAWG | 0.4451 | 405 | WB | Large T |
| DRB1_0101 | 476 DVKGTGAESKDLPSG | VKGTGAESK | 0.4428 | 415 | WB | Large T |
| DRB1_0101 | 477 VKGTGAESKDLPSGH | VKGTGAESK | 0.4412 | 422 | WB | Large T |
| DRB1_0101 | 526 GLVTMNEYPVPKTLQ | MNEYPVPKT | 0.4408 | 424 | WB | Large T |
| DRB1_0101 | 174 YKKLMEKYSVTFISR | LMEKYSVTF | 0.4406 | 425 | WB | Large T |
| DRB1_0101 | 390 MAGVAWLHCLLPKMD | VAWLHCLLP | 0.4407 | 425 | WB | Large T |
| DRB1_0101 | 173 LYKKLMEKYSVTFIS | LMEKYSVTF | 0.4405 | 426 | WB | Large T |
| DRB1_0101 | 5 LNREESMELMDLLGL | LNREESMEL | 0.4397 | 429 | WB | Large T |
| DRB1_0101 | 580 LLIWFRPVADFSKDI | WFRPVADFS | 0.4370 | 442 | WB | Large T |
| DRB1_0101 | 391 AGVAWLHCLLPKMDS | VAWLHCLLP | 0.4368 | 443 | WB | Large T |
| DRB1_0101 | 7 REESMELMDLLGLER | MELMDLLGL | 0.4355 | 449 | WB | Large T |
| DRB1_0101 | 341 QAVDTVLAKKRVDTL | VDTVLAKKR | 0.4341 | 456 | WB | Large T |
| DRB1_0101 | 431 DSGKTTLAAGLLDLC | KTTLAAGLL | 0.4339 | 457 | WB | Large T |
| DRB1_0101 | 155 NRTLACFAVYTTKEK | LACFAVYTT | 0.4312 | 471 | WB | Large T |
| DRB1_0101 | 192 AGHNIIFFLTPHRHR | IFFLTPHRH | 0.4310 | 472 | WB | Large T |
| DRB1_0101 | 538 TLQARFVRQIDFRPK | LQARFVRQI | 0.4309 | 472 | WB | Large T |
| DRB1_0101 | 266 ETKQVSWKLITEYAV | VSWKLITEY | 0.4307 | 473 | WB | Large T |
| DRB1_0101 | 267 TKQVSWKLITEYAVE | WKLITEYAV | 0.4303 | 475 | WB | Large T |
| DRB1_0101 | 539 LQARFVRQIDFRPKI | LQARFVRQI | 0.4290 | 482 | WB | Large T |
| DRB1_0101 | 225 CKGVNKEYLLYSALT | VNKEYLLYS | 0.4288 | 483 | WB | Large T |
| DRB1_0101 | 677 KGFQCFKRPKTPPPK | FKRPKTPPP | 0.4281 | 487 | WB | Large T |
| DRB1_0101 | 333 KNQKSICQQAVDTVL | ICQQAVDTV | 0.4261 | 498 | WB | Large T |
| DRB1_0101 | 72 PDFGTWNSSEVPTYG | FGTWNSSEV | 0.4258 | 499 | WB | Large T |
| DRB1_0401 | 47 GDEDKMKRMNTLYKK | MKRMNTLYK | 0.5015 | 220 | WB | Large T |
| DRB1_0401 | 48 DEDKMKRMNTLYKKM | MKRMNTLYK | 0.4994 | 225 | WB | Large T |
| DRB1_0401 | 46 GGDEDKMKRMNTLYK | KMKRMNTLY | 0.4992 | 226 | WB | Large T |
| DRB1_0401 | 49 EDKMKRMNTLYKKME | MKRMNTLYK | 0.4991 | 226 | WB | Large T |
| DRB1_0401 | 50 DKMKRMNTLYKKMEQ | MKRMNTLYK | 0.4948 | 237 | WB | Large T |
| DRB1_0401 | 192 AGHNIIFFLTPHRHR | IIFFLTPHR | 0.4859 | 261 | WB | Large T |
| DRB1_0401 | 194 HNIIFFLTPHRHRVS | IIFFLTPHR | 0.4856 | 261 | WB | Large T |
| DRB1_0401 | 193 GHNIIFFLTPHRHRV | IIFFLTPHR | 0.4820 | 272 | WB | Large T |

TABLE S-continued

Prediction of BK virus Large T protein specific MHC class 2, 15-mer peptide binders for 14 MHC class 2 alleles (see FIG. 11) using the www.cbs.dtu.dk/services/NetMHCII/database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0401 | 191CAGHNIIFFLTPHRH | IIFFLTPHR | 0.4700 | 309 | WB | Large T |
| DRB1_0401 | 190MCAGHNIIFFLTPHR | MCAGHNIIF | 0.4533 | 371 | WB | Large T |
| DRB1_0404 | 194HNIIFFLTPHRHRVS | IIFFLTPHR | 0.5594 | 118 | WB | Large T |
| DRB1_0404 | 193GHNIIFFLTPHRHRV | IIFFLTPHR | 0.5580 | 119 | WB | Large T |
| DRB1_0404 | 284CEDVFLLLGMYLEFQ | FLLLGMYLE | 0.5487 | 132 | WB | Large T |
| DRB1_0404 | 286DVFLLLGMYLEFQYN | LLGMYLEFQ | 0.5479 | 133 | WB | Large T |
| DRB1_0404 | 285EDVFLLLGMYLEFQY | LLGMYLEFQ | 0.5470 | 135 | WB | Large T |
| DRB1_0404 | 288FLLLGMYLEFQYNVE | LLGMYLEFQ | 0.5425 | 141 | WB | Large T |
| DRB1_0404 | 287VFLLLGMYLEFQYNV | LLGMYLEFQ | 0.5417 | 142 | WB | Large T |
| DRB1_0404 | 192AGHNIIFFLTPHRHR | IIFFLTPHR | 0.5303 | 161 | WB | Large T |
| DRB1_0404 | 191CAGHNIIFFLTPHRH | IIFFLTPHR | 0.5272 | 167 | WB | Large T |
| DRB1_0404 | 575MTLLLLLIWFRPVAD | LLLLIWFRP | 0.5188 | 182 | WB | Large T |
| DRB1_0404 | 389YMAGVAWLHCLLPKM | VAWLHCLLP | 0.5113 | 198 | WB | Large T |
| DRB1_0404 | 387EQYMAGVAWLHCLLP | YMAGVAWLH | 0.5087 | 203 | WB | Large T |
| DRB1_0404 | 576TLLLLLIWFRPVADF | LLLLIWFRP | 0.5091 | 203 | WB | Large T |
| DRB1_0404 | 190MCAGHNIIFFLTPHR | HNIIFFLTP | 0.5052 | 211 | WB | Large T |
| DRB1_0404 | 390MAGVAWLHCLLPKMD | VAWLHCLLP | 0.5054 | 211 | WB | Large T |
| DRB1_0404 | 175KKLMEKYSVTFISRH | LMEKYSVTF | 0.5033 | 216 | WB | Large T |
| DRB1_0404 | 391AGVAWLHCLLPKMDS | VAWLHCLLP | 0.5004 | 223 | WB | Large T |
| DRB1_0404 | 577LLLLLIWFRPVADFS | LLIWFRPVA | 0.5001 | 223 | WB | Large T |
| DRB1_0404 | 388QYMAGVAWLHCLLPK | VAWLHCLLP | 0.4995 | 225 | WB | Large T |
| DRB1_0404 | 195NIIFFLTPHRHRVSA | IIFFLTPHR | 0.4985 | 227 | WB | Large T |
| DRB1_0404 | 179EKYSVTFISRHMCAG | YSVTFISRH | 0.4981 | 228 | WB | Large T |
| DRB1_0404 | 177LMEKYSVTFISRHMC | YSVTFISRH | 0.4969 | 231 | WB | Large T |
| DRB1_0404 | 176KLMEKYSVTFISRHM | YSVTFISRH | 0.4952 | 236 | WB | Large T |
| DRB1_0404 | 178MEKYSVTFISRHMCA | YSVTFISRH | 0.4940 | 239 | WB | Large T |
| DRB1_0404 | 578LLLLIWFRPVADFSK | LLIWFRPVA | 0.4909 | 247 | WB | Large T |
| DRB1_0404 | 196IIFFLTPHRHRVSAI | IIFFLTPHR | 0.4866 | 258 | WB | Large T |
| DRB1_0404 | 574GMTLLLLLIWFRPVA | LLLLIWFRP | 0.4835 | 267 | WB | Large T |
| DRB1_0404 | 371LDKMDLIFGAHGNAV | MDLIFGAHG | 0.4592 | 348 | WB | Large T |
| DRB1_0404 | 290LLGMYLEFQYNVEEC | LLGMYLEFQ | 0.4448 | 406 | WB | Large T |
| DRB1_0404 | 289LLLGMYLEFQYNVEE | LLGMYLEFQ | 0.4447 | 407 | WB | Large T |
| DRB1_0404 | 372DKMDLIFGAHGNAVL | IFGAHGNAV | 0.4437 | 411 | WB | Large T |
| DRB1_0405 | 575MTLLLLLIWFRPVAD | LLIWFRPVA | 0.7757 | 11 | SB | Large T |
| DRB1_0405 | 576TLLLLLIWFRPVADF | LIWFRPVAD | 0.7721 | 12 | SB | Large T |
| DRB1_0405 | 577LLLLLIWFRPVADFS | LIWFRPVAD | 0.7733 | 12 | SB | Large T |
| DRB1_0405 | 578LLLLIWFRPVADFSK | LIWFRPVAD | 0.7738 | 12 | SB | Large T |
| DRB1_0405 | 579LLLIWFRPVADFSKD | LIWFRPVAD | 0.7712 | 12 | SB | Large T |
| DRB1_0405 | 85YGTEEWESWWSSFNE | WESWWSSFN | 0.7453 | 16 | SB | Large T |
| DRB1_0405 | 87TEEWESWWSSFNEKW | WESWWSSFN | 0.7451 | 16 | SB | Large T |
| DRB1_0405 | 86GTEEWESWWSSFNEK | WESWWSSFN | 0.7381 | 17 | SB | Large T |
| DRB1_0405 | 88EEWESWWSSFNEKWD | WESWWSSFN | 0.7402 | 17 | SB | Large T |
| DRB1_0405 | 84TYGTEEWESWWSSFN | TEEWESWWS | 0.7216 | 20 | SB | Large T |
| DRB1_0405 | 580LLIWFRPVADFSKDI | LIWFRPVAD | 0.6804 | 32 | SB | Large T |
| DRB1_0405 | 581LIWFRPVADFSKDIQ | LIWFRPVAD | 0.6771 | 33 | SB | Large T |
| DRB1_0405 | 89EWESWWSSFNEKWDE | WESWWSSFN | 0.6771 | 33 | SB | Large T |
| DRB1_0405 | 90WESWWSSFNEKWDED | WESWWSSFN | 0.6504 | 44 | SB | Large T |
| DRB1_0405 | 49EDKMKRMNTLYKKME | MKRMNTLYK | 0.5687 | 106 | WB | Large T |
| DRB1_0405 | 50DKMKRMNTLYKKMEQ | MKRMNTLYK | 0.5662 | 109 | WB | Large T |
| DRB1_0405 | 47GDEDKMKRMNTLYKK | MKRMNTLYK | 0.5447 | 138 | WB | Large T |
| DRB1_0405 | 46GGDEDKMKRMNTLYK | DKMKRMNTL | 0.5432 | 140 | WB | Large T |
| DRB1_0405 | 48DEDKMKRMNTLYKKM | MKRMNTLYK | 0.5413 | 143 | WB | Large T |
| DRB1_0405 | 490GHGINNLDSLRDYLD | INNLDSLRD | 0.5182 | 184 | WB | Large T |
| DRB1_0405 | 491HGINNLDSLRDYLDG | INNLDSLRD | 0.5113 | 198 | WB | Large T |
| DRB1_0405 | 18GLERAAWGNLPLMRK | RAAWGNLPL | 0.5095 | 202 | WB | Large T |
| DRB1_0405 | 487LPSGHGINNLDSLRD | GHGINNLDS | 0.4979 | 229 | WB | Large T |
| DRB1_0405 | 19LERAAWGNLPLMRKA | RAAWGNLPL | 0.4956 | 235 | WB | Large T |
| DRB1_0405 | 488PSGHGINNLDSLRDY | INNLDSLRD | 0.4948 | 237 | WB | Large T |
| DRB1_0405 | 489SGHGINNLDSLRDYL | INNLDSLRD | 0.4858 | 261 | WB | Large T |
| DRB1_0405 | 51KMRMNTLYKKMEQD | MKRMNTLYK | 0.4857 | 261 | WB | Large T |
| DRB1_0405 | 52MKRMNTLYKKMEQDV | MKRMNTLYK | 0.4857 | 261 | WB | Large T |
| DRB1_0405 | 391AGVAWLHCLLPKMDS | VAWLHCLLP | 0.4831 | 269 | WB | Large T |
| DRB1_0405 | 91ESWWSSFNEKWDEDL | WSSFNEKWD | 0.4812 | 274 | WB | Large T |
| DRB1_0405 | 390MAGVAWLHCLLPKMD | VAWLHCLLP | 0.4697 | 310 | WB | Large T |
| DRB1_0405 | 387EQYMAGVAWLHCLLP | YMAGVAWLH | 0.4648 | 327 | WB | Large T |
| DRB1_0405 | 68VAHQPDFGTWNSSEV | QPDFGTWNS | 0.4624 | 336 | WB | Large T |
| DRB1_0405 | 418VPKRRYWLFKGPIDS | YWLFKGPID | 0.4620 | 337 | WB | Large T |
| DRB1_0405 | 388QYMAGVAWLHCLLPK | VAWLHCLLP | 0.4614 | 339 | WB | Large T |
| DRB1_0405 | 420KRRYWLFKGPIDSGK | YWLFKGPID | 0.4599 | 345 | WB | Large T |
| DRB1_0405 | 419PKRRYWLFKGPIDSG | YWLFKGPID | 0.4586 | 350 | WB | Large T |
| DRB1_0405 | 20ERAAWGNLPLMRKAY | WGNLPLMRK | 0.4570 | 356 | WB | Large T |

TABLE S-continued

Prediction of BK virus Large T protein specific MHC class 2, 15-mer peptide binders for 14 MHC class 2 alleles (see FIG. 11) using the www.cbs.dtu.dk/services/NetMHCII/database. The MHC class 2 molecules for which no binders were found are not listed.

| Allele | pospeptide | core | 1-log50k(aff) | aff(nM) | B.L. | Identity |
|---|---|---|---|---|---|---|
| DRB1_0405 | 69 AHQPDFGTWNSSEVP | FGTWNSSEV | 0.4571 | 356 | WB | Large T |
| DRB1_0405 | 389 YMAGVAWLHCLLPKM | VAWLHCLLP | 0.4547 | 365 | WB | Large T |
| DRB1_0405 | 421 RRYWLFKGPIDSGKT | YWLFKGPID | 0.4540 | 368 | WB | Large T |
| DRB1_0405 | 417 NVPKRRYWLFKGPID | RYWLFKGPI | 0.4530 | 372 | WB | Large T |
| DRB1_0405 | 17 LGLERAAWGNLPLMR | RAAWGNLPL | 0.4515 | 378 | WB | Large T |
| DRB1_0405 | 16 LLGLERAAWGNLPLM | RAAWGNLPL | 0.4465 | 399 | WB | Large T |
| DRB1_0405 | 493 INNLDSLRDYLDGSV | INNLDSLRD | 0.4409 | 424 | WB | Large T |
| DRB1_0405 | 492 GINNLDSLRDYLDGS | INNLDSLRD | 0.4405 | 426 | WB | Large T |
| DRB1_0405 | 15 DLLGLERAAWGNLPL | ERAAWGNLP | 0.4401 | 427 | WB | Large T |
| DRB1_0405 | 70 HQPDFGTWNSSEVPT | FGTWNSSEV | 0.4392 | 432 | WB | Large T |
| DRB1_0405 | 653 CSSQVSDTSAPDSEN | QVSDTSAPD | 0.4296 | 479 | WB | Large T |
| DRB1_0405 | 654 SSQVSDTSAPDSENP | QVSDTSAPD | 0.4282 | 486 | WB | Large T |
| DRB1_0701 | 412 HCVVFNVPKRRYWLF | VFNVPKRRY | 0.5438 | 139 | WB | Large T |
| DRB1_0701 | 413 CVVFNVPKRRYWLFK | VPKRRYWLF | 0.5406 | 144 | WB | Large T |
| DRB1_0701 | 414 VVFNVPKRRYWLFKG | VPKRRYWLF | 0.5149 | 190 | WB | Large T |
| DRB1_0701 | 415 VFNVPKRRYWLFKGP | VPKRRYWLF | 0.5009 | 221 | WB | Large T |
| DRB1_0701 | 71 QPDFGTWNSSEVPTY | FGTWNSSEV | 0.4820 | 272 | WB | Large T |
| DRB1_0701 | 72 PDFGTWNSSEVPTYG | FGTWNSSEV | 0.4789 | 281 | WB | Large T |
| DRB1_0701 | 68 VAHQPDFGTWNSSEV | DFGTWNSSE | 0.4709 | 306 | WB | Large T |
| DRB1_0701 | 69 AHQPDFGTWNSSEVP | FGTWNSSEV | 0.4658 | 324 | WB | Large T |
| DRB1_0701 | 70 HQPDFGTWNSSEVPT | FGTWNSSEV | 0.4657 | 324 | WB | Large T |
| DRB1_0701 | 416 FNVPKRRYWLFKGPI | VPKRRYWLF | 0.4627 | 335 | WB | Large T |
| DRB1_0701 | 194 HNIIFFLTPHRHRVS | IFFLTPHRH | 0.4550 | 364 | WB | Large T |
| DRB1_0701 | 195 NIIFFLTPHRHRVSA | IFFLTPHRH | 0.4521 | 375 | WB | Large T |
| DRB1_0701 | 193 GHNIIFFLTPHRHRV | IFFLTPHRH | 0.4386 | 434 | WB | Large T |
| DRB1_0701 | 176 KLMEKYSVTFISRHM | YSVTFISRH | 0.4346 | 454 | WB | Large T |
| DRB1_0701 | 196 IIFFLTPHRHRVSAI | IFFLTPHRH | 0.4331 | 461 | WB | Large T |
| DRB1_0701 | 177 LMEKYSVTFISRHMC | YSVTFISRH | 0.4315 | 469 | WB | Large T |
| DRB1_0701 | 387 EQYMAGVAWLHCLLP | YMAGVAWLH | 0.4303 | 475 | WB | Large T |
| DRB1_0701 | 386 LEQYMAGVAWLHCLL | YMAGVAWLH | 0.4292 | 481 | WB | Large T |
| DRB1_0701 | 192 AGHNIIFFLTPHRHR | IFFLTPHRH | 0.4288 | 483 | WB | Large T |
| DRB1_0701 | 197 IFFLTPHRHRVSAIN | IFFLTPHRH | 0.4289 | 483 | WB | Large T |
| DRB1_0901 | 229 NKEYLLYSALTRDPY | YLLYSALTR | 0.4376 | 439 | WB | Large T |
| DRB1_0901 | 230 KEYLLYSALTRDPYH | YLLYSALTR | 0.4372 | 441 | WB | Large T |
| DRB1_0901 | 72 PDFGTWNSSEVPTYG | WNSSEVPTY | 0.4364 | 445 | WB | Large T |
| DRB1_0901 | 71 QPDFGTWNSSEVPTY | FGTWNSSEV | 0.4355 | 449 | WB | Large T |
| DRB1_0901 | 228 VNKEYLLYSALTRDP | YLLYSALTR | 0.4325 | 464 | WB | Large T |
| DRB1_0901 | 384 AVLEQYMAGVAWLHC | LEQYMAGVA | 0.4270 | 493 | WB | Large T |
| DRB1_0901 | 383 NAVLEQYMAGVAWLH | LEQYMAGVA | 0.4259 | 499 | WB | Large T |
| DRB1_1101 | 232 YLLYSALTRDPYHII | YSALTRDPY | 0.4594 | 347 | WB | Large T |
| DRB1_1101 | 233 LLYSALTRDPYHIIE | YSALTRDPY | 0.4586 | 350 | WB | Large T |
| DRB1_1101 | 231 EYLLYSALTRDPYHI | YSALTRDPY | 0.4552 | 363 | WB | Large T |
| DRB1_1101 | 229 NKEYLLYSALTRDPY | YLLYSALTR | 0.4548 | 364 | WB | Large T |
| DRB1_1101 | 47 GDEDKMKRMNTLYKK | MKRMNTLYK | 0.4550 | 364 | WB | Large T |
| DRB1_1101 | 230 KEYLLYSALTRDPYH | YSALTRDPY | 0.4537 | 369 | WB | Large T |
| DRB1_1101 | 49 EDKMKRMNTLYKKME | MKRMNTLYK | 0.4498 | 385 | WB | Large T |
| DRB1_1101 | 48 DEDKMKRMNTLYKKM | MKRMNTLYK | 0.4495 | 386 | WB | Large T |
| DRB1_1101 | 50 DKMKRMNTLYKKMEQ | MKRMNTLYK | 0.4483 | 391 | WB | Large T |
| DRB1_1101 | 46 GGDEDKMKRMNTLYK | EDKMKRMNT | 0.4433 | 413 | WB | Large T |
| DRB1_1101 | 18 GLERAAWGNLPLMRK | AWGNLPLMR | 0.4312 | 471 | WB | Large T |
| DRB1_1101 | 19 LERAAWGNLPLMRKA | WGNLPLMRK | 0.4311 | 471 | WB | Large T |
| DRB1_1101 | 21 RAAWGNLPLMRKAYL | WGNLPLMRK | 0.4288 | 483 | WB | Large T |
| DRB1_1101 | 20 ERAAWGNLPLMRKAY | WGNLPLMRK | 0.4279 | 488 | WB | Large T |
| DRB1_1302 | 18 GLERAAWGNLPLMRK | LERAAWGNL | 0.5752 | 99 | WB | Large T |
| DRB1_1302 | 21 RAAWGNLPLMRKAYL | WGNLPLMRK | 0.5714 | 103 | WB | Large T |
| DRB1_1302 | 22 AAWGNLPLMRKAYLK | WGNLPLMRK | 0.5704 | 104 | WB | Large T |
| DRB1_1302 | 19 LERAAWGNLPLMRKA | WGNLPLMRK | 0.5702 | 105 | WB | Large T |
| DRB1_1302 | 20 ERAAWGNLPLMRKAY | WGNLPLMRK | 0.5531 | 126 | WB | Large T |
| DRB1_1302 | 285 EDVFLLLGMYLEFQY | FLLLGMYLE | 0.5498 | 130 | WB | Large T |
| DRB1_1302 | 445 CGGKALNVNLPMERL | LNVNLPMER | 0.5476 | 134 | WB | Large T |
| DRB1_1302 | 446 GGKALNVNLPMERLT | LNVNLPMER | 0.5454 | 137 | WB | Large T |
| DRB1_1302 | 566 LEKRILQSGMTLLLL | ILQSGMTLL | 0.5431 | 140 | WB | Large T |
| DRB1_1302 | 444 LCGGKALNVNLPMER | GKALNVNLP | 0.5427 | 141 | WB | Large T |
| DRB1_1302 | 565 LLEKRILQSGMTLLL | ILQSGMTLL | 0.5420 | 142 | WB | Large T |
| DRB1_1302 | 447 GKALNVNLPMERLTF | LNVNLPMER | 0.5392 | 146 | WB | Large T |
| DRB1_1302 | 284 CEDVFLLLGMYLEFQ | FLLLGMYLE | 0.5383 | 148 | WB | Large T |
| DRB1_1302 | 283 KCEDVFLLLGMYLEF | FLLLGMYLE | 0.5363 | 151 | WB | Large T |
| DRB1_1302 | 567 EKRILQSGMTLLLLL | ILQSGMTLL | 0.5327 | 157 | WB | Large T |
| DRB1_1302 | 282 TKCEDVFLLLGMYLE | VFLLLGMYL | 0.5292 | 163 | WB | Large T |

TABLE S-continued

Prediction of BK virus Large T protein specific MHC class 2, 15-mer peptide binders for 14 MHC class 2 alleles (see FIG. 11) using the www.cbs.dtu.dk/services/NetMHCII/database. The MHC class 2 molecules for which no binders were found are not listed.

| Allele | pospeptide | core | 1-log50k(aff) | aff(nM) | B.L. | Identity |
|---|---|---|---|---|---|---|
| DRB1_1302 | 568 KRILQSGMTLLLLLI | ILQSGMTLL | 0.5282 | 165 | WB | Large T |
| DRB1_1302 | 286 DVFLLLGMYLEFQYN | FLLLGMYLE | 0.5258 | 169 | WB | Large T |
| DRB1_1302 | 409 DFLHCVVFNVPKRRY | VVFNVPKRR | 0.5112 | 198 | WB | Large T |
| DRB1_1302 | 411 LHCVVFNVPKRRYWL | VFNVPKRRY | 0.5079 | 205 | WB | Large T |
| DRB1_1302 | 410 FLHCVVFNVPKRRYW | VFNVPKRRY | 0.5074 | 206 | WB | Large T |
| DRB1_1302 | 48 DEDKMKRMNTLYKKM | MKRMNTLYK | 0.5012 | 221 | WB | Large T |
| DRB1_1302 | 448 KALNVNLPMERLTFE | LNVNLPMER | 0.4996 | 225 | WB | Large T |
| DRB1_1302 | 49 EDKMKRMNTLYKKME | MKRMNTLYK | 0.4986 | 227 | WB | Large T |
| DRB1_1302 | 609 ISMYTFSRMKYNICM | MYTFSRMKY | 0.4969 | 231 | WB | Large T |
| DRB1_1302 | 50 DKMKRMNTLYKKMEQ | MKRMNTLYK | 0.4966 | 232 | WB | Large T |
| DRB1_1302 | 412 HCVVFNVPKRRYWLF | VFNVPKRRY | 0.4955 | 235 | WB | Large T |
| DRB1_1302 | 47 GDEDKMKRMNTLYKK | MKRMNTLYK | 0.4940 | 239 | WB | Large T |
| DRB1_1302 | 564 FLLEKRILQSGMTLL | KRILQSGMT | 0.4938 | 239 | WB | Large T |
| DRB1_1302 | 608 EISMYTFSRMKYNIC | ISMYTFSRM | 0.4935 | 240 | WB | Large T |
| DRB1_1302 | 24 WGNLPLMRKAYLKKC | WGNLPLMRK | 0.4926 | 242 | WB | Large T |
| DRB1_1302 | 23 AWGNLPLMRKAYLKK | WGNLPLMRK | 0.4885 | 253 | WB | Large T |
| DRB1_1302 | 46 GGDEDKMKRMNTLYK | DKMKRMNTL | 0.4800 | 278 | WB | Large T |
| DRB1_1302 | 487 LPSGHGINNLDSLRD | HGINNLDSL | 0.4764 | 289 | WB | Large T |
| DRB1_1302 | 489 SGHGINNLDSLRDYL | INNLDSLRD | 0.4752 | 293 | WB | Large T |
| DRB1_1302 | 488 PSGHGINNLDSLRDY | INNLDSLRD | 0.4736 | 298 | WB | Large T |
| DRB1_1302 | 569 RILQSGMTLLLLLIW | LQSGMTLLL | 0.4720 | 303 | WB | Large T |
| DRB1_1302 | 287 VFLLLGMYLEFQYNV | FLLLGMYLE | 0.4711 | 306 | WB | Large T |
| DRB1_1302 | 413 CVVFNVPKRRYWLFK | VFNVPKRRY | 0.4581 | 352 | WB | Large T |
| DRB1_1302 | 522 IFPPGLVTMNEYPVP | PGLVTMNEY | 0.4560 | 360 | WB | Large T |
| DRB1_1302 | 490 GHGINNLDSLRDYLD | INNLDSLRD | 0.4532 | 371 | WB | Large T |
| DRB1_1302 | 523 FPPGLVTMNEYPVPK | PGLVTMNEY | 0.4489 | 389 | WB | Large T |
| DRB1_1302 | 232 YLLYSALTRDPYHII | YSALTRDPY | 0.4367 | 444 | WB | Large T |
| DRB1_1302 | 491 HGINNLDSLRDYLDG | INNLDSLRD | 0.4358 | 448 | WB | Large T |
| DRB1_1302 | 570 ILQSGMTLLLLLIWF | ILQSGMTLL | 0.4330 | 462 | WB | Large T |
| DRB1_1302 | 449 ALNVNLPMERLTFEL | LNVNLPMER | 0.4326 | 463 | WB | Large T |
| DRB1_1302 | 607 SEISMYTFSRMKYNI | ISMYTFSRM | 0.4327 | 463 | WB | Large T |
| DRB1_1302 | 51 KMKRMNTLYKKMEQD | MKRMNTLYK | 0.4272 | 492 | WB | Large T |
| DRB1_1501 | 192 AGHNIIFFLTPHRHR | IIFFLTPHR | 0.6526 | 43 | SB | Large T |
| DRB1_1501 | 193 GHNIIFFLTPHRHRV | IIFFLTPHR | 0.6507 | 44 | SB | Large T |
| DRB1_1501 | 575 MTLLLLLIWFRPVAD | LLLLLIWFR | 0.6509 | 44 | SB | Large T |
| DRB1_1501 | 574 GMTLLLLLIWFRPVA | LLLLLIWFR | 0.6462 | 46 | SB | Large T |
| DRB1_1501 | 191 CAGHNIIFFLTPHRH | IIFFLTPHR | 0.6427 | 48 | SB | Large T |
| DRB1_1501 | 194 HNIIFFLTPHRHRVS | IIFFLTPHR | 0.6416 | 48 | SB | Large T |
| DRB1_1501 | 576 TLLLLLIWFRPVADF | LLLLLIWFR | 0.6127 | 66 | WB | Large T |
| DRB1_1501 | 577 LLLLLIWFRPVADFS | LLIWFRPVA | 0.5958 | 79 | WB | Large T |
| DRB1_1501 | 190 MCAGHNIIFFLTPHR | NIIFFLTPH | 0.5914 | 83 | WB | Large T |
| DRB1_1501 | 573 SGMTLLLLLIWFRPV | LLLLLIWFR | 0.5875 | 87 | WB | Large T |
| DRB1_1501 | 195 NIIFFLTPHRHRVSA | IIFFLTPHR | 0.5848 | 89 | WB | Large T |
| DRB1_1501 | 572 QSGMTLLLLLIWFRP | LLLLLIWFR | 0.5640 | 112 | WB | Large T |
| DRB1_1501 | 196 IIFFLTPHRHRVSAI | IIFFLTPHR | 0.5515 | 128 | WB | Large T |
| DRB1_1501 | 578 LLLLIWFRPVADFSK | LLIWFRPVA | 0.5410 | 144 | WB | Large T |
| DRB1_1501 | 571 LQSGMTLLLLLIWFR | TLLLLLIWF | 0.5272 | 167 | WB | Large T |
| DRB1_1501 | 48 DEDKMKRMNTLYKKM | MKRMNTLYK | 0.5229 | 174 | WB | Large T |
| DRB1_1501 | 49 EDKMKRMNTLYKKME | MKRMNTLYK | 0.5190 | 182 | WB | Large T |
| DRB1_1501 | 24 WGNLPLMRKAYLKKC | LMRKAYLKK | 0.5176 | 185 | WB | Large T |
| DRB1_1501 | 50 DKMKRMNTLYKKMEQ | MKRMNTLYK | 0.5153 | 190 | WB | Large T |
| DRB1_1501 | 47 GDEDKMKRMNTLYKK | MKRMNTLYK | 0.5147 | 191 | WB | Large T |
| DRB1_1501 | 23 AWGNLPLMRKAYLKK | LPLMRKAYL | 0.5076 | 206 | WB | Large T |
| DRB1_1501 | 25 GNLPLMRKAYLKKCK | LMRKAYLKK | 0.5063 | 209 | WB | Large T |
| DRB1_1501 | 46 GGDEDKMKRMNTLYK | DKMKRMNTL | 0.5026 | 217 | WB | Large T |
| DRB1_1501 | 26 NLPLMRKAYLKKCKE | LMRKAYLKK | 0.4961 | 233 | WB | Large T |
| DRB1_1501 | 548 DFRPKIYLRKSLQNS | DFRPKIYLR | 0.4942 | 238 | WB | Large T |
| DRB1_1501 | 227 GVNKEYLLYSALTRD | YLLYSALTR | 0.4878 | 255 | WB | Large T |
| DRB1_1501 | 228 VNKEYLLYSALTRDP | YLLYSALTR | 0.4864 | 259 | WB | Large T |
| DRB1_1501 | 229 NKEYLLYSALTRDPY | YLLYSALTR | 0.4863 | 259 | WB | Large T |
| DRB1_1501 | 230 KEYLLYSALTRDPYH | YLLYSALTR | 0.4859 | 260 | WB | Large T |
| DRB1_1501 | 27 LPLMRKAYLKKCKEF | LMRKAYLKK | 0.4850 | 263 | WB | Large T |
| DRB1_1501 | 409 DFLHCVVFNVPKRRY | CVVFNVPKR | 0.4823 | 271 | WB | Large T |
| DRB1_1501 | 410 FLHCVVFNVPKRRYW | CVVFNVPKR | 0.4819 | 272 | WB | Large T |
| DRB1_1501 | 226 KGVNKEYLLYSALTR | VNKEYLLYS | 0.4792 | 280 | WB | Large T |
| DRB1_1501 | 411 LHCVVFNVPKRRYWL | CVVFNVPKR | 0.4791 | 280 | WB | Large T |
| DRB1_1501 | 543 FVRQIDFRPKIYLRK | DFRPKIYLR | 0.4749 | 293 | WB | Large T |
| DRB1_1501 | 544 VRQIDFRPKIYLRKS | DFRPKIYLR | 0.4739 | 297 | WB | Large T |
| DRB1_1501 | 542 RFVRQIDFRPKIYLR | VRQIDFRPK | 0.4731 | 299 | WB | Large T |
| DRB1_1501 | 408 FDFLHCVVFNVPKRR | CVVFNVPKR | 0.4728 | 300 | WB | Large T |
| DRB1_1501 | 579 LLLIWFRPVADFSKD | LLIWFRPVA | 0.4695 | 311 | WB | Large T |
| DRB1_1501 | 13 LMDLLGLERAAWGNL | LMDLLGLER | 0.4683 | 315 | WB | Large T |

TABLE S-continued

Prediction of BK virus Large T protein specific MHC class 2, 15-mer
peptide binders for 14 MHC class 2 alleles (see FIG. 11) using the
www.cbs.dtu.dk/services/NetMHCII/database. The MHC class 2
molecules for which no binders were found are not listed.

| Allele | pospeptide | core | 1-log50k(aff) | aff(nM) | B.L. | Identity |
|---|---|---|---|---|---|---|
| DRB1_1501 | 549 FRPKIYLRKSLQNSE | YLRKSLQNS | 0.4683 | 315 | WB | Large T |
| DRB1_1501 | 11 MELMDLLGLERAAWG | LMDLLGLER | 0.4651 | 326 | WB | Large T |
| DRB1_1501 | 142 SDLHQFLSQAVFSNR | LHQFLSQAV | 0.4611 | 341 | WB | Large T |
| DRB1_1501 | 413 CVVFNVPKRRYWLFK | CVVFNVPKR | 0.4554 | 362 | WB | Large T |
| DRB1_1501 | 169 KAQILYKKLMEKYSV | ILYKKLMEK | 0.4523 | 375 | WB | Large T |
| DRB1_1501 | 170 AQILYKKLMEKYSVT | ILYKKLMEK | 0.4511 | 379 | WB | Large T |
| DRB1_1501 | 546 QIDFRPKIYLRKSLQ | DFRPKIYLR | 0.4502 | 383 | WB | Large T |
| DRB1_1501 | 419 PKRRYWLFKGPIDSG | WLFKGPIDS | 0.4498 | 385 | WB | Large T |
| DRB1_1501 | 418 VPKRRYWLFKGPIDS | KRRYWLFKG | 0.4458 | 402 | WB | Large T |
| DRB1_1501 | 547 IDFRPKIYLRKSLQN | FRPKIYLRK | 0.4373 | 440 | WB | Large T |
| DRB1_1501 | 420 KRRYWLFKGPIDSGK | WLFKGPIDS | 0.4350 | 452 | WB | Large T |
| DRB1_1501 | 414 VVFNVPKRRYWLFKG | PKRRYWLFK | 0.4334 | 460 | WB | Large T |
| DRB1_1501 | 28 PLMRKAYLKKCKEFH | LMRKAYLKK | 0.4332 | 461 | WB | Large T |
| DRB1_1501 | 51 KMKRMNTLYKKMEQD | MKRMNTLYK | 0.4331 | 461 | WB | Large T |
| DRB1_1501 | 172 ILYKKLMEKYSVTFI | ILYKKLMEK | 0.4319 | 467 | WB | Large T |
| DRB1_1501 | 550 RPKIYLRKSLQNSEF | YLRKSLQNS | 0.4316 | 469 | WB | Large T |
| DRB1_1501 | 545 RQIDFRPKIYLRKSL | DFRPKIYLR | 0.4312 | 471 | WB | Large T |
| DRB1_1501 | 580 LLIWFRPVADFSKDI | LLIWFRPVA | 0.4297 | 479 | WB | Large T |
| DRB1_1501 | 412 HCVVFNVPKRRYWLF | CVVFNVPKR | 0.4294 | 480 | WB | Large T |
| DRB1_1501 | 10 SMELMDLLGLERAAW | LMDLLGLER | 0.4261 | 497 | WB | Large T |
| DRB4_0101 | 609 ISMYTFSRMKYNICM | FSRMKYNIC | 0.5682 | 107 | WB | Large T |
| DRB4_0101 | 611 MYTFSRMKYNICMGK | FSRMKYNIC | 0.5289 | 163 | WB | Large T |
| DRB4_0101 | 608 EISMYTFSRMKYNIC | ISMYTFSRM | 0.5272 | 167 | WB | Large T |
| DRB4_0101 | 612 YTFSRMKYNICMGKC | FSRMKYNIC | 0.5271 | 167 | WB | Large T |
| DRB4_0101 | 610 SMYTFSRMKYNICMG | FSRMKYNIC | 0.5243 | 172 | WB | Large T |
| DRB4_0101 | 576 TLLLLLIWFRPVADF | LIWFRPVAD | 0.4721 | 302 | WB | Large T |
| DRB4_0101 | 194 HNIIFFLTPHRHRVS | IFFLTPHRH | 0.4700 | 309 | WB | Large T |
| DRB4_0101 | 193 GHNIIFFLTPHRHRV | IFFLTPHRH | 0.4668 | 320 | WB | Large T |
| DRB4_0101 | 192 AGHNIIFFLTPHRHR | IFFLTPHRH | 0.4660 | 323 | WB | Large T |
| DRB4_0101 | 195 NIIFFLTPHRHRVSA | IFFLTPHRH | 0.4640 | 330 | WB | Large T |
| DRB4_0101 | 541 ARFVRQIDFRPKIYL | VRQIDFRPK | 0.4637 | 331 | WB | Large T |
| DRB4_0101 | 577 LLLLLIWFRPVADFS | LIWFRPVAD | 0.4628 | 334 | WB | Large T |
| DRB4_0101 | 191 CAGHNIIFFLTPHRH | IIFFLTPHR | 0.4583 | 351 | WB | Large T |
| DRB4_0101 | 613 TFSRMKYNICMGKCI | FSRMKYNIC | 0.4575 | 354 | WB | Large T |
| DRB4_0101 | 542 RFVRQIDFRPKIYLR | VRQIDFRPK | 0.4556 | 362 | WB | Large T |
| DRB4_0101 | 578 LLLLIWFRPVADFSK | LIWFRPVAD | 0.4526 | 373 | WB | Large T |
| DRB4_0101 | 614 FSRMKYNICMGKCIL | FSRMKYNIC | 0.4368 | 443 | WB | Large T |
| DRB4_0101 | 579 LLLIWFRPVADFSKD | LIWFRPVAD | 0.4362 | 446 | WB | Large T |
| DRB4_0101 | 539 LQARFVRQIDFRPKI | VRQIDFRPK | 0.4355 | 449 | WB | Large T |
| DRB4_0101 | 575 MTLLLLLIWFRPVAD | LLLIWFRPV | 0.4344 | 455 | WB | Large T |
| DRB4_0101 | 538 TLQARFVRQIDFRPK | FVRQIDFRP | 0.4341 | 456 | WB | Large T |
| DRB4_0101 | 540 QARFVRQIDFRPKIY | VRQIDFRPK | 0.4260 | 498 | WB | Large T |
| DRB5_0101 | 543 FVRQIDFRPKIYLRK | RQIDFRPKI | 0.6349 | 52 | WB | Large T |
| DRB5_0101 | 544 VRQIDFRPKIYLRKS | FRPKIYLRK | 0.6346 | 52 | WB | Large T |
| DRB5_0101 | 545 RQIDFRPKIYLRKSL | FRPKIYLRK | 0.6343 | 52 | WB | Large T |
| DRB5_0101 | 546 QIDFRPKIYLRKSLQ | FRPKIYLRK | 0.6326 | 53 | WB | Large T |
| DRB5_0101 | 547 IDFRPKIYLRKSLQN | FRPKIYLRK | 0.6322 | 53 | WB | Large T |
| DRB5_0101 | 411 LHCVVFNVPKRRYWL | VVFNVPKRR | 0.5655 | 110 | WB | Large T |
| DRB5_0101 | 412 HCVVFNVPKRRYWLF | VVFNVPKRR | 0.5631 | 113 | WB | Large T |
| DRB5_0101 | 410 FLHCVVFNVPKRRYW | VVFNVPKRR | 0.5614 | 115 | WB | Large T |
| DRB5_0101 | 409 DFLHCVVFNVPKRRY | VVFNVPKRR | 0.5437 | 139 | WB | Large T |
| DRB5_0101 | 548 DFRPKIYLRKSLQNS | FRPKIYLRK | 0.5361 | 151 | WB | Large T |
| DRB5_0101 | 549 FRPKIYLRKSLQNSE | FRPKIYLRK | 0.5359 | 152 | WB | Large T |
| DRB5_0101 | 255 KEHDFNPEEPEETKQ | FNPEEPEET | 0.5183 | 183 | WB | Large T |
| DRB5_0101 | 254 LKEHDFNPEEPEETK | FNPEEPEET | 0.5181 | 184 | WB | Large T |
| DRB5_0101 | 256 EHDFNPEEPEETKQV | FNPEEPEET | 0.5168 | 186 | WB | Large T |
| DRB5_0101 | 253 GLKEHDFNPEEPEET | GLKEHDFNP | 0.5161 | 188 | WB | Large T |
| DRB5_0101 | 257 HDFNPEEPEETKQVS | FNPEEPEET | 0.5162 | 188 | WB | Large T |
| DRB5_0101 | 408 FDFLHCVVFNVPKRR | CVVFNVPKR | 0.5052 | 211 | WB | Large T |
| DRB5_0101 | 413 CVVFNVPKRRYWLFK | VVFNVPKRR | 0.5006 | 222 | WB | Large T |
| DRB5_0101 | 84 TYGTEEWESWWSSFN | TEEWESWWS | 0.4988 | 227 | WB | Large T |
| DRB5_0101 | 85 YGTEEWESWWSSFNE | WESWWSSFN | 0.4977 | 229 | WB | Large T |
| DRB5_0101 | 88 EEWESWWSSFNEKWD | WESWWSSFN | 0.4975 | 230 | WB | Large T |
| DRB5_0101 | 87 TEEWESWWSSFNEKW | WESWWSSFN | 0.4963 | 233 | WB | Large T |
| DRB5_0101 | 86 GTEEWESWWSSFNEK | WESWWSSFN | 0.4952 | 235 | WB | Large T |
| DRB5_0101 | 677 KGFQCFKRPKTPPPK | FQCFKRPKT | 0.4816 | 273 | WB | Large T |
| DRB5_0101 | 49 EDKMKRMNTLYKKME | MKRMNTLYK | 0.4763 | 289 | WB | Large T |
| DRB5_0101 | 50 DKMKRMNTLYKKMEQ | MKRMNTLYK | 0.4758 | 290 | WB | Large T |
| DRB5_0101 | 48 DEDKMKRMNTLYKKM | MKRMNTLYK | 0.4726 | 301 | WB | Large T |
| DRB5_0101 | 414 VVFNVPKRRYWLFKG | VVFNVPKRR | 0.4695 | 311 | WB | Large T |
| DRB5_0101 | 47 GDEDKMKRMNTLYKK | MKRMNTLYK | 0.4617 | 338 | WB | Large T |

TABLE S-continued

Prediction of BK virus Large T protein specific MHC class 2, 15-mer peptide binders for 14 MHC class 2 alleles (see FIG. 11) using the www.cbs.dtu.dk/services/NetMHCII/database. The MHC class 2 molecules for which no binders were found are not listed.

| Allele | pospeptide | core | 1-log50k(aff) | aff(nM) | B.L. | Identity |
|---|---|---|---|---|---|---|
| DRB5_0101 | 194 HNIIFFLTPHRHRVS | FFLTPHRHR | 0.4587 | 350 | WB | Large T |
| DRB5_0101 | 46 GGDEDKMKRMNTLYK | DKMKRMNTL | 0.4567 | 357 | WB | Large T |
| DRB5_0101 | 193 GHNIIFFLTPHRHRV | FFLTPHRHR | 0.4542 | 367 | WB | Large T |
| DRB5_0101 | 195 NIIFFLTPHRHRVSA | FFLTPHRHR | 0.4419 | 419 | WB | Large T |
| DRB5_0101 | 119 TADSQHSTPPKKKRK | QHSTPPKKK | 0.4363 | 446 | WB | Large T |
| DRB5_0101 | 120 ADSQHSTPPKKKRKV | QHSTPPKKK | 0.4331 | 461 | WB | Large T |
| DRB5_0101 | 259 FNPEEPEETKQVSWK | FNPEEPEET | 0.4320 | 467 | WB | Large T |
| DRB5_0101 | 53 KRMNTLYKKMEQDVK | KRMNTLYKK | 0.4284 | 485 | WB | Large T |
| DRB5_0101 | 22 AAWGNLPLMRKAYLK | WGNLPLMRK | 0.4268 | 494 | WB | Large T |

SEQ ID NOS.: 60258-61275

Preferred BK virus fragments of Agnoprotein capable of interacting with one or more MHC class 2 molecules are listed in Table T.

TABLE T

Prediction of BK virus Agnoprotein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k (aff) | affinity (nM) | Bind Level | Identity |
|---|---|---|---|---|---|---|
| DRB1_0101 | 8 LVVLRQLSRQAS-VKV | LRQLSRQAS | 0.6877 | 29 | SB | Agno |
| DRB1_0101 | 9 VVLRQLSRQAS-VKVG | LSRQASVKV | 0.6820 | 31 | SB | Agno |
| DRB1_0101 | 10 VLRQLSRQASVK-VGK | LSRQASVKV | 0.6587 | 40 | SB | Agno |
| DRB1_0101 | 11 LRQLSRQASVK-VGKT | LSRQASVKV | 0.6595 | 40 | SB | Agno |
| DRB1_0101 | 5 PKNLVVL-RQLSRQAS | VLRQLSRQA | 0.6455 | 46 | SB | Agno |
| DRB1_0101 | 7 NLVVL-RQLSRQASVK | VLRQLSRQA | 0.6439 | 47 | SB | Agno |
| DRB1_0101 | 6 KNLVVL-RQLSRQASV | VLRQLSRQA | 0.6410 | 49 | SB | Agno |
| DRB1_0101 | 12 RQLSRQASVKVG-KTW | LSRQASVKV | 0.6369 | 51 | WB | Agno |
| DRB1_0101 | 14 LSRQASVKVGK-TWTG | LSRQASVKV | 0.6206 | 61 | WB | Agno |
| DRB1_0101 | 18 ASVKVGKTWTGT-KKR | VKVGKTWTG | 0.5679 | 107 | WB | Agno |
| DRB1_0101 | 17 QASVKVGKTWT-GTKK | VKVGKTWTG | 0.5669 | 108 | WB | Agno |
| DRB1_0101 | 15 SRQASVKVGK-TWTGT | VKVGKTWTG | 0.5640 | 112 | WB | Agno |
| DRB1_0101 | 16 RQASVKVGKTWT-GTK | VKVGKTWTG | 0.5640 | 112 | WB | Agno |
| DRB1_0101 | 4 EPKNLVVL-RQLSRQA | PKNLVVLRQ | 0.5604 | 116 | WB | Agno |
| DRB1_0101 | 13 QLSRQASVKVGK-TWT | LSRQASVKV | 0.5447 | 138 | WB | Agno |
| DRB1_0101 | 19 SVKVGKTWTGTK-KRA | VKVGKTWTG | 0.4852 | 263 | WB | Agno |
| DRB1_0101 | 20 VKVGKTWTGTK-KRAQ | VKVGKTWTG | 0.4749 | 293 | WB | Agno |
| DRB1_0401 | 8 LVVLRQLSRQAS-VKV | VLRQLSRQA | 0.4745 | 295 | WB | Agno |
| DRB1_0401 | 10 VLRQLSRQASVK-VGK | LSRQASVKV | 0.4500 | 384 | WB | Agno |
| DRB1_0401 | 9 VVLRQLSRQAS-VKVG | LSRQASVKV | 0.4476 | 394 | WB | Agno |
| DRB1_0401 | 11 LRQLSRQASVK-VGKT | LSRQASVKV | 0.4393 | 431 | WB | Agno |
| DRB1_0401 | 12 RQLSRQASVKVG-KTW | LSRQASVKV | 0.4380 | 437 | WB | Agno |
| DRB1_0405 | 55 DGKNKSTTAL-PAVKD | NKSTTALPA | 0.4704 | 308 | WB | Agno |
| DRB1_0405 | 56 GKNKSTTAL-PAVKDS | TTALPAVKD | 0.4657 | 324 | WB | Agno |

TABLE T-continued

Prediction of BK virus Agnoprotein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | pospeptide | core | 1-log50k affinity (aff) | Bind (nM) | Identity Level | |
|---|---|---|---|---|---|---|
| DRB1_0405 | 57 KNKSTTAL-PAVKDSV | TTALPAVKD | 0.4367 | 443 | WB | Agno |
| DRB1_0405 | 58 NKSTTAL-PAVKDSVK | TTALPAVKD | 0.4330 | 462 | WB | Agno |
| DRB1_1101 | 8 LVVLRQLSRQAS-VKV | LRQLSRQAS | 0.4614 | 340 | WB | Agno |
| DRB1_1101 | 5 PKNLVVL-RQLSRQAS | PKNLVVLRQ | 0.4605 | 343 | WB | Agno |
| DRB1_1101 | 6 KNLVVL-RQLSRQASV | LRQLSRQAS | 0.4594 | 347 | WB | Agno |
| DRB1_1101 | 9 VVLRQLSRQAS-VKVG | LRQLSRQAS | 0.4595 | 347 | WB | Agno |
| DRB1_1101 | 7 NLVVL-RQLSRQASVK | LRQLSRQAS | 0.4579 | 352 | WB | Agno |
| DRB1_1302 | 5 PKNLVVL-RQLSRQAS | VVLRQLSRQ | 0.5120 | 196 | WB | Agno |
| DRB1_1302 | 8 LVVLRQLSRQAS-VKV | LRQLSRQAS | 0.5035 | 215 | WB | Agno |
| DRB1_1302 | 6 KNLVVL-RQLSRQASV | LRQLSRQAS | 0.5031 | 216 | WB | Agno |
| DRB1_1302 | 9 VVLRQLSRQAS-VKVG | LRQLSRQAS | 0.4904 | 248 | WB | Agno |
| DRB1_1302 | 7 NLVVL-RQLSRQASVK | LRQLSRQAS | 0.4893 | 251 | WB | Agno |
| DRB1_1302 | 3 CEPKNLVVL-RQLSRQ | LVVLRQLSR | 0.4329 | 462 | WB | Agno |
| DRB1_1501 | 5 PKNLVVL-RQLSRQAS | LVVLRQLSR | 0.6754 | 34 | SB | Agno |
| DRB1_1501 | 6 KNLVVL-RQLSRQASV | LVVLRQLSR | 0.6742 | 34 | SB | Agno |
| DRB1_1501 | 4 EPKNLVVL-RQLSRQA | LVVLRQLSR | 0.6596 | 40 | SB | Agno |
| DRB1_1501 | 3 CEPKNLVVL-RQLSRQ | LVVLRQLSR | 0.6209 | 60 | WB | Agno |
| DRB1_1501 | 7 NLVVL-RQLSRQASVK | LVVLRQLSR | 0.6093 | 69 | WB | Agno |
| DRB1_1501 | 8 LVVLRQLSRQAS-VKV | LVVLRQLSR | 0.6010 | 75 | WB | Agno |
| DRB1_1501 | 2 FCEPKNLVVL-RQLSR | NLVVLRQLS | 0.5977 | 78 | WB | Agno |
| DRB1_1501 | 9 VVLRQLSRQAS-VKVG | LRQLSRQAS | 0.4406 | 425 | WB | Agno |
| DRB4_0101 | 35 RIFI-FILELLLEFCR | ILELLLEFC | 0.4266 | 494 | WB | Agno |

SEQ ID NOS: 61276-61367

Preferred *Borrelia afzelli* fragments of Osp C capable of interacting with one or more MHC class 1 and/or MHC class 2 molecules are listed in Table U.

TABLE U

Prediction of MHC class 1 and 2 *Borrelia afzelii* OspC peptide binders. Prediction of 8-, 9-, 10-, 11-, 13-, 14-, 15-, 16-mer peptides were using the program displayed in FIG. 2

8 mers:

MKKNTLSA; KKNTLSAI; KNTLSAIL; NTLSAILM; TLSAILMT; LSAILMTL;
SAILMTLF; AILMTLFL; ILMTLFLF; LMTLFLFI; MTLFLFIS; TLFLFISC;
LFLFISCN; FLFISCNN; LFISCNNS; FISCNNSG; ISCNNSGK; SCNNSGKG;
CNNSGKGG; NNSGKGGD; NSGKGGDS; SGKGGDSA; GKGGDSAS; KGGDSAST;
GGDSASTN; GDSASTNP; DSASTNPA; SASTNPAD; ASTNPADE; STNPADES;
TNPADESA; NPADESAK; PADESAKG; ADESAKGP; DESAKGPN; ESAKGPNL;
SAKGPNLT; AKGPNLTE; KGPNLTEI; GPNLTEIS; PNLTEISK; NLTEISKK;
LTEISKKI; TEISKKIT; EISKKITD; ISKKITDS; SKKITDSN; KKITDSNA;
KITDSNAF; ITDSNAFV; TDSNAFVL; DSNAFVLA; SNAFVLAV; NAFVLAVK;
AFVLAVKE; FVLAVKEV; VLAVKEVE; LAVKEVET; AVKEVETL; VKEVETLV;
KEVETLVS; EVETLVSS; VETLVSSI; ETLVSSID; TLVSSIDE; LVSSIDEL;
VSSIDELA; SSIDELAN; SIDELANK; IDELANKA; DELANKAI; ELANKAIG;
LANKAIGK; ANKAIGKK; NKAIGKKI; KAIGKKIQ; AIGKKIQQ; IGKKIQQN;

TABLE U-continued

Prediction of MHC class 1 and 2 *Borrelia afzelii* OspC peptide binders. Prediction of 8-, 9-, 10-, 11-, 13-, 14-, 15-, 16-mer peptides were using the program displayed in FIG. 2

GKKIQQNG; KKIQQNGL; KIQQNGLG; IQQNGLGA; QQNGLGAE; QNGLGAEA;
NGLGAEAN; GLGAEANR; LGAEANRN; GAEANRNE; AEANRNES; EANRNESL;
ANRNESLL; NRNESLLA; RNESLLAG; NESLLAGV; ESLLAGVH; SLLAGVHE;
LLAGVHEI; LAGVHEIS; AGVHEIST; GVHEISTL; VHEISTLI; HEISTLIT;
EISTLITE; ISTLITEK; STLITEKL; TLITEKLS; LITEKLSK; ITEKLSKL;
TEKLSKLK; EKLSKLKN; KLSKLKNS; LSKLKNSG; SKLKNSGE; KLKNSGEL;
LKNSGELK; KNSGELKA; NSGELKAK; SGELKAKI; GELKAKIE; ELKAKIED;
LKAKIEDA; KAKIEDAK; AKIEDAKK; KIEDAKKC; IEDAKKCS; EDAKKCSE;
DAKKCSEE; AKKCSEEF; KKCSEEFT; KCSEEFTN; CSEEFTNK; SEEFTNKL;
EEFTNKLR; EFTNKLRV; FTNKLRVS; TNKLRVSH; NKLRVSHA; KLRVSHAD;
LRVSHADL; RVSHADLG; VSHADLGK; SHADLGKQ; HADLGKQG; ADLGKQGV;
DLGKQGVN; LGKQGVND; GKQGVNDD; KQGVNDDD; QGVNDDDA; GVNDDDAK;
VNDDDAKK; NDDDAKKA; DDDAKKAI; DDAKKAIL; DAKKAILK; AKKAILKT;
KKAILKTN; KAILKTNA; AILKTNAD; ILKTNADK; LKTNADKT; KTNADKTK;
TNADKTKG; NADKTKGA; ADKTKGAE; DKTKGAEE; KTKGAEEL; TKGAEELG;
KGAEELGK; GAEELGKL; AEELGKLF; EELGKLFK; ELGKLFKS; LGKLFKSV;
GKLFKSVE; KLFKSVEG; LFKSVEGL; FKSVEGLV; KSVEGLVK; SVEGLVKA;
VEGLVKAA; EGLVKAAQ; GLVKAAQE; LVKAAQEA; VKAAQEAL; KAAQEALT;
AAQEALTN; AQEALTNS; QEALTNSV; EALTNSVK; ALTNSVKE; LTNSVKEL;
TNSVKELT; NSVKELTS; SVKELTSP; VKELTSPV; KELTSPVV; ELTSPVVA;
LTSPVVAE; TSPVVAES; SPVVAESP; PVVAESPK; VVAESPKK; VAESPKKP 9 mers:

MKKNTLSAI; KKNTLSAIL; KNTLSAILM; NTLSAILMT; TLSAILMTL;
LSAILMTLF; SAILMTLFL; AILMTLFLF; ILMTLFLFI; LMTLFLFIS;
MTLFLFISC; TLFLFISCN; LFLFISCNN; FLFISCNNS; LFISCNNSG;
FISCNNSGK; ISCNNSGKG; SCNNSGKGG; CNNSGKGGD; NNSGKGGDS;
NSGKGGDSA; SGKGGDSAS; GKGGDSAST; KGGDSASTN; GGDSASTNP;
GDSASTNPA; DSASTNPAD; SASTNPADE; ASTNPADES; STNPADESA;
TNPADESAK; NPADESAKG; PADESAKGP; ADESAKGPN; DESAKGPNL;
ESAKGPNLT; SAKGPNLTE; AKGPNLTEI; KGPNLTEIS; GPNLTEISK;
PNLTEISKK; NLTEISKKI; LTEISKKIT; TEISKKITD; EISKKITDS;
ISKKITDSN; SKKITDSNA; KKITDSNAF; KITDSNAFV; ITDSNAFVL;
TDSNAFVLA; DSNAFVLAV; SNAFVLAVK; NAFVLAVKE; AFVLAVKEV;
FVLAVKEVE; VLAVKEVET; LAVKEVETL; AVKEVETLV; VKEVETLVS;
KEVETLVSS; EVETLVSSI; VETLVSSID; ETLVSSIDE; TLVSSIDEL;
LVSSIDELA; VSSIDELAN; SSIDELANK; SIDELANKA; IDELANKAI;
DELANKAIG; ELANKAIGK; LANKAIGKK; ANKAIGKKI; NKAIGKKIQ;
KAIGKKIQQ; AIGKKIQQN; IGKKIQQNG; GKKIQQNGL; KKIQQNGLG;
KIQQNGLGA; IQQNGLGAE; QQNGLGAEA; QNGLGAEAN; NGLGAEANR;
GLGAEANRN; LGAEANRNE; GAEANRNES; AEANRNESL; EANRNESLL;
ANRNESLLA; NRNESLLAG; RNESLLAGV; NESLLAGVH; ESLLAGVHE;
SLLAGVHEI; LLAGVHEIS; LAGVHEIST; AGVHEISTL; GVHEISTLI;
VHEISTLIT; HEISTLITE; EISTLITEK; ISTLITEKL; STLITEKLS;
TLITEKLSK; LITEKLSKL; ITEKLSKLK; TEKLSKLKN; EKLSKLKNS;
KLSKLKNSG; LSKLKNSGE; SKLKNSGEL; KLKNSGELK; LKNSGELKA;
KNSGELKAK; NSGELKAKI; SGELKAKIE; GELKAKIED; ELKAKIEDA;
LKAKIEDAK; KAKIEDAKK; AKIEDAKKC; KIEDAKKCS; IEDAKKCSE;
EDAKKCSEE; DAKKCSEEF; AKKCSEEFT; KKCSEEFTN; KCSEEFTNK;
CSEEFTNKL; SEEFTNKLR; EEFTNKLRV; EFTNKLRVS; FTNKLRVSH;
TNKLRVSHA; NKLRVSHAD; KLRVSHADL; LRVSHADLG; RVSHADLGK;
VSHADLGKQ; SHADLGKQG; HADLGKQGV; ADLGKQGVN; DLGKQGVND;
LGKQGVNDD; GKQGVNDDD; KQGVNDDDA; QGVNDDDAK; GVNDDDAKK;
VNDDDAKKA; NDDDAKKAI; DDDAKKAIL; DDAKKAILK; DAKKAILKT;
AKKAILKTN; KKAILKTNA; KAILKTNAD; AILKTNADK; ILKTNADKT;
LKTNADKTK; KTNADKTKG; TNADKTKGA; NADKTKGAE; ADKTKGAEE;
DKTKGAEEL; KTKGAEELG; TKGAEELGK; KGAEELGKL; GAEELGKLF;
AEELGKLFK; EELGKLFKS; ELGKLFKSV; LGKLFKSVE; GKLFKSVEG;
KLFKSVEGL; LFKSVEGLV; FKSVEGLVK; KSVEGLVKA; SVEGLVKAA;
VEGLVKAAQ; EGLVKAAQE; GLVKAAQEA; LVKAAQEAL; VKAAQEALT;
KAAQEALTN; AAQEALTNS; AQEALTNSV; QEALTNSVK; EALTNSVKE;
ALTNSVKEL; LTNSVKELT; TNSVKELTS; NSVKELTSP; SVKELTSPV;
VKELTSPVV; KELTSPVVA; ELTSPVVAE; LTSPVVAES; TSPVVAESP;
SPVVAESPK; PVVAESPKK; VVAESPKKP 10 mers:

MKKNTLSAIL; KKNTLSAILM; KNTLSAILMT; NTLSAILMTL; TLSAILMTLF;
LSAILMTLFL; SAILMTLFLF; AILMTLFLFI; ILMTLFLFIS; LMTLFLFISC;
MTLFLFISCN; TLFLFISCNN; LFLFISCNNS; FLFISCNNSG; LFISCNNSGK;
FISCNNSGKG; ISCNNSGKGG; SCNNSGKGGD; CNNSGKGGDS; NNSGKGGDSA;
NSGKGGDSAS; SGKGGDSAST; GKGGDSASTN; KGGDSASTNP; GGDSASTNPA;
GDSASTNPAD; DSASTNPADE; SASTNPADES; ASTNPADESA; STNPADESAK;
TNPADESAKG; NPADESAKGP; PADESAKGPN; ADESAKGPNL; DESAKGPNLT;

TABLE U-continued

Prediction of MHC class 1 and 2 *Borrelia afzelii* OspC peptide binders. Prediction of 8-, 9-, 10-, 11-, 13-, 14-, 15-, 16-mer peptides were using the program displayed in FIG. 2

ESAKGPNLTE; SAKGPNLTEI; AKGPNLTEIS; KGPNLTEISK; GPNLTEISKK;
PNLTEISKKI; NLTEISKKIT; LTEISKKITD; TEISKKITDS; EISKKITDSN;
ISKKITDSNA; SKKITDSNAF; KKITDSNAFV; KITDSNAFVL; ITDSNAFVLA;
TDSNAFVLAV; DSNAFVLAVK; SNAFVLAVKE; NAFVLAVKEV; AFVLAVKEVE;
FVLAVKEVET; VLAVKEVETL; LAVKEVETLV; AVKEVETLVS; VKEVETLVSS;
KEVETLVSSI; EVETLVSSID; VETLVSSIDE; ETLVSSIDEL; TLVSSIDELA;
LVSSIDELAN; VSSIDELANK; SSIDELANKA; SIDELANKAI; IDELANKAIG;
DELANKAIGK; ELANKAIGKK; LANKAIGKKI; ANKAIGKKIQ; NKAIGKKIQQ;
KAIGKKIQQN; AIGKKIQQNG; IGKKIQQNGL; GKKIQQNGLG; KKIQQNGLGA;
KIQQNGLGAE; IQQNGLGAEA; QQNGLGAEAN; QNGLGAEANR; NGLGAEANRN;
GLGAEANRNE; LGAEANRNES; GAEANRNESL; AEANRNESLL; EANRNESLLA;
ANRNESLLAG; NRNESLLAGV; RNESLLAGVH; NESLLAGVHE; ESLLAGVHEI;
SLLAGVHEIS; LLAGVHEIST; LAGVHEISTL; AGVHEISTLI; GVHEISTLIT;
VHEISTLITE; HEISTLITEK; EISTLITEKL; ISTLITEKLS; STLITEKLSK;
TLITEKLSKL; LITEKLSKLK; ITEKLSKLKN; TEKLSKLKNS; EKLSKLKNSG;
KLSKLKNSGE; LSKLKNSGEL; SKLKNSGELK; KLKNSGELKA; LKNSGELKAK;
KNSGELKAKI; NSGELKAKIE; SGELKAKIED; GELKAKIEDA; ELKAKIEDAK;
LKAKIEDAKK; KAKIEDAKKC; AKIEDAKKCS; KIEDAKKCSE; IEDAKKCSEE;
EDAKKCSEEF; DAKKCSEEFT; AKKCSEEFTN; KKCSEEFTNK; KCSEEFTNKL;
CSEEFTNKLR; SEEFTNKLRV; EEFTNKLRVS; EFTNKLRVSH; FTNKLRVSHA;
TNKLRVSHAD; NKLRVSHADL; KLRVSHADLG; LRVSHADLGK; RVSHADLGKQ;
VSHADLGKQG; SHADLGKQGV; HADLGKQGVN; ADLGKQGVND; DLGKQGVNDD;
LGKQGVNDDD; GKQGVNDDDA; KQGVNDDDAK; QGVNDDDAKK; GVNDDDAKKA;
VNDDDAKKAI; NDDDAKKAIL; DDDAKKAILK; DDAKKAILKT; DAKKAILKTN;
AKKAILKTNA; KKAILKTNAD; KAILKTNADK; AILKTNADKT; ILKTNADKTK;
LKTNADKTKG; KTNADKTKGA; TNADKTKGAE; NADKTKGAEE; ADKTKGAEEL;
DKTKGAEELG; KTKGAEELGK; TKGAEELGKL; KGAEELGKLF; GAEELGKLFK;
AEELGKLFKS; EELGKLFKSV; ELGKLFKSVE; LGKLFKSVEG; GKLFKSVEGK;
KLFKSVEGLV; LFKSVEGLVK; FKSVEGLVKA; KSVEGLVKAA; SVEGLVKAAQ;
VEGLVKAAQE; EGLVKAAQEA; GLVKAAQEAL; LVKAAQEALT; VKAAQEALTN;
KAAQEALTNS; AAQEALTNSV; AQEALTNSVK; QEALTNSVKE; EALTNSVKEL;
ALTNSVKELT; LTNSVKELTS; TNSVKELTSP; NSVKELTSPV; SVKELTSPVV;
VKELTSPVVA; KELTSPVVAE; ELTSPVVAES; LTSPVVAESP; TSPVVAESPK;
SPVVAESPKK; PVVAESPKKP 11 mers:

MKKNTLSAILM; KKNTLSAILMT; KNTLSAILMTL; NTLSAILMTLF;
TLSAILMTLFL; LSAILMTLFLF; SAILMTLFLFI; AILMTLFLFIS;
ILMTLFLFISC; LMTLFLFISCN; MTLFLFISCNN; TLFLFISCNNS;
LFLFISCNNSG; FLFISCNNSGK; LFISCNNSGKG; FISCNNSGKGG;
ISCNNSGKGGD; SCNNSGKGGDS; CNNSGKGGDSA; NNSGKGGDSAS;
NSGKGGDSAST; SGKGGDSASTN; GKGGDSASTNP; KGGDSASTNPA;
GGDSASTNPAD; GDSASTNPADE; DSASTNPADES; SASTNPADESA;
ASTNPADESAK; STNPADESAKG; TNPADESAKGP; NPADESAKGPN;
PADESAKGPNL; ADESAKGPNLT; DESAKGPNLTE; ESAKGPNLTEI;
SAKGPNLTEIS; AKGPNLTEISK; KGPNLTEISKK; GPNLTEISKKI;
PNLTEISKKIT; NLTEISKKITD; LTEISKKITDS; TEISKKITDSN;
EISKKITDSNA; ISKKITDSNAF; SKKITDSNAFV; KKITDSNAFVL;
KITDSNAFVLA; ITDSNAFVLAV; TDSNAFVLAVK; DSNAFVLAVKE;
SNAFVLAVKEV; NAFVLAVKEVE; AFVLAVKEVET; FVLAVKEVETL;
VLAVKEVETLV; LAVKEVETLVS; AVKEVETLVSS; VKEVETLVSSI;
KEVETLVSSID; EVETLVSSIDE; VETLVSSIDEL; ETLVSSIDELA;
TLVSSIDELAN; LVSSIDELANK; VSSIDELANKA; SSIDELANKAI;
SIDELANKAIG; IDELANKAIGK; DELANKAIGKK; ELANKAIGKKI;
LANKAIGKKIQ; ANKAIGKKIQQ; NKAIGKKIQQN; KAIGKKIQQNG;
AIGKKIQQNGL; IGKKIQQNGLG; GKKIQQNGLGA; KKIQQNGLGAE;
KIQQNGLGAEA; IQQNGLGAEAN; QQNGLGAEANR; QNGLGAEANRN;
NGLGAEANRNE; GLGAEANRNES; LGAEANRNESL; GAEANRNESLL;
AEANRNESLLA; EANRNESLLAG; ANRNESLLAGV; NRNESLLAGVH;
RNESLLAGVHE; NESLLAGVHEI; ESLLAGVHEIS; SLLAGVHEIST;
LLAGVHEISTL; LAGVHEISTLI; AGVHEISTLIT; GVHEISTLITE;
VHEISTLITEK; HEISTLITEKL; EISTLITEKLS; ISTLITEKLSK;
STLITEKLSKL; TLITEKLSKLK; LITEKLSKLKN; ITEKLSKLKNS;
TEKLSKLKNSG; EKLSKLKNSGE; KLSKLKNSGEL; LSKLKNSGELK;
SKLKNSGELKA; KLKNSGELKAK; LKNSGELKAKI; KNSGELKAKIE;
NSGELKAKIED; SGELKAKIEDA; GELKAKIEDAK; ELKAKIEDAKK;
LKAKIEDAKKC; KAKIEDAKKCS; AKIEDAKKCSE; KIEDAKKCSEE;
IEDAKKCSEEF; EDAKKCSEEFT; DAKKCSEEFTN; AKKCSEEFTNK;
KKCSEEFTNKL; KCSEEFTNKLR; CSEEFTNKLRV; SEEFTNKLRVS;
EEFTNKLRVSH; EFTNKLRVSHA; FTNKLRVSHAD; TNKLRVSHADL;
NKLRVSHADLG; KLRVSHADLGK; LRVSHADLGKQ; RVSHADLGKQG;
VSHADLGKQGV; SHADLGKQGVN; HADLGKQGVND; ADLGKQGVNDD;
DLGKQGVNDDD; LGKQGVNDDDA; GKQGVNDDDAK; KQGVNDDDAKK;
QGVNDDDAKKA; GVNDDDAKKAI; VNDDDAKKAIL; NDDDAKKAILK;

TABLE U-continued

Prediction of MHC class 1 and 2 *Borrelia afzelii* OspC peptide binders. Prediction of 8-, 9-, 10-, 11-, 13-, 14-, 15-, 16-mer peptides were using the program displayed in FIG. 2

DDDAKKAILKT; DDAKKAILKTN; DAKKAILKTNA; AKKAILKTNAD;
KKAILKTNADK; KAILKTNADKT; AILKTNADKTK; ILKTNADKTKG;
LKTNADKTKGA; KTNADKTKGAE; TNADKTKGAEE; NADKTKGAEEL;
ADKTKGAEELG; DKTKGAEELGK; KTKGAEELGKL; TKGAEELGKLF;
KGAEELGKLFK; GAEELGKLFKS; AEELGKLFKSV; EELGKLFKSVE;
ELGKLFKSVEG; LGKLFKSVEGL; GKLFKSVEGLV; KLFKSVEGLVK;
LFKSVEGLVKA; FKSVEGLVKAA; KSVEGLVKAAQ; SVEGLVKAAQE;
VEGLVKAAQEA; EGLVKAAQEAL; GLVKAAQEALT; LVKAAQEALTN;
VKAAQEALTNS; KAAQEALTNSV; AAQEALTNSVK; AQEALTNSVKE;
QEALTNSVKEL; EALTNSVKELT; ALTNSVKELTS; LTNSVKELTSP;
TNSVKELTSPV; NSVKELTSPVV; SVKELTSPVVA; VKELTSPVVAE;
KELTSPVVAES; ELTSPVVAESP; LTSPVVAESPK; TSPVVAESPKK;
SPVVAESPKKP;

13 mers:

MKKNTLSAILMTL; KKNTLSAILMTLF; KNTLSAILMTLFL; NTLSAILMTLFLF;
TLSAILMTLFLFI; LSAILMTLFLFIS; SAILMTLFLFISC; AILMTLFLFISCN;
ILMTLFLFISCNN; LMTLFLFISCNNS; MTLFLFISCNNSG; TLFLFISCNNSGK;
LFLFISCNNSGKG; FLFISCNNSGKGG; LFISCNNSGKGGD; FISCNNSGKGGDS;
ISCNNSGKGGDSA; SCNNSGKGGDSAS; CNNSGKGGDSAST; NNSGKGGDSASTN;
NSGKGGDSASTNP; SGKGGDSASTNPA; GKGGDSASTNPAD; KGGDSASTNPADE;
GGDSASTNPADES; GDSASTNPADESA; DSASTNPADESAK; SASTNPADESAKG;
ASTNPADESAKGP; STNPADESAKGPN; TNPADESAKGPNL; NPADESAKGPNLT;
PADESAKGPNLTE; ADESAKGPNLTEI; DESAKGPNLTEIS; ESAKGPNLTEISK;
SAKGPNLTEISKK; AKGPNLTEISKKI; KGPNLTEISKKIT; GPNLTEISKKITD;
PNLTEISKKITDS; NLTEISKKITDSN; LTEISKKITDSNA; TEISKKITDSNAF;
EISKKITDSNAFV; ISKKITDSNAFVL; SKKITDSNAFVLA; KKITDSNAFVLAV;
KITDSNAFVLAVK; ITDSNAFVLAVKE; TDSNAFVLAVKEV; DSNAFVLAVKEVE;
SNAFVLAVKEVET; NAFVLAVKEVETL; AFVLAVKEVETLV; FVLAVKEVETLVS;
VLAVKEVETLVSS; LAVKEVETLVSSI; AVKEVETLVSSID; VKEVETLVSSIDE;
KEVETLVSSIDEL; EVETLVSSIDELA; VETLVSSIDELAN; ETLVSSIDELANK;
TLVSSIDELANKA; LVSSIDELANKAI; VSSIDELANKAIG; SSIDELANKAIGK;
SIDELANKAIGKK; IDELANKAIGKKI; DELANKAIGKKIQ; ELANKAIGKKIQQ;
LANKAIGKKIQQN; ANKAIGKKIQQNG; NKAIGKKIQQNGL; KAIGKKIQQNGLG;
AIGKKIQQNGLGA; IGKKIQQNGLGAE; GKKIQQNGLGAEA; KKIQQNGLGAEAN;
KIQQNGLGAEANR; IQQNGLGAEANRN; QQNGLGAEANRNE; QNGLGAEANRNES;
NGLGAEANRNESL; GLGAEANRNESLL; LGAEANRNESLLA; GAEANRNESLLAG;
AEANRNESLLAGV; EANRNESLLAGVH; ANRNESLLAGVHE; NRNESLLAGVHEI;
RNESLLAGVHEIS; NESLLAGVHEIST; ESLLAGVHEISTL; SLLAGVHEISTLI;
LLAGVHEISTLIT; LAGVHEISTLITE; AGVHEISTLITEK; GVHEISTLITEKL;
VHEISTLITEKLS; HEISTLITEKLSK; EISTLITEKLSKL; ISTLITEKLSKLK;
STLITEKLSKLKN; TLITEKLSKLKNS; LITEKLSKLKNSG; ITEKLSKLKNSGE;
TEKLSKLKNSGEL; EKLSKLKNSGELK; KLSKLKNSGELKA; LSKLKNSGELKAK;
SKLKNSGELKAKI; KLKNSGELKAKIE; LKNSGELKAKIED; KNSGELKAKIEDA;
NSGELKAKIEDAK; SGELKAKIEDAKK; GELKAKIEDAKKC; ELKAKIEDAKKCS;
LKAKIEDAKKCSE; KAKIEDAKKCSEE; AKIEDAKKCSEEF; KIEDAKKCSEEFT;
IEDAKKCSEEFTN; EDAKKCSEEFTNK; DAKKCSEEFTNKL; AKKCSEEFTNKLR;
KKCSEEFTNKLRV; KCSEEFTNKLRVS; CSEEFTNKLRVSH; SEEFTNKLRVSHA;
EEFTNKLRVSHAD; EFTNKLRVSHADL; FTNKLRVSHADLG; TNKLRVSHADLGK;
NKLRVSHADLGKQ; KLRVSHADLGKQG; LRVSHADLGKQGV; RVSHADLGKQGVN;
VSHADLGKQGVND; SHADLGKQGVNDD; HADLGKQGVNDDD; ADLGKQGVNDDDA;
DLGKQGVNDDDAK; LGKQGVNDDDAKK; GKQGVNDDDAKKA; KQGVNDDDAKKAI;
QGVNDDDAKKAIL; GVNDDDAKKAILK; VNDDDAKKAILKT; NDDDAKKAILKTN;
DDDAKKAILKTNA; DDAKKAILKTNAD; DAKKAILKTNADK; AKKAILKTNADKT;
KKAILKTNADKTK; KAILKTNADKTKG; AILKTNADKTKGA; ILKTNADKTKGAE;
LKTNADKTKGAEE; KTNADKTKGAEEL; TNADKTKGAEELG; NADKTKGAEELGK;
ADKTKGAEELGKL; DKTKGAEELGKLF; KTKGAEELGKLFK; TKGAEELGKLFKS;
KGAEELGKLFKSV; GAEELGKLFKSVE; AEELGKLFKSVEG; EELGKLFKSVEGL;
ELGKLFKSVEGLV; LGKLFKSVEGLVK; GKLFKSVEGLVKA; KLFKSVEGLVKAA;
LFKSVEGLVKAAQ; FKSVEGLVKAAQE; KSVEGLVKAAQEA; SVEGLVKAAQEAL;
VEGLVKAAQEALT; EGLVKAAQEALTN; GLVKAAQEALTNS; LVKAAQEALTNSV;
VKAAQEALTNSVK; KAAQEALTNSVKE; AAQEALTNSVKEL; AQEALTNSVKELT;
QEALTNSVKELTS; EALTNSVKELTSP; ALTNSVKELTSPV; LTNSVKELTSPVV;
TNSVKELTSPVVA; NSVKELTSPVVAE; SVKELTSPVVAES; VKELTSPVVAESP;
KELTSPVVAESPK; ELTSPVVAESPKK; LTSPVVAESPKKP

14 mers:

MKKNTLSAILMTLF; KKNTLSAILMTLFL; KNTLSAILMTLFLF;
NTLSAILMTLFLFI; TLSAILMTLFLFIS; LSAILMTLFLFISC;
SAILMTLFLFISCN; AILMTLFLFISCNN; ILMTLFLFISCNNS;
LMTLFLFISCNNSG; MTLFLFISCNNSGK; TLFLFISCNNSGKG;
LFLFISCNNSGKGG; FLFISCNNSGKGGD; LFISCNNSGKGGDS;
FISCNNSGKGGDSA; ISCNNSGKGGDSAS; SCNNSGKGGDSAST;

TABLE U-continued

Prediction of MHC class 1 and 2 Borrelia afzelii OspC peptide binders. Prediction of 8-, 9-, 10-, 11-, 13-, 14-, 15-, 16-mer peptides were using the program displayed in FIG. 2

CNNSGKGGDSASTN; NNSGKGGDSASTNP; NSGKGGDSASTNPA;
SGKGGDSASTNPAD; GKGGDSASTNPADE; KGGDSASTNPADES;
GGDSASTNPADESA; GDSASTNPADESAK; DSASTNPADESAKG;
SASTNPADESAKGP; ASTNPADESAKGPN; STNPADESAKGPNL;
TNPADESAKGPNLT; NPADESAKGPNLTE; PADESAKGPNLTEI;
ADESAKGPNLTEIS; DESAKGPNLTEISK; ESAKGPNLTEISKK;
SAKGPNLTEISKKI; AKGPNLTEISKKIT; KGPNLTEISKKITD;
GPNLTEISKKITDS; PNLTEISKKITDSN; NLTEISKKITDSNA;
LTEISKKITDSNAF; TEISKKITDSNAFV; EISKKITDSNAFVL;
ISKKITDSNAFVLA; SKKITDSNAFVLAV; KKITDSNAFVLAVK;
KITDSNAFVLAVKE; ITDSNAFVLAVKEV; TDSNAFVLAVKEVE;
DSNAFVLAVKEVET; SNAFVLAVKEVETL; NAFVLAVKEVETLV;
AFVLAVKEVETLVS; FVLAVKEVETLVSS; VLAVKEVETLVSSI;
LAVKEVETLVSSID; AVKEVETLVSSIDE; VKEVETLVSSIDEL;
KEVETLVSSIDELA; EVETLVSSIDELAN; VETLVSSIDELANK;
ETLVSSIDELANKA; TLVSSIDELANKAI; LVSSIDELANKAIG;
VSSIDELANKAIGK; SSIDELANKAIGKK; SIDELANKAIGKKI;
IDELANKAIGKKIQ; DELANKAIGKKIQQ; ELANKAIGKKIQQN;
LANKAIGKKIQQNG; ANKAIGKKIQQNGL; NKAIGKKIQQNGLG;
KAIGKKIQQNGLGA; AIGKKIQQNGLGAE; IGKKIQQNGLGAEA;
GKKIQQNGLGAEAN; KKIQQNGLGAEANR; KIQQNGLGAEANRN;
IQQNGLGAEANRNE; QQNGLGAEANRNES; QNGLGAEANRNESL;
NGLGAEANRNESLL; GLGAEANRNESLLA; LGAEANRNESLLAG;
GAEANRNESLLAGV; AEANRNESLLAGVH; EANRNESLLAGVHE;
ANRNESLLAGVHEI; NRNESLLAGVHEIS; RNESLLAGVHEIST;
NESLLAGVHEISTL; ESLLAGVHEISTLI; SLLAGVHEISTLIT;
LLAGVHEISTLITE; LAGVHEISTLITEK; AGVHEISTLITEKL;
GVHEISTLITEKLS; VHEISTLITEKLSK; HEISTLITEKLSKL;
EISTLITEKLSKLK; ISTLITEKLSKLKN; STLITEKLSKLKNS;
TLITEKLSKLKNSG; LITEKLSKLKNSGE; ITEKLSKLKNSGEL;
TEKLSKLKNSGELK; EKLSKLKNSGELKA; KLSKLKNSGELKAK;
LSKLKNSGELKAKI; SKLKNSGELKAKIE; KLKNSGELKAKIED;
LKNSGELKAKIEDA; KNSGELKAKIEDAK; NSGELKAKIEDAKK;
SGELKAKIEDAKKC; GELKAKIEDAKKCS; ELKAKIEDAKKCSE;
LKAKIEDAKKCSEE; KAKIEDAKKCSEEF; AKIEDAKKCSEEFT;
KIEDAKKCSEEFTN; IEDAKKCSEEFTNK; EDAKKCSEEFTNKL;
DAKKCSEEFTNKLR; AKKCSEEFTNKLRV; KKCSEEFTNKLRVS;
KCSEEFTNKLRVSH; CSEEFTNKLRVSHA; SEEFTNKLRVSHAD;
EEFTNKLRVSHADL; EFTNKLRVSHADLG; FTNKLRVSHADLGK;
TNKLRVSHADLGKQ; NKLRVSHADLGKQG; KLRVSHADLGKQGV;
LRVSHADLGKQGVN; RVSHADLGKQGVND; VSHADLGKQGVNDD;
SHADLGKQGVNDDD; HADLGKQGVNDDDA; ADLGKQGVNDDDAK;
DLGKQGVNDDDAKK; LGKQGVNDDDAKKA; GKQGVNDDDAKKAI;
KQGVNDDDAKKAIL; QGVNDDDAKKAILK; GVNDDDAKKAILKT;
VNDDDAKKAILKTN; NDDDAKKAILKTNA; DDDAKKAILKTNAD;
DDAKKAILKTNADK; DAKKAILKTNADKT; AKKAILKTNADKTK;
KKAILKTNADKTKG; KAILKTNADKTKGA; AILKTNADKTKGAE;
ILKTNADKTKGAEE; LKTNADKTKGAEEL; KTNADKTKGAEELG;
TNADKTKGAEELGK; NADKTKGAEELGKL; ADKTKGAEELGKLF;
DKTKGAEELGKLFK; KTKGAEELGKLFKS; TKGAEELGKLFKSV;
KGAEELGKLFKSVE; GAEELGKLFKSVEG; AEELGKLFKSVEGL;
EELGKLFKSVEGLV; ELGKLFKSVEGLVK; LGKLFKSVEGLVKA;
GKLFKSVEGLVKAA; KLFKSVEGLVKAAQ; LFKSVEGLVKAAQE;
FKSVEGLVKAAQEA; KSVEGLVKAAQEAL; SVEGLVKAAQEALT;
VEGLVKAAQEALTN; EGLVKAAQEALTNS; GLVKAAQEALTNSV;
LVKAAQEALTNSVK; VKAAQEALTNSVKE; KAAQEALTNSVKEL;
AAQEALTNSVKELT; AQEALTNSVKELTS; QEALTNSVKELTSP;
EALTNSVKELTSPV; ALTNSVKELTSPVV; LTNSVKELTSPVVA;
TNSVKELTSPVVAE; NSVKELTSPVVAES; SVKELTSPVVAESP;
VKELTSPVVAESPK; KELTSPVVAESPKK; ELTSPVVAESPKKP 15 mers:

MKKNTLSAILMTLFL; KKNTLSAILMTLFLF; KNTLSAILMTLFLFI;
NTLSAILMTLFLFIS; TLSAILMTLFLFISC; LSAILMTLFLFISCN;
SAILMTLFLFISCNN; AILMTLFLFISCNNS; ILMTLFLFISCNNSG;
LMTLFLFISCNNSGK; MTLFLFISCNNSGKG; TLFLFISCNNSGKGG;
LFLFISCNNSGKGGD; FLFISCNNSGKGGDS; LFISCNNSGKGGDSA;
FISCNNSGKGGDSAS; ISCNNSGKGGDSAST; SCNNSGKGGDSASTN;
CNNSGKGGDSASTNP; NNSGKGGDSASTNPA; NSGKGGDSASTNPAD;
SGKGGDSASTNPADE; GKGGDSASTNPADES; KGGDSASTNPADESA;
GGDSASTNPADESAK; GDSASTNPADESAKG; DSASTNPADESAKGP;
SASTNPADESAKGPN; ASTNPADESAKGPNL; STNPADESAKGPNLT;
TNPADESAKGPNLTE; NPADESAKGPNLTEI; PADESAKGPNLTEIS;
ADESAKGPNLTEISK; DESAKGPNLTEISKK; ESAKGPNLTEISKKI;

TABLE U-continued

Prediction of MHC class 1 and 2 *Borrelia afzelii* OspC peptide binders. Prediction of 8-, 9-, 10-, 11-, 13-, 14-, 15-, 16-mer peptides were using the program displayed in FIG. 2

SAKGPNLTEISKKIT; AKGPNLTEISKKITD; KGPNLTEISKKITDS;
GPNLTEISKKITDSN; PNLTEISKKITDSNA; NLTEISKKITDSNAF;
LTEISKKITDSNAFV; TEISKKITDSNAFVL; EISKKITDSNAFVLA;
ISKKITDSNAFVLAV; SKKITDSNAFVLAVK; KKITDSNAFVLAVKE;
KITDSNAFVLAVKEV; ITDSNAFVLAVKEVE; TDSNAFVLAVKEVET;
DSNAFVLAVKEVETL; SNAFVLAVKEVETLV; NAFVLAVKEVETLVS;
AFVLAVKEVETLVSS; FVLAVKEVETLVSSI; VLAVKEVETLVSSID;
LAVKEVETLVSSIDE; AVKEVETLVSSIDEL; VKEVETLVSSIDELA;
KEVETLVSSIDELAN; EVETLVSSIDELANK; VETLVSSIDELANKA;
ETLVSSIDELANKAI; TLVSSIDELANKAIG; LVSSIDELANKAIGK;
VSSIDELANKAIGKK; SSIDELANKAIGKKI; SIDELANKAIGKKIQ;
IDELANKAIGKKIQQ; DELANKAIGKKIQQN; ELANKAIGKKIQQNG;
LANKAIGKKIQQNGL; ANKAIGKKIQQNGLG; NKAIGKKIQQNGLGA;
KAIGKKIQQNGLGAE; AIGKKIQQNGLGAEA; IGKKIQQNGLGAEAN;
GKKIQQNGLGAEANR; KKIQQNGLGAEANRN; KIQQNGLGAEANRNE;
IQQNGLGAEANRNES; QQNGLGAEANRNESL; QNGLGAEANRNESLL;
NGLGAEANRNESLLA; GLGAEANRNESLLAG; LGAEANRNESLLAGV;
GAEANRNESLLAGVH; AEANRNESLLAGVHE; EANRNESLLAGVHEI;
ANRNESLLAGVHEIS; NRNESLLAGVHEIST; RNESLLAGVHEISTL;
NESLLAGVHEISTLI; ESLLAGVHEISTLIT; SLLAGVHEISTLITE;
LLAGVHEISTLITEK; LAGVHEISTLITEKL; AGVHEISTLITEKLS;
GVHEISTLITEKLSK; VHEISTLITEKLSKL; HEISTLITEKLSKLK;
EISTLITEKLSKLKN; ISTLITEKLSKLKNS; STLITEKLSKLKNSG;
TLITEKLSKLKNSGE; LITEKLSKLKNSGEL; ITEKLSKLKNSGELK;
TEKLSKLKNSGELKA; EKLSKLKNSGELKAK; KLSKLKNSGELKAKI;
LSKLKNSGELKAKIE; SKLKNSGELKAKIED; KLKNSGELKAKIEDA;
LKNSGELKAKIEDAK; KNSGELKAKIEDAKK; NSGELKAKIEDAKKC;
SGELKAKIEDAKKCS; GELKAKIEDAKKCSE; ELKAKIEDAKKCSEE;
LKAKIEDAKKCSEEF; KAKIEDAKKCSEEFT; AKIEDAKKCSEEFTN;
KIEDAKKCSEEFTNK; IEDAKKCSEEFTNKL; EDAKKCSEEFTNKLR;
DAKKCSEEFTNKLRV; AKKCSEEFTNKLRVS; KKCSEEFTNKLRVSH;
KCSEEFTNKLRVSHA; CSEEFTNKLRVSHAD; SEEFTNKLRVSHADL;
EEFTNKLRVSHADLG; EFTNKLRVSHADLGK; FTNKLRVSHADLGKQ;
TNKLRVSHADLGKQG; NKLRVSHADLGKQGV; KLRVSHADLGKQGVN;
LRVSHADLGKQGVND; RVSHADLGKQGVNDD; VSHADLGKQGVNDDD;
SHADLGKQGVNDDDA; HADLGKQGVNDDDAK; ADLGKQGVNDDDAKK;
DLGKQGVNDDDAKKA; LGKQGVNDDDAKKAI; GKQGVNDDDAKKAIL;
KQGVNDDDAKKAILK; QGVNDDDAKKAILKT; GVNDDDAKKAILKTN;
VNDDDAKKAILKTNA; NDDDAKKAILKTNAD; DDDAKKAILKTNADK;
DDAKKAILKTNADKT; DAKKAILKTNADKTK; AKKAILKTNADKTKG;
KKAILKTNADKTKGA; KAILKTNADKTKGAE; AILKTNADKTKGAEE;
ILKTNADKTKGAEEL; LKTNADKTKGAEELG; KTNADKTKGAEELGK;
TNADKTKGAEELGKL; NADKTKGAEELGKLF; ADKTKGAEELGKLFK;
DKTKGAEELGKLFKS; KTKGAEELGKLFKSV; TKGAEELGKLFKSVE;
KGAEELGKLFKSVEG; GAEELGKLFKSVEGL; AEELGKLFKSVEGLV;
EELGKLFKSVEGLVK; ELGKLFKSVEGLVKA; LGKLFKSVEGLVKAA;
GKLFKSVEGLVKAAQ; KLFKSVEGLVKAAQE; LFKSVEGLVKAAQEA;
FKSVEGLVKAAQEAL; KSVEGLVKAAQEALT; SVEGLVKAAQEALTN;
VEGLVKAAQEALTNS; EGLVKAAQEALTNSV; GLVKAAQEALTNSVK;
LVKAAQEALTNSVKE; VKAAQEALTNSVKEL; KAAQEALTNSVKELT;
AAQEALTNSVKELTS; AQEALTNSVKELTSP; QEALTNSVKELTSPV;
EALTNSVKELTSPVV; ALTNSVKELTSPVVA; LTNSVKELTSPVVAE;
TNSVKELTSPVVAES; NSVKELTSPVVAESP; SVKELTSPVVAESPK;
VKELTSPVVAESPKK; KELTSPVVAESPKKP 16 mers:

MKKNTLSAILMTLFLF; KKNTLSAILMTLFLFI; KNTLSAILMTLFLFIS;
NTLSAILMTLFLFISC; TLSAILMTLFLFISCN; LSAILMTLFLFISCNN;
SAILMTLFLFISCNNS; AILMTLFLFISCNNSG; ILMTLFLFISCNNSGK;
LMTLFLFISCNNSGKG; MTLFLFISCNNSGKGG; TLFLFISCNNSGKGGD;
LFLFISCNNSGKGGDS; FLFISCNNSGKGGDSA; LFISCNNSGKGGDSAS;
FISCNNSGKGGDSAST; ISCNNSGKGGDSASTN; SCNNSGKGGDSASTNP;
CNNSGKGGDSASTNPA; NNSGKGGDSASTNPAD; NSGKGGDSASTNPADE;
SGKGGDSASTNPADES; GKGGDSASTNPADESA; KGGDSASTNPADESAK;
GGDSASTNPADESAKG; GDSASTNPADESAKGP; DSASTNPADESAKGPN;
SASTNPADESAKGPNL; ASTNPADESAKGPNLT; STNPADESAKGPNLTE;
TNPADESAKGPNLTEI; NPADESAKGPNLTEIS; PADESAKGPNLTEISK;
ADESAKGPNLTEISKK; DESAKGPNLTEISKKI; ESAKGPNLTEISKKIT;
SAKGPNLTEISKKITD; AKGPNLTEISKKITDS; KGPNLTEISKKITDSN;
GPNLTEISKKITDSNA; PNLTEISKKITDSNAF; NLTEISKKITDSNAFV;
LTEISKKITDSNAFVL; TEISKKITDSNAFVLA; EISKKITDSNAFVLAV;
ISKKITDSNAFVLAVK; SKKITDSNAFVLAVKE; KKITDSNAFVLAVKEV;
KITDSNAFVLAVKEVE; ITDSNAFVLAVKEVET; TDSNAFVLAVKEVETL;
DSNAFVLAVKEVETLV; SNAFVLAVKEVETLVS; NAFVLAVKEVETLVSS;

TABLE U-continued

Prediction of MHC class 1 and 2 *Borrelia afzelii* OspC peptide binders. Prediction of 8-, 9-, 10-, 11-, 13-, 14-, 15-, 16-mer peptides were using the program displayed in FIG. 2

AFVLAVKEVETLVSSI; FVLAVKEVETLVSSID; VLAVKEVETLVSSIDE;
LAVKEVETLVSSIDEL; AVKEVETLVSSIDELA; VKEVETLVSSIDELAN;
KEVETLVSSIDELANK; EVETLVSSIDELANKA; VETLVSSIDELANKAI;
ETLVSSIDELANKAIG; TLVSSIDELANKAIGK; LVSSIDELANKAIGKK;
VSSIDELANKAIGKKI; SSIDELANKAIGKKIQ; SIDELANKAIGKKIQQ;
IDELANKAIGKKIQQN; DELANKAIGKKIQQNG; ELANKAIGKKIQQNGL;
LANKAIGKKIQQNGLG; ANKAIGKKIQQNGLGA; NKAIGKKIQQNGLGAE;
KAIGKKIQQNGLGAEA; AIGKKIQQNGLGAEAN; IGKKIQQNGLGAEANR;
GKKIQQNGLGAEANRN; KKIQQNGLGAEANRNE; KIQQNGLGAEANRNES;
IQQNGLGAEANRNESL; QQNGLGAEANRNESLL; QNGLGAEANRNESLLA;
NGLGAEANRNESLLAG; GLGAEANRNESLLAGV; LGAEANRNESLLAGVH;
GAEANRNESLLAGVHE; AEANRNESLLAGVHEI; EANRNESLLAGVHEIS;
ANRNESLLAGVHEIST; NRNESLLAGVHEISTL; RNESLLAGVHEISTLI;
NESLLAGVHEISTLIT; ESLLAGVHEISTLITE; SLLAGVHEISTLITEK;
LLAGVHEISTLITEKL; LAGVHEISTLITEKLS; AGVHEISTLITEKLSK;
GVHEISTLITEKLSKL; VHEISTLITEKLSKLK; HEISTLITEKLSKLKN;
EISTLITEKLSKLKNS; ISTLITEKLSKLKNSG; STLITEKLSKLKNSGE;
TLITEKLSKLKNSGEL; LITEKLSKLKNSGELK; ITEKLSKLKNSGELKA;
TEKLSKLKNSGELKAK; EKLSKLKNSGELKAKI; KLSKLKNSGELKAKIE;
LSKLKNSGELKAKIED; SKLKNSGELKAKIEDA; KLKNSGELKAKIEDAK;
LKNSGELKAKIEDAKK; KNSGELKAKIEDAKKC; NSGELKAKIEDAKKCS;
SGELKAKIEDAKKCSE; GELKAKIEDAKKCSEE; ELKAKIEDAKKCSEEF;
LKAKIEDAKKCSEEFT; KAKIEDAKKCSEEFTN; AKIEDAKKCSEEFTNK;
KIEDAKKCSEEFTNKL; IEDAKKCSEEFTNKLR; EDAKKCSEEFTNKLRV;
DAKKCSEEFTNKLRVS; AKKCSEEFTNKLRVSH; KKCSEEFTNKLRVSHA;
KCSEEFTNKLRVSHAD; CSEEFTNKLRVSHADL; SEEFTNKLRVSHADLG;
EEFTNKLRVSHADLGK; EFTNKLRVSHADLGKQ; FTNKLRVSHADLGKQG;
TNKLRVSHADLGKQGV; NKLRVSHADLGKQGVN; KLRVSHADLGKQGVND;
LRVSHADLGKQGVNDD; RVSHADLGKQGVNDDD; VSHADLGKQGVNDDDA;
SHADLGKQGVNDDDAK; HADLGKQGVNDDDAKK; ADLGKQGVNDDDAKKA;
DLGKQGVNDDDAKKAI; LGKQGVNDDDAKKAIL; GKQGVNDDDAKKAILK;
KQGVNDDDAKKAILKT; QGVNDDDAKKAILKTN; GVNDDDAKKAILKTNA;
VNDDDAKKAILKTNAD; NDDDAKKAILKTNADK; DDDAKKAILKTNADKT;
DDAKKAILKTNADKTK; DAKKAILKTNADKTKG; AKKAILKTNADKTKGA;
KKAILKTNADKTKGAE; KAILKTNADKTKGAEE; AILKTNADKTKGAEEL;
ILKTNADKTKGAEELG; LKTNADKTKGAEELGK; KTNADKTKGAEELGKL;
TNADKTKGAEELGKLF; NADKTKGAEELGKLFK; ADKTKGAEELGKLFKS;
DKTKGAEELGKLFKSV; KTKGAEELGKLFKSVE; TKGAEELGKLFKSVEG;
KGAEELGKLFKSVEGL; GAEELGKLFKSVEGLV; AEELGKLFKSVEGLVK;
EELGKLFKSVEGLVKA; ELGKLFKSVEGLVKAA; LGKLFKSVEGLVKAAQ;
GKLFKSVEGLVKAAQE; KLFKSVEGLVKAAQEA; LFKSVEGLVKAAQEAL;
FKSVEGLVKAAQEALT; KSVEGLVKAAQEALTN; SVEGLVKAAQEALTNS;
VEGLVKAAQEALTNSV; EGLVKAAQEALTNSVK; GLVKAAQEALTNSVKE;
LVKAAQEALTNSVKEL; VKAAQEALTNSVKELT; KAAQEALTNSVKELTS;
AAQEALTNSVKELTSP; AQEALTNSVKELTSPV; QEALTNSVKELTSPVV;
EALTNSVKELTSPVVA; ALTNSVKELTSPVVAE; LTNSVKELTSPVVAES;
TNSVKELTSPVVAESP; NSVKELTSPVVAESPK; SVKELTSPVVAESPKK;
VKELTSPVVAESPKKP

SEQ ID NOS: 49527-51126

Preferred *Borrelia burgdorferi* fragments of Osp A capable of interacting with one or more MHC molecules are listed in Table V.

TABLE V

Prediction of *Borrelia burgdorferi* OspA protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| | | |
|---|---|---|
| CAA44492.1\|Outer surface protein A [*Borrelia burgdorferi*] Seq9 | HLA-A0101 | |
| | HLA-A0201 | YLLGIGLIL |
| | | FTLEGTLAA |
| | | KTSTLTISV |
| | | FTKEDTITV |
| | | ALIACKQNV |
| | | LLGIGLILA |

TABLE V-continued

Prediction of *Borrelia burgdorferi* OspA protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

SLEATVDKL
ILKSGEITV
KVTEGTVVL
STLDEKNSV
TLVSKKVTL
GIGLILALI
YLLGIGLILA
TLDEKNSVSV
ALDDSDTTQA
LLGIGLILAL
NILKSGEITV
TLAADGKTTL

TABLE V-continued

Prediction of *Borrelia burgdorferi* OspA protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

| | |
|---|---|
| | VLKDFTLEGT |
| | YSLEATVDKL |
| | YLLGIGLILAL |
| | LVFTKEDTITV |
| | LLGIGLILALI |
| | ILALIACKQNV |
| | STLDEKNSVSV |
| | ALDDSDTTQAT |
| | VLKDFTLEGTL |
| | SLEATVDKLEL |
| | ILKSGEITVAL |
| | ALIACKQNVST |
| | TTLKVTEGTVV |
| | LAADGKTTLKV |
| | LIACKQNVSTL |
| HLA-A0301 | VVLSKNILK |
| | KTKNLVFTK |
| | LVSKKVTLK |
| | LILALIACK |
| | LTISVNSQK |
| | KAVEITTLK |
| | AADGKTTLK |
| | ISVNSQKTK |
| | RANGTRLEY |
| | SQTKFEIFK |
| | KSDGSGKAK |
| | TQATKKTGK |
| | MTELVSKEK |
| | TLVSKKVTLK |
| | TLTISVNSQK |
| | TVVLSKNILK |
| | GLILALIACK |
| | TLKELKNALK |
| | LSQTKFEIFK |
| | LAADGKTTLK |
| | VTEGTVVLSK |
| | KLELKGTSDK |
| | TTQATKKTGK |
| | GMTELVSKEK |
| | KYSLEATVDK |
| | KQNVSTLDEK |
| | TIADDLSQTK |
| | TISVNSQKTK |
| | KEDAKTLVSK |
| | GSGKAKEVLK |
| | KTIVRANGTR |
| | GTLEGEKTDK |
| | GKAVEITTLK |
| | GTRLEYTDIK |
| | VSKKVTLKDK |
| | IKSDGSGKAK |
| | TLAADGKTTLK |
| | STLTISVNSQK |
| | KTLVSKKVTLK |
| | KVTEGTVVLSK |
| | TTLKELKNALK |
| | LTISVNSQKTK |
| | GTVVLSKNILK |
| | FTKEDTITVQK |
| | IVRANGTRLEY |
| | TLKDKSSTEEK |
| | LVSKKVTLKDK |
| | KFNEKGETSEK |
| | LTIADDLSQTK |
| | SQKTKNLVFTK |
| | KSSTEEKFNEK |
| | ATKKTGKWDSK |
| HLA-A1101 | VVLSKNILK |
| | KTKNLVFTK |
| | SQTKFEIFK |
| | LTISVNSQK |
| | ATVDKLELK |
| | LILALIACK |
| | STEEKFNEK |
| | KAVEITTLK |
| | LVSKKVTLK |
| | MTELVSKEK |
| | AADGKTTLK |
| | SAGTNLEGK |
| | YSLEATVDK |
| | GSGTLEGEK |
| | TQATKKTGK |
| | RANGTRLEY |
| | IADDLSQTK |
| | ISVNSQKTK |
| | KSDGSGKAK |
| | GGMTELVSK |
| | TEGTVVLSK |
| | EITTLKELK |
| | TIVRANGTR |
| | TVVLSKNILK |
| | TTQATKKTGK |
| | TIADDLSQTK |
| | VTEGTVVLSK |
| | LSQTKFEIFK |
| | SSTEEKFNEK |
| | GLILALIACK |
| | KQNVSTLDEK |
| | TLTISVNSQK |
| | TLVSKKVTLK |
| | TISVNSQKTK |
| | LAADGKTTLK |
| | GMTELVSKEK |
| | TLKELKNALK |
| | KTIVRANGTR |
| | GSGKAKEVLK |
| | GTLEGEKTDK |
| | VSKKVTLKDK |
| | GTRLEYTDIK |
| | KLELKGTSDK |
| | DSAGTNLEGK |
| | STLTISVNSQK |
| | TTLKELKNALK |
| | KVTEGTVVLSK |
| | KTLVSKKVTLK |
| | GTVVLSKNILK |
| | LTIADDLSQTK |
| | TLAADGKTTLK |
| | AVEITTLKELK |
| | LTISVNSQKTK |
| | SQKTKNLVFTK |
| | KSSTEEKFNEK |
| | ATKKTGKWDSK |
| | TLKDKSSTEEK |
| | FTKEDTITVQK |
| | TLEGTLAADGK |
| | LVSKKVTLKDK |
| | MTELVSKEKDK |
| | DLSQTKFEIFK |
| | YTDIKSDGSGK |
| | LVSKEKDKDGK |
| | KFNEKGETSEK |
| | IGLILALIACK |
| HLA-A2402 | KYLLGIGLI |
| | KWDSKTSTL |
| | KYDSAGTNL |
| | KYLLGIGLIL |
| | KWDSKTSTLTI |
| | KYSLEATVDKL |
| HLA-A2902 | IVRANGTRLEY |
| | TIADDLSQTKF |
| HLA-A6801 | LTISVNSQK |
| | ETSEKTIVR |
| | MTELVSKEK |

TABLE V-continued

Prediction of *Borrelia burgdorferi* OspA protein specific MHC class1, 8-, 9-, 10-, 11-mer peptide binders for 42 MHC class 1 alleles (see FIG. 11) using the www.cbs.dtu.dk/services/NetMHC/ database. The MHC class 1 molecules for which no binders were found are not listed.

|  |  |
|---|---|
|  | EITTLKELK |
|  | TIVRANGTR |
|  | KAVEITTLK |
|  | DAKTLVSKK |
|  | KTKNLVFTK |
|  | STEEKFNEK |
|  | ATVDKLELK |
|  | LVSKKVTLK |
|  | SQTKFEIFK |
|  | YSLEATVDK |
|  | EGTLAADGK |
|  | ISVNSQKTK |
|  | LILALIACK |
|  | DIKSDGSGK |
|  | VVLSKNILK |
|  | EDAKTLVSK |
|  | DSDTTQATK |
|  | SAGTNLEGK |
|  | TVVLSKNILK |
|  | TLTISVNSQK |
|  | EATVDKLELK |
|  | TIADDLSQTK |
|  | DSAGTNLEGK |
|  | TTQATKKTGK |
|  | LAADGKTTLK |
|  | KTIVRANGTR |
|  | TISVNSQKTK |
|  | TLVSKKVTLK |
|  | SSTEEKFNEK |
|  | TLKELKNALK |
|  | LSQTKFEIFK |
|  | VTEGTVVLSK |
|  | EDAKTLVSKK |
|  | DSDTTQATKK |
|  | GLILALIACK |
| HLA-B0702 | IVRANGTRL |
|  | KVTEGTVVL |
|  | LAADGKTTL |
|  | LPGGMTELV |
|  | TVVLSKNIL |
|  | KAVEITTLKEL |
| HLA-B0801 | TLKELKNAL |
|  | ILKSGEITVAL |
|  | YLLGIGLILAL |
|  | TLKVTEGTVVL |
| HLA-B1501 | SQKTKNLVF |
|  | RANGTRLEY |
|  | YLLGIGLIL |
|  | KVTEGTVVL |
|  | TLKELKNAL |
|  | KAKEVLKDF |
|  | IVRANGTRL |
|  | LGIGLILAL |
|  | TLAADGKTTL |
|  | IVRANGTRLEY |
|  | YLLGIGLILAL |
|  | VQKYDSAGTNL |
|  | ILKSGEITVAL |
|  | VSKEKDKDGKY |
|  | VLKDFTLEGTL |
|  | TLKVTEGTVVL |
|  | VNSQKTKNLVF |
| HLA-B2705 | KKYLLGIGL |
|  | VRANGTRLEY |
|  | GKWDSKTSTL |
|  | KKYLLGIGLIL |
| HLA-B3501 | LAADGKTTL |
|  | RANGTRLEY |
|  | FTLEGTLAA |
|  | TVVLSKNIL |
|  | VALDDSDTT |
|  | YLLGIGLIL |
|  | LPGGMTELV |
|  | IADDLSQTKF |
|  | LPGGMTELVS |
|  | LKVTEGTVVL |
|  | YSLEATVDKL |
|  | YLLGIGLILAL |
|  | NSVSVDLPGGM |
|  | IVRANGTRLEY |
|  | TIADDLSQTKF |
|  | KAVEITTLKEL |
| HLA-B4403 | KEVLKDFTL |
|  | GEITVALDD |
|  | KEKDKDGKY |
|  | KEDAKTLVS |
|  | GEITVALDDS |
|  | KEDTITVQKY |
|  | GEITVALDDSD |
|  | KEVLKDFTLEG |
| HLA-B5101 | LPGGMTELV |
| HLA-B5701 | TTQATKKTGKW |

SEQ ID NOS: 51127-51380

Preferred *Borrelia garinii* fragments of FlaB capable of interacting with one or more MHC molecules are listed in Table X.

TABLE X

Prediction of *Borrelia garinii* FlaB protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| BAD18055.1 FlaB protein [*Borrelia garinii*] Seq15 | HLA-A0101 | NQDEAIAVNIY |
|---|---|---|
|  |  | ELAVQSGNGTY |
|  | HLA-A0201 | SQASWTLRV |
|  |  | QLTDEINRI |
|  |  | AQAAQTAPV |
|  |  | AIAVNIYAA |
|  |  | SLAKIENAI |
|  |  | AVNIYAANV |
|  |  | AQYNQMHML |
|  |  | TTVDANTSL |
|  |  | SQGGVNSPV |
|  |  | QTAPVQEGV |
|  |  | NIYAANVANL |
|  |  | NLNEVEKVLV |
|  |  | VLVRMKELAV |
|  |  | QLTDEINRIA |
|  |  | NLFSGEGAQA |
|  |  | IAVNIYAANV |
|  |  | SLSGSQASWTL |
|  |  | MLSNKSASQNV |
|  |  | AIAVNIYAANV |
|  |  | SQASWTLRVHV |
|  |  | GMQPAKINTPA |
|  |  | KVLVRMKELAV |
|  |  | SLAKIENAIRM |
|  |  | NLFSGEGAQAA |
|  | HLA-A0301 | NQMHMLSNK |
|  |  | GSQASWTLR |
|  |  | TVDANTSLAK |
|  |  | YNQMHMLSNK |
|  |  | LSGSQASWTLR |

TABLE X-continued

Prediction of *Borrelia garinii* FlaB protein specific MHC class 2, 15-mer peptide binders for 14 MHC class 2 alleles (see FIG. 11) using the www.cbs.dtu.dk/services/NetMHCII/ database. The MHC class 2 molecules for which no binders were found are not listed.

| Allele | Peptide |
|---|---|
| HLA-A1101 | TTVDANTSLAK |
| | LSNKSASQNVR |
| | NQMHMLSNK |
| | GSQASWTLR |
| | AVQSGNGTY |
| | TVDANTSLAK |
| | YNQMHMLSNK |
| | EVEKVLVRMK |
| | TTVDANTSLAK |
| | TTEGNLNEVEK |
| | TAEELGMQPAK |
| | TSLAKIENAIR |
| | QYNQMHMLSNK |
| | LSGSQASWTLR |
| | LSNKSASQNVR |
| HLA-A2402 | IYAANVANL |
| | YAANVANLF |
| | IYAANVANLF |
| | TYSDADRGSI |
| | IYAANVANLFS |
| HLA-A2902 | AVQSGNGTY |
| | YAANVANLF |
| | ELAVQSGNGTY |
| | EINRIADQAQY |
| HLA-A6801 | LAKIENAIR |
| | EGNLNEVEK |
| | YAANVANLF |
| | NGTYSDADR |
| | GSQASWTLR |
| | NQMHMLSNK |
| | TSKAINFIQ |
| | NKSASQNVR |
| | EVEKVLVRMK |
| | SLAKIENAIR |
| | TVDANTSLAK |
| | NTSKAINFIQ |
| | SGSQASWTLR |
| | TTVDANTSLA |
| | TTVDANTSLAK |
| | TTEGNLNEVEK |
| | EIEQLTDEINR |
| | LSNKSASQNVR |
| | TSLAKIENAIR |
| | EINRIADQAQY |
| | NLNEVEKVLVR |
| | LSGSQASWTLR |
| | TAEELGMQPAK |
| | QYNQMHMLSNK |
| | NIYAANVANLF |
| | QTAPVQEGVQQ |
| HLA-B0702 | SPVNVTTTV |
| | QPAKINTPA |
| | QPAPATAPS |
| | LVRMKELAV |
| | TPASLSGSQ |
| | APSQGGVNS |
| | APATAPSQG |
| | APVQEGVQQ |
| | TPASLSGSQA |
| | SPVNVTTTVD |
| | APSQGGVNSP |
| | QPAKINTPAS |
| | APSQGGVNSPV |
| | QPAKINTPASL |
| | APATAPSQGGV |
| | SPVNVTTTVDA |
| | TPASLSGSQAS |
| HLA-B0801 | KVLVRMKEL |
| | VEKVLVRMKEL |
| HLA-B1501 | YAANVANLF |
| | AVQSGNGTY |
| | AQAAQTAPV |
| | AQYNQMHML |
| | SQGGVNSPV |
| | SLSGSQASW |
| | SQASWTLRV |
| | IQIEIEQLT |
| | LAVQSGNGTY |
| | SQASWTLRVH |
| | SQNVRTAEEL |
| | VQQEGAQQPA |
| | INRIADQAQY |
| | AQAAQTAPVQ |
| | MQPAKINTPA |
| | ELAVQSGNGTY |
| | NIYAANVANLF |
| | NQDEAIAVNIY |
| | SLSGSQASWTL |
| HLA-B2705 | NRIADQAQY |
| HLA-B3501 | YAANVANLF |
| | QPAPATAPS |
| | SPVNVTTTV |
| | DEAIAVNIY |
| | TTVDANTSL |
| | LAVQSGNGT |
| | QPAKINTPA |
| | AVQSGNGTY |
| | QASWTLRVH |
| | IAVNIYAAN |
| | LAVQSGNGTY |
| | IADQAQYNQM |
| | QPAKINTPAS |
| | LAKIENAIRM |
| | QPAPATAPSQ |
| | YAANVANLFS |
| | TAEELGMQPA |
| | EAIAVNIYAA |
| | QAQYNQMHML |
| | TPASLSGSQA |
| | SPVNVTTTVD |
| | TPASLSGSQAS |
| | ELAVQSGNGTY |
| | NQDEAIAVNIY |
| | QPAKINTPASL |
| | IAVNIYAANVA |
| | NIYAANVANLF |
| | SPVNVTTTVDA |
| | EINRIADQAQY |
| | IADQAQYNQMH |
| | APSQGGVNSPV |
| | LAVQSGNGTYS |
| HLA-B4403 | EELGMQPAKI |
| | NEVEKVLVRM |
| | DEINRIADQA |
| | DEINRIADQAQ |
| HLA-B5101 | SPVNVTTTV |
| | APATAPSQGGV |
| | APSQGGVNSPV |
| HLA-B5701 | ASLSGSQASW |

SEQ ID NOS: 51381-51540

Preferred *Mycobacterium tuberculosis* fragments of CFP10 protein (Rv3874) capable of interacting with one or more class 1 and/or one or more class 2 MHC molecules are listed in Table Y.

TABLE Y

Prediction of MHC class 1 and 2 *Mycobacterium tuberculosis* CFP10 peptide binders. Prediction of 8-, 9-, 10-, 11-, 13-, 14-, 15-, 16-mer peptides were using the program displayed in FIG. 2

8 mers:

MAEMKTDA; AEMKTDAA; EMKTDAAT; MKTDAATL; KTDAATLA; TDAATLAQ; DAATLAQE; AATLAQEA; ATLAQEAG; TLAQEAGN; LAQEAGNF; AQEAGNFE; QEAGNFER; EAGNFERI; AGNFERIS; GNFERISG; NFERISGD; FERISGDL; ERISGDLK; RISGDLKT; ISGDLKTQ; SGDLKTQI; GDLKTQID; DLKTQIDQ; LKTQIDQV; KTQIDQVE; TQIDQVES; QIDQVEST; IDQVESTA; DQVESTAG; QVESTAGS; VESTAGSL; ESTAGSLQ; STAGSLQG; TAGSLQGQ; AGSLQGQW; GSLQGQWR; SLQGQWRG; LQGQWRGA; QGQWRGAA; GQWRGAAG; QWRGAAGT; WRGAAGTA; RGAAGTAA; GAAGTAAQ; AAGTAAQA; AGTAAQAA; GTAAQAAV; TAAQAAVV; AAQAAVVR; AQAAVVRF; QAAVVRFQ; AAVVRFQE; AVVRFQEA; VVRFQEAA; VRFQEAAN; RFQEAANK; FQEAANKQ; QEAANKQK; EAANKQKQ; AANKQKQE; ANKQKQEL; NKQKQELD; KQKQELDE; QKQELDEI; KQELDEIS; QELDEIST; ELDEISTN; LDEISTNI; DEISTNIR; EISTNIRQ; ISTNIRQA; STNIRQAG; TNIRQAGV; NIRQAGVQ; IRQAGVQY; RQAGVQYS; QAGVQYSR; AGVQYSRA; GVQYSRAD; VQYSRADE; QYSRADEE; YSRADEEQ; SRADEEQQ; RADEEQQQ; ADEEQQQA; DEEQQQAL; EEQQQALS; EQQQALSS; QQQALSSQ; QQALSSQM; QALSSQMG; ALSSQMGF 9 mers:

MAEMKTDAA; AEMKTDAAT; EMKTDAATL; MKTDAATLA; KTDAATLAQ; TDAATLAQE; DAATLAQEA; AATLAQEAG; ATLAQEAGN; TLAQEAGNF; LAQEAGNFE; AQEAGNFER; QEAGNFERI; EAGNFERIS; AGNFERISG; GNFERISGD; NFERISGDL; FERISGDLK; ERISGDLKT; RISGDLKTQ; ISGDLKTQI; SGDLKTQID; GDLKTQIDQ; DLKTQIDQV; LKTQIDQVE; KTQIDQVES; TQIDQVEST; QIDQVESTA; IDQVESTAG; DQVESTAGS; QVESTAGSL; VESTAGSLQ; ESTAGSLQG; STAGSLQGQ; TAGSLQGQW; AGSLQGQWR; GSLQGQWRG; SLQGQWRGA; LQGQWRGAA; QGQWRGAAG; GQWRGAAGT; QWRGAAGTA; WRGAAGTAA; RGAAGTAAQ; GAAGTAAQA; AAGTAAQAA; AGTAAQAAV; GTAAQAAVV; TAAQAAVVR; AAQAAVVRF; AQAAVVRFQ; QAAVVRFQE; AAVVRFQEA; AVVRFQEAA; VVRFQEAAN; VRFQEAANK; RFQEAANKQ; FQEAANKQK; QEAANKQKQ; EAANKQKQE; AANKQKQEL; ANKQKQELD; NKQKQELDE; KQKQELDEI; QKQELDEIS; KQELDEIST; QELDEISTN; ELDEISTNI; LDEISTNIR; DEISTNIRQ; EISTNIRQA; ISTNIRQAG; STNIRQAGV; TNIRQAGVQ; NIRQAGVQY; IRQAGVQYS; RQAGVQYSR; QAGVQYSRA; AGVQYSRAD; GVQYSRADE; VQYSRADEE; QYSRADEEQ; YSRADEEQQ; SRADEEQQQ; RADEEQQQA; ADEEQQQAL; DEEQQQALS; EEQQQALSS; EQQQALSSQ; QQQALSSQM; QQALSSQMG; QALSSQMGF;

10 mers:

MAEMKTDAAT; AEMKTDAATL; EMKTDAATLA; MKTDAATLAQ; KTDAATLAQE; TDAATLAQEA; DAATLAQEAG; AATLAQEAGN; ATLAQEAGNF; TLAQEAGNFE; LAQEAGNFER; AQEAGNFERI; QEAGNFERIS; EAGNFERISG; AGNFERISGD; GNFERISGDL; NFERISGDLK; FERISGDLKT; ERISGDLKTQ; RISGDLKTQI; ISGDLKTQID; SGDLKTQIDQ; GDLKTQIDQV; DLKTQIDQVE; LKTQIDQVES; KTQIDQVEST; TQIDQVESTA; QIDQVESTAG; IDQVESTAGS; DQVESTAGSL; QVESTAGSLQ; VESTAGSLQG; ESTAGSLQGQ; STAGSLQGQW; TAGSLQGQWR; AGSLQGQWRG; GSLQGQWRGA; SLQGQWRGAA; LQGQWRGAAG; QGQWRGAAGT; GQWRGAAGTA; QWRGAAGTAA; WRGAAGTAAQ; RGAAGTAAQA; GAAGTAAQAA; AAGTAAQAAV; AGTAAQAAVV; GTAAQAAVVR; TAAQAAVVRF; AAQAAVVRFQ; AQAAVVRFQE; QAAVVRFQEA; AAVVRFQEAA; AVVRFQEAAN; VVRFQEAANK; VRFQEAANKQ; RFQEAANKQK; FQEAANKQKQ; QEAANKQKQE; EAANKQKQEL; AANKQKQELD; ANKQKQELDE; NKQKQELDEI; KQKQELDEIS; QKQELDEIST; KQELDEISTN; QELDEISTNI; ELDEISTNIR; LDEISTNIRQ; DEISTNIRQA; EISTNIRQAG; ISTNIRQAGV; STNIRQAGVQ; TNIRQAGVQY; NIRQAGVQYS; IRQAGVQYSR; RQAGVQYSRA; QAGVQYSRAD; AGVQYSRADE; GVQYSRADEE; VQYSRADEEQ; QYSRADEEQQ; YSRADEEQQQ; SRADEEQQQA; RADEEQQQAL; ADEEQQQALS; DEEQQQALSS; EEQQQALSSQ; EQQQALSSQM; QQQALSSQMG; QQALSSQMGF;

11 mers:

MAEMKTDAATL; AEMKTDAATLA; EMKTDAATLAQ; MKTDAATLAQE; KTDAATLAQEA; TDAATLAQEAG; DAATLAQEAGN; AATLAQEAGNF; ATLAQEAGNFE; TLAQEAGNFER; LAQEAGNFERI; AQEAGNFERIS; QEAGNFERISG; EAGNFERISGD; AGNFERISGDL; GNFERISGDLK; NFERISGDLKT; FERISGDLKTQ; ERISGDLKTQI; RISGDLKTQID; ISGDLKTQIDQ; SGDLKTQIDQV; GDLKTQIDQVE; DLKTQIDQVES; LKTQIDQVEST; KTQIDQVESTA; TQIDQVESTAG; QIDQVESTAGS; IDQVESTAGSL; DQVESTAGSLQ; QVESTAGSLQG; VESTAGSLQGQ; ESTAGSLQGQW; STAGSLQGQWR; TAGSLQGQWRG; AGSLQGQWRGA; GSLQGQWRGAA; SLQGQWRGAAG; LQGQWRGAAGT; QGQWRGAAGTA;

TABLE Y-continued

Prediction of MHC class 1 and 2 *Mycobacterium tuberculosis* CFP10 peptide binders. Prediction of 8-, 9-, 10-, 11-, 13

TABLE Y-continued

Prediction of MHC class 1 and 2 *Mycobacterium tuberculosis* CFP10 peptide binders. Prediction of 8-, 9-, 10-, 11-, 13-, -continued

INDEX TO SEQUENCE LIST

| | SEQ ID NO |
|---|---|
| Table D: BclX(L) fragments (class II) | 47134-47645 |
| Table O: BK 13-16 mers class II | 24957-44888 |
| Table P: BK 13-16 mers class II | 58312-59135 |
| Table Q: BK 13-16 mers class II | 59136-59917 |
| Table R: BK 13-16 mers class II | 59918-60257 |
| Table S: BK 13-16 mers class II | 60258-61275 |
| Table T: BK 13-16 mers class II | 61276-61367 |
| Table F: Survivin fragments (class I) | 47646-48180 |
| Table G: Mcl-1 fragments (class II) | 48181-49526 |
| Table U: *Borrelia* OspC 8-11 mers and 13-16 mers | 49527-51126 |
| Table V: *Borrelia* OspA fragments | 51127-51380 |
| Table X: *Borrelia* FlaB fragments | 51381-51540 |
| Table Y: *Mycobacterium tuberculosis* CFP10 8-11 mers and 13-16 mers | 51541-52252 |
| FIG. 7 | 61368-61663 |
| FIG. 8 and 9 | 61664 |
| FIG. 12 | 61665-61726 |
| FIG. 15, 16 and 17 | 61727 |
| FIG. 18 | 61728 |
| FIG. 19 | 61729 |
| FIG. 20 | 61730 |

EXAMPLES

Example 1

This example describes how to make a MHC class I complex with a peptide in the peptide binding-groove using in vitro refolding. The MHC-complex in this example consisted of light chain β2m, the MHC class I Heavy Chain allele HLA-A*0201 (a truncated version in which the intracellular and transmembrane domains have been deleted) and the peptide QLFEELQEL. MHC I-complexes consists of 3 components; Light Chain (β2m), Heavy Chain and a peptide of typically 8-10 amino acids. In this example MHC-complexes was generated by in vitro refolding of heavy chain, β2m and peptide in a buffer containing reduced and oxidized glutathione. By incubation in this buffer a non-covalent complex between Heavy Chain, β2m and peptide was formed. Heavy chain and β2m was expressed as inclusion bodies in *E. coli* prior to in vitro refolding following standard procedures as described in Garboczi et al., (1996), Nature 384, 134-141. Following refolding the MHC complexes was biotinylated using BirA enzyme able to biotinylate a specific amino acid residue in a recognition sequence fused to the C-terminal of the Heavy Chain by genetic fusion. Monomer MHC complexes was then purified by size exclusion chromatography.

1. 200 ml of refolding buffer (100 mM Tris, 400 mM L-arginin-HCL, 2 mM NaEDTA, 0.5 mM oxidized Gluthathione, 5 mM reduced Glutathione, pH 8.0) was supplied with protease inhibitors PMSF (phenylmethylsulphonyl fluoride), Pepstatin A and Leupeptin (to a final concentration of 1 mM, 1 mg/l and 1 mg/l, respectively). The refolding buffer was placed at 10° C. on a stirrer.
2. 12 mg of peptide QLFEELQEL was dissolved in DMSO or another suitable solvent (300-500 µl), and added drop-wise to the refolding buffer at vigorous stirring.
3. 4.4 mg of human Light Chain β2m was added drop-wise to the refolding buffer at vigorous stirring.
4. 6.2 mg of Heavy Chain HLA-A*0201 (supplied with DTT to a concentration of 0.1 mM) was added drop-wise to the refolding buffer at vigorous stirring.
5. The folding reaction was placed at 10° C. at slow stirring for 4-8 hours.
6. After 4-8 hours, step 3 and 4 was repeated and the folding reaction is placed at 10° C. at slow stirring O/N.
7. Step 3 and 4 was repeated, and the folding reaction is placed at 10° C. at slow stirring for 6-8 hours.
 Optionally, steps 5-7 may be done in less time, e.g. a total of 0.5-5 hours.
8. After 6-8 hours the folding reaction was filtrated through a 0.2 µm filter to remove aggregates.
9. The folding reaction was concentrated O/N at 10° C. shaking gently in a suitable concentrator with a 5000 mw cut-off filter. The folding reaction was concentrated to approximately 5-10 ml. (Optionally the filtrate can be stored at 4° C. and reused for another folding with the same peptide and heavy chain.)
10. The concentrated folding reaction was buffer-exchanged at least 8 times, into a MHC-buffer (20 mM Tris-HCl, 50 mM NaCl, pH 8.0) and concentrated (at 10° C. in a suitable concentrator with a 5000 mw cut-off filter) down to approximately 1 ml.
11. The heavy chain part of the MHC-complex was biotinylated by mixing the following components: approximately 1000 µl folded MHC-complex, 100 µl each of Biomix-A, Biomix-B and d-Biotin (all 3 from Biotin Protein Ligase Kit from Avidity, 10 µl birA enzyme (3 mg/ml, from Biotin Protein Ligase Kit from Avidity, 0.5 µl Pepstatin A (2 mg/ml) and 0.5 µl Leupeptin (2 mg/ml). The above was gently mixed and incubated O/N at room temperature.
12. The biotinylated and folded MHC-complex solution was centrifuged for 5 min. at 1700×g, room temperature.
13. Correctly folded MHC-complex was separated and purified from excess biotin, excess β2m, excess heavy chain and aggregates thereof, by size exclusion chromatography on a column that separates proteins in the 10-100 kDa range. Correctly folded monomer MHC-complex was eluted with a MHC-buffer (20 mM Tris-HCl, 50 mM NaCl, pH 8.0). The elution profile consisted of 4 peaks, corresponding to aggregated Heavy Chain, correctly folded monomer MHC-complex, β2m and excess biotin and peptide (See FIG. 8).
14. Fractions containing the folded MHC-complex were pooled and concentrated to approximately 1 ml in a suitable concentrator with a 5000 mw cut-off filter. The protein-concentration was estimated from its absorption at 280 nm.
15. Folded MHC-complex can optionally be stored at −170° C. before further use.
16. The grade of biotinylation was analyzed by a SDS PAGE SHIFT-assay with Streptavidin (FIG. 9) and correct folding was confirmed by ELISA, using the antibody W6/32 that recognizes correctly folded MHC-peptide complex.
17.

The above procedure may be used for folding any MHC I complexes consisting of any β2m, any heavy chain and any peptide approx. 8-11 amino acids long. Either of the components can be truncated or otherwise modified. The above procedure can also be used for generation of "empty" MHC I complexes consisting of β2m and heavy chain without peptide.

Example 2

This example describes how to generate soluble biotinylated MHC II complexes using a baculovirus expression system, where the MHC II complex was DR4 consisting of the α-chain DRA1*0101 and the β-chain DRB1*0401 as described by Svendsen et al., (2004), J. Immunol. 173(11): 7037-45. Briefly, The hydrophobic transmembrane regions of the DRα and DRβ chains of DR4 were replaced by leucine zipper dimerization domains from the transcription factors Fos and Jun to promote DR α/β assembly. This was done by ligating cytoplasmic cDNA sequences of DRA1*0101 and DRB1*0401 to fos- and jun-encoding sequences. A birA site GLNDIFEAQKIEWH was added to the 3' end of the DRA1*0101-fos template. Covalently bound peptide AGFKGEQGPKGEP derived from collagen II amino acid 261-273 were genetically attached by a flexible linker peptide to the N terminus of the DRβ-chain. Finally, the modified DRA1*0101 and DRB1*0401 inserts were cloned into the expression vector pAcAb3. The pAcAB3-DRA1*0101/DRB1*0401 plasmids were cotransfected with linearized baculovirus DNA (BD Pharmingen; BaculoGold kit) into Sf9 insect cells, according to the manufacturer's instructions. Following two rounds of plaque purification, clonal virus isolates were further amplified three times before preparation of high-titer virus ($10^8$-$10^{10}$/ ml). These stocks were used to infect High Five or serum-free Sf21 insect cells (Invitrogen Life Technologies, Carlsbad, Calif.) for protein production. Spinner cultures (2-3× $10^6$ cells/ml) were infected at a multiplicity of infection of 1-3 in a volume of 150 ml per 2 L spinner flask. Supernatants were harvested and proteinase inhibitor tablets (Roche, Basel, Switzerland) were added before affinity purification on MiniLeak-Low columns (Kem-En-Tec) coupled with the anti-HLA-DR monoclonal antibody L243. HLA-DR4 complexes were eluted with diethylamine (pH 11) into neutralization buffer (2 M Tris, pH 6.5) and immediately buffer exchanged and concentrated in PBS, 0.01% $NaN_3$, using Millipore (Bedford, Mass.) concentrators. The purity of protein was confirmed by SDS-PAGE. The purified DR4 complexes were biotinylated in vitro as described for MHC I complexes elsewhere herein. These complexes may now be used for coupling to any dimerization domain, e.g. divynylsulfone activated dextran 270 coupled with SA and a fluorochrome.

Example 3

This example describes how to generate empty biotinylated MHC II complexes using a baculovirus expression system, where the MHC II complex consist of any α-chain and any β-chain, including truncated and otherwise modified versions of the two. Briefly, The hydrophobic transmembrane regions of the DRα and DRβ chains of MHC II are replaced by leucine zipper dimerization domains from the transcription factors Fos and Jun to promote DR α/β assembly. This is done by ligating cytoplasmic cDNA sequences of DRα and DRβ to fos- and jun-encoding sequences. A birA site GLNDIFEAQKIEWH is added to the 3' end of either the DRα-fos/DRα-jun or the DRβ-jun/DRβ-fos template. The modified DRα and DRβ inserts is cloned into the expression vector pAcAb3 and cotransfected with linearized baculovirus DNA into Sf9 insect cells, according to the manufacturer's instructions. Following rounds of plaque purification, clonal virus isolates is further amplified before preparation of high-titer virus. These stocks are used to infect High Five or serum-free Sf21 insect cells (Invitrogen Life Technologies, Carlsbad, Calif.) for protein production, e.g. as Spinner cultures. Supernatants are harvested and proteinase inhibitors added before affinity purification, e.g. using a MiniLeak-Low columns (Kem-En-Tec) coupled with anti-MHC II antibody. The purified MHC II complexes is biotinylated in vitro as described for MHC I complexes elsewhere herein. These biotinylated MHC II complexes may now be used for coupling to any dimerization domain, e.g. divynylsulfone activated dextran 270 coupled with SA and a fluorochrome.

Example 4

This example describes how to generate biotinylated MHC II complexes using a cell based protein expression system, where the MHC II complex consist of any α-chain and any β-chain, including truncated and otherwise modified versions of the two. The MHC II complex may also have a peptide bound in the peptide binding cleft.

The hydrophobic transmembrane regions of the MHC II α-chain and MHC II β-chain are replaced by leucine zipper dimerization domains from the transcription factors Fos and Jun to promote α/β chain assembly. This is done by ligating cytoplasmic cDNA sequences of α-chain and β-chain to fos- and jun-encoding sequences. A birA site GLNDIFEAQKIEWH is added to the 3' end of the DRα-fos template. Optionally covalently bound peptide is genetically attached by a flexible linker peptide to the N terminus of the DRβ-chain. The modified DRα and DRβ inserts is cloned into a suitable expression vector and transfected into a cell line capable of protein expression, e.g. insect cells, CHO cells or similar. Transfected cells are grown in culture, supernatants are harvested and proteinase inhibitors added before affinity purification, e.g. using a MiniLeak-Low columns (Kem-En-Tec) coupled with anti-MHC II antibody. Alternatively the expressed MHC II complexes may be purified by anion- or cation-exchange chromatography. The purified MHC II complexes is biotinylated in vitro as described for MHC I complexes elsewhere herein. These biotinylated MHC II complexes may now be used for coupling to any dimerization domain, e.g. divynylsulfone activated dextran 270 coupled with SA and a fluorochrome.

Example 5

This is an example of how to make a MHC multimer that is a tetramer and where the MHC are attached to the multimerization domain through a non-covalent interaction The multimerization domain consist of Streptavidin. The MHC molecule was biotinylated DR4 consisting of the α-chain DRA1*0101 and the β-chain DRB1*0401 and the peptide AGFKGEQGPKGEP derived from collagen II amino acid 261-273. The biotinylated MHC-peptide complexes was generated as described in a previous example herein.

Fluorescent DR4-peptide tetramer complexes were assembled by addition of ultra-avidin-R-PE (Leinco Technologies, St. Louis, Mo.) at a final molar ratio of biotinylated to DR4-peptide ultra-avidin-R-PE of 6:1. The resulting DR4-peptide multimer complexes were subjected to size exclusion on a Superdex-200 column to separate the tetramer complexes from protein aggregates and lower molecular weight complexes and excess fre DR4-peptide. The tetramer complexes were concentrated using Centicon-30 concentrators and stored at 0.1-0.3 mg/ml in a mixture of protease inhibitors.

These complexes could be used to detect specific T cells in a flow cytometry assay as described by Svendsen et al. (2004) Tracking of Proinflammatory Collagen-Specific T cells in Early and Late Collagen-Induced Arthritis in Humanized mice. J. Immunol. 173:7037-7045.

Example 6

This example describes how an activated divinylsylfone-dextran (270 kDa) (VS-dex270) was coupled with streptavidin (SA) and Allophycocyanin (APC).

1. Streptavidin (approx. 100 mg SA/ml in 10 mM HEPES, 0.1M NaCl, pH 7.85) was dialysed with gentle stirring for 2 days against 10 mM HEPES, 0.1M NaCl, pH 7.85 (20 fold excess volume) at 2-8° C. with 1 buffer change/day.
2. 5 ml of APC from a homogen suspension (approx. 10 mg/ml) was centrifuged 40 min. at 3000 rpm. The supernatant was discharged and the precipitate dissolved in 5 ml of 10 mM HEPES, 0.1M NaCl, pH 7.85. This APC solution was dialysed with gentle stirring in the dark for 2 days against 10 mM HEPES, 0.1M NaCl, pH 7.85 (20 fold excess volume) at 2-8° C. with 1 buffer change/day.
3. The APC-solution was concentrated to 1 ml and the concentration measured to 47 g/L at UV 650 nm. The A650/A278-ratio was measured to 4.2.
4. The SA-solution was filtrated through a 0.45 µm filter and the protein concentration was measured to 61.8 g SA/L at UV 278 nm.
5. Conjugation: The reagents was mixed to a total volume of 500 µl in the following order with 8.1 mol SA/mol Dex and 27 mol APC/mol Dex.:
   a) 90 µl water
   b) 160 µl activated VS-dex270
   c) 23 µl SA (61.8 g/L)~8.1 equivalents,
   d) 177 µl APC (47 g/L)~27 equivalents,
   e) 50 µl of 100 mM HEPES, 1M NaCl, pH 8

The reaction was placed in a water bath with stirring at 30° C. in the dark for 18 hours.

6. The coupling was stopped by adding 50 µl 0.1M ethanolamine, pH 8.0.
7. The conjugate was purified on a Sephacryl S-200 column with 10 mM HEPES, 0.1M NaCl buffer, pH 7.2.
8. 3 peaks were collected (peak 1: APC-SA-dex270; peak 2: Free APC; peak 3: Free SA). Volume, UV A650 and UV A278 were measured.
9. The concentration of dextran270, APC/Dex and SA/Dex were calculated to $22.4 \times 10^{-8}$ M; 3.48 and 9.54 respectively.
10. The conjugate were added $NaN_3$ and BSA to a final concentration of 15 mM and 1% respectively. The volume was adjusted with 10 mM HEPES, 0.1M NaCl, pH 7.2 to a final concentration of $16 \times 10^{-8}$ M Dex270.
11. The conjugate were kept at 2-8° C. in dark until further use.

Example 7

This example describes how an activated divinylsylfone-dextran (270 kDa) (VS-dex270) was coupled with streptavidin (SA) and R-phycoerythrin (RPE).

The coupling procedure described for coupling of SA and APC to VS-dex270 (as described elsewhere herein) were followed with the exception that APC were replaced with RPE

Example 8

This example describes how to couple an empty MHC or a MHC-complex to a dextran multimerization domain through a non-covalent coupling, to generate a MHC-dextramer. The MHC-dextramer in this example consisted of APC-streptavidin (APC-SA)-conjugated 270 kDA dextran and a biotinylated, folded MHC-complex composed of β2m, HLA-A*0201 heavy chain and the peptide NLVPMVATV.

The APC-SA conjugated 270 kDA dextran contained 3.7 molecules of SA per dextran (each SA can bind 3 MHC-complexes) and the concentration was $16 \times 10^{-8}$ M. The concentration of the HLA-A*0201/NLVPMVATV-complex was 4 mg/ml (1 µg=20,663 pmol). The molecular concentration of the MHC-complex was $8.27 \times 10^{-5}$M.

The MHC-Complex was Attached to the Dextran by a Non-Covalent Biotin-Streptavidin Interaction Between the Biotinylated Heavy Chain Part of the MHC-Complex and the SA, Conjugated to Dextran.

Here follows a protocol for how to produce 1000 µl of a MHC-dextramer solution with a final concentration of approximately $32 \times 10^{-9}$M:

1. 200 µL 270 kDA vinylsulfone-activated dextran, corresponding to $3.2 \times 10^{-11}$ mol, and 4 µl MHC-complex, corresponding to $3.55 \times 10^{-10}$ mol was mixed and incubated at room temperature in the dark for 30 min.
2. A buffer of 0.05M Tris-HCl, 15 mM $NaN_3$, 1% BSA, pH 7.2 was added to a total volume of 1000 µl.
3. The resulting MHC-dextramer preparation may now be used in flow cytometry experiments.

Example 9

This is an example of how to make and use MHC multimers that are trimers consisting of a streptavidin multimerization domain with 3 biotinylated MHC complexes and 1 fluorophore molecule attached to the biotin binding pockets of streptavidin.

MHC complexes consisting of HLA-A*0201 heavy chain, beta2microglobulin and NLVPMVATV peptide or the negative control peptide GLAGDVSAV were generated as described elsewhere herein. The fluorophore in this example was Fluorescein-linker molecules as shown in FIG. 10. Each of these molecules consist of a linker-biotin molecule mounted with 4 trippel fluorescein-linker molecules. The linker-biotin molecule was here H-L30-Lys($NH_2$)-L30-Lys($NH_2$)-L30-Lys($NH_2$)L300Lys(caproylamidobiotin)-$NH_2$ where L30 was a 30 atom large linker and L300 was a 300 atom large linker. Both L30 and L300 was composed of multiple L15 linkers with the structure shown in FIG. 10B. Linker-biotin molecules were generated as follows: Downloaded Boc-L300-Lys(Fmoc) resin (100 mg) was deprotected and subjected to coupling with Boc-Lys(2ClZ)—OH, Boc-L30-OH, Boc-Lys(2ClZ)—OH, Boc-L30-OH, Boc-Lys(2ClZ)—OH then Boc-L30-OH. The resin was Fmoc deprotected and reacted twice (2×2 h) with caproylamido biotin NHS ester (25 mg in 0.5 mL NMP+25 microL DIPEA). The resin was washed with TFA and the product cleaved off with TFA:TFMSA:mCresol:thioanisol (6:2:1:1), 1 mL, precipitated with diethyl ether and purified by RP-HPLC. MS calculated for $C_{300}H_{544}N_{64}O_{137}S$ is 7272.009 Da, found 7271.19 Da.

Alternatively linker-biotin molecule was H-L60-Lys($NH_2$)-L60-Lys($NH_2$)-L60-Lys($NH_2$)L300Lys(caproylamidobiotin)-$NH_2$ and made from downloaded Boc-L300-Lys(Fmoc) resin (100 mg), and then prepared analogously to H-L30-Lys($NH_2$)-L30-Lys($NH_2$)-L30-Lys($NH_2$)L300Lys(caproylamidobiotin)-$NH_2$. MS calculated for $C_{360}H_{652}N_{76}O_{167}S$ is 8749.5848 Da and was found to be 7271.19 Da. Yield 3 mg.

The trippel fluorescein-linker molecules was here betaalanin-L90-Lys(Flu)-L90-Lys(Flu)-L90-Lys(Flu)-$NH_2$ where Lys=Lysine, Flu=Fluorescein and L90 is a 90 atom linker (se FIG. 10 for further details). The trippel-fluorescein-linker molecule was generated as follows:

Downloaded Boc-Lys(Fmoc) resin, 2 g, was Boc deprotected and subjected to 3× coupling with Boc-L30-OH, Boc-Lys(Fmoc)-OH, 3×Boc-L30-OH, Boc-Lys(Fmoc)-OH, 3×Boc-L30-OH. The three Fmoc groups were removed and carboxyfluorescein, 301 mg, activated with HATU, 274 mg, and DIPEA, 139 µL, in 8 mL NMP, was added to the resin twice for 30 min. The resin was Boc deprotected and subjected to 2×30 min coupling with beta-alanine-N,N-diacetic acid benzyl ester, followed by 5 min treatment with 20% piperidine in NMP. The resin was washed with DCM, then TFA and the product was cleaved off the resin, precipitated with diethyl ether and purified by RP-HPLC. Yield was 621 mg. MS calculated for $C_{268}H_{402}N_{44}O_{116}$ is 6096.384 Da, while MS found was 6096 Da.

Biotin-linker molecule were coupled together with 4 trippel fluorescein-linker molecules as follows: (500 nmol) was dissolved in 88 microliter NMP+2 µl pyridine and activated for 10 min at room temperature (conversion to cyclic anhydride) by addition of 10 µl N,N' diisopropylcarbodiimide. Following activation the trippel fluorescein-linker was precipitated with diethyl ether and redissolved in 100 microliter NMP containing 10 nmol biotin-linker Once dissolved the coupling was initiated by addition of 5 µl diisopropyl ethyl amine, and was complete after 30 min.

Streptavidin and Fluorescein-linker molecules are then mixed in a molar ration of 1:1 and incubated for ½ hour. Then MHC complexes are added in 3-fold molar excess in respect to streptavidin and incubated for another ½ hour. Alternatively, MHC complexes are added first, then Fluorescein-linker molecules or MHC complexes are mixed with Fluorescein-linker molecules before addition to Streptavidin.

These MHC multimers are then used to stain CMV specific T cells in a flow Cytometry experiment. 1×10$^6$ purified HPBMC from a donor with T cells specific for HLA-A*0201(NLVPMVATV) are incubated with 10 µl of each of the two HLA-A*0201(peptide)/Fluorescein constructs described above for 10 minutes in the dark at room temperature with a cell concentration of 2×10$^7$ cells/ml. 10 µl of mouse-anti-human CD8/PB (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are resuspended in 400-500 µl PBS; pH=7.2 and analyzed on a flowcytometer.

In the above described example the Fluorescein-linker is as shown in FIG. 10 but the linker molecule can be any linker molecule as described in patent application WO 2007/015168 A2 (Lohse (2007)) or alternatively chemical biotinylated fluorochrom can be used instead of Fluorescein-linker molecules. The MHC complexes described in this example is a MHC I molecule composed of HLA-A*0201 heavy chain, beta2microglobulin and NLVPMVATV peptide but can in principle be any MHC complex or MHC like molecule as described elsewhere herein.

Example 10

This is an example of how to make MHC multimers consisting of a streptavidin multimerization domain with 3 biotinylated MHC complexes attached to the biotin binding pockets of streptavidin and how to use such trimer MHC complexes to detect specific T cells by direct detection of individual cells in a flow cytometry experiment by addition of a biotinylated fluorophore molecule. In this example the fluorophore is Fluorescein linker molecules constructed as described elsewhere herein.

MHC complexes consisting of HLA-A*0201 heavy chain, beta2microglobulin and peptide are generated as described elsewhere. MHC complexes are incubated with streptavidin in a molar ratio of 3:1 for ½ hour.

These trimer MHC multimers are then used to stain CMV specific T cells in a flow Cytometry experiment. 1×10$^6$ purified HPBMC from a donor with T cells specific for HLA-A*0201(NLVPMVATV) are incubated with 10 µl HLA-A*0201(peptide) multimer construct for 10 minutes in the dark at room temperature with a cell concentration of 2×10$^7$ cells/ml. Then Fluorescein linker molecules (as described in Example 42) are added and incubation continued for 5 minutes. 10 µl mouse-anti-human CD8/PB antibody (clone DK25 from Dako) is added and the incubation continued for another 20 minutes at 4° C. in the dark. The samples are then washed by addition of 2 ml PBS; pH=7.2 followed by centrifugation for 5 minutes at 200×g and the supernatant removed. Cells are resuspended in 400-500 µl PBS; pH=7.2 and analyzed on a flowcytometer.

In this example the Fluorescein-linker is as shown in FIG. 10 but the linker molecule can be any linker molecule as described in Lohse, Jesper, (2007), WO 2007/015168 A2 or alternative chemically biotinylated fluorochrome may be used. The MHC complexes described in this example is a MHC I molecule composed of HLA-A*0201 heavy chain, beta2microglobulin and NLVPMVATV peptide but can in principle be any MHC complex or MHC like molecule as described elsewhere herein.

Example 11

This is an example of how to make MHC multimers where the multimerization domain is dextran and the MHC complexes are chemically conjugated to the dextran multimerization domain.

MHC complexes consisting of HLA-A*0201 heavy chain, beta2microglobulin and NLVPMVATV peptide or the negative control peptide GLAGDVSAV are generated as described elsewhere herein. Dextran with a molecular weight of 270 kDa is activated with divinylsulfone. Activated Dextran is then incubated with MHC and RPE in a 0.05 M NaCHO$_3$ buffer; pH=9.5 with a molar ratio between MHC and Dextran of 30-60 and a molar ratio between RPE and dextran of 3-7:1 The mixture is placed in a water bath at 30° C. for 16 hours. Excess fluorochrome, MHC and dextran are removed by FPLC using a sephacryl S-300 column.

These MHC/RPE dextramers are then used to stain CMV specific T cells in a flow Cytometry experiment. Briefly, 1×10$^6$ purified HPBMC from a donor with T cells specific for HLA-A*0201(NLVPMVATV) are incubated with 10 µl of each of the two HLA-A*0201(peptide)/RPE constructs described above for 10 minutes in the dark at room temperature with a cell concentration of 2×10$^7$ cells/ml. 10 µl mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 µl PBS; pH=7.2 and analyzed on a flow cytometer.

Example 12

This is an example of how to make MHC multimers where the multimerization domain is dextran and MHC complexes are MHC I molecules chemically conjugated to dextran multimerization domain and the dextran multimerization domain also have fluorochrome chemically coupled.

Human beta2microglobulin is coupled to dextran as follows. Dextran with a molecular weight of 270 kDa is activated with divinylsulfone. Activated dextran is incubated with human beta2microglobulin and RPE in a 0.05 M NaCHO$_3$ buffer; pH=9.5 with a molar ratio between beta2microglobulin and Dextran of 30-60 and a molar ratio between RPE and dextran of 3-7:1. The molar ratio of the final product is preferable 4-6 RPE and 15-24 beta2microglobulin per dextran. The mixture is placed in a water bath at 30° C. for 16 hours. Excess fluorochrome, beta2microglobulin and dextran are removed by FPLC using a sephacryl S-300 column. The beta2microglobulin-RPE-dextran construct is then refolded in vitro together with heavy chain and peptide using the following procedure. 200 ml refolding buffer (100 mM Tris, 400 mM L-arginin-HCL, 2 mM NaEDTA, 0.5 mM oxidized Gluthathione, 5 mM reduced Glutathione, pH 8.0) supplied with protease inhibitors PMSF, Pepstatin A and Leupeptin (to a final concentration of 1 mM, 1 mg/l and 1 mg/l, respectively) is made and cooled to 10° C. 12 mg NLVPMVATV peptide is dissolved in DMSO and added to the refolding buffer together with 20-30 mg beta2microglobulin-RPE-dex and 6 mg HLA-A*0201 heavy chain. Incubation at 10° C. for 4-8 hours, then 20-30 mg beta2microglobulin-RPE-dex and 6 mg HLA-A*0201 heavy chain is added and incubation continued for 4-8 hours. Another 20-30 mg beta2microglobulin-RPE-dex and 6 mg HLA-A*0201 heavy chain is added and incubation continued for 6-8 hours. The folding reaction is filtrated through a 0.2 µm filter to remove larger aggregates and then buffer exchanged into a buffer containing 20 mM Tris-HCl, 50 nM NaCl; pH=8.0 followed by concentration to 1-2 ml sample. Dextran-RPE-MHC complexes are then separated from excess heavy chain and peptide by size exclusion chromatography using a sephacryl S-300, S-400 or sephacryl S-500 column.

These MHC/RPE dextramers may be used to stain CMV specific T cells in a flow Cytometry experiment. Briefly, 1×10$^6$ purified HPBMC from a donor with T cells specific for HLA-A*0201(NLVPMVATV) are incubated with 10 µl of each of the two HLA-A*0201(peptide)/RPE constructs described above for 10 minutes in the dark at room temperature with a cell concentration of 2×10$^7$ cells/ml. 10 µl of mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 µl PBS; pH=7.2 and analyzed on a flowcytometer.

Example 13

The preparation of a Pentamer is described in e.g. (United States Patent application 20040209295). Briefly, the following steps lead to a fluorescent Pentamer reagent:

The following is a detailed example for cloning, expressing, and purifying a pentameric class I MHC complex, which comprises a chimeric fusion of .beta.2m with COMP. The chimeric .beta.2m-COMP protein is expressed in insoluble inclusion bodies in *E. coli* and subsequently assembled as pentameric .beta.2m-COMP in vitro. The pentameric class I MHC peptide complex is then formed in a second refolding reaction by combining beta.2m-COMP pentamers and the human MHC class I .alpha. molecule known as HLA-A*0201, in the presence of an appropriate synthetic binding peptide representing the T cell antigen. In this example, a well characterized antigen derived from Epstein-Barr virus BMLF1 protein, GLCTLVAML (a.a. 289-297) [SEQ ID NO: 1], is used. The resultant complex is labelled with a fluorescent entity and used as a staining reagent for detecting antigen-specific T cells from a mixed lymphocyte population, in a flow cytometry application.

The strategy involves the sequential cloning into pET-24c vector of .beta.2m, yielding a construct referred to as pET-BMC01, followed by the insertion of the oligomerisation domain of cartilage oligomeric matrix protein (COMP) with a biotin acceptor sequence (BP) for site-specific biotinylation with the biotin-protein ligase BirA, yielding a construct referred to as pETBMC02. Thirdly a polyglycine linker is cloned in between .beta.2m and COMP, yielding a construct referred to as pETBMC03, and finally, a serine-residue is removed by site-directed mutagenesis, which serine residue precedes the poly-glycine linker, to give the final .beta.2m-COMP/pET-24c construct, referred to as pET-BMC04 (see also FIG. 3). Removal of the serine residue is carried out to avoid steric hindrance when the .beta.2m molecule is associated with the MHC class I chain protein.

The extracellular portion of .beta.2m comprises of 99 amino acids (equivalent to Ile1-Met99 of the mature protein) encoded by 74 bp-370 by of the DNA sequence. This region of the .beta.2m sequence is amplified from a normal human lymphocyte cDNA library, by polymerase chain reaction (PCR)

beta.2m PCR product is purified from the above reaction mix using a QIAquick® PCR purification kit according to the manufacturer's instructions (Qiagen). 200 ng of purified PCR product and 1.mu.g pET-24c vector (Novagen) are each digested with BamH I (10 U) and Nde I (10 U) restriction enzymes (New England Biolabs, NEB) for 4 h at 37.degree. C., in accordance with the manufacturer's instructions, and purified.

The gel-purified insert and vector DNA are ligated at a 1:3 molar ratio (vector: insert, 50 ng: 7.5 ng) using T4 DNA ligase (5 U; Bioline), in T4 DNA ligase buffer (as supplied) for 16 hrs at 16.degree. C.

The ligation mixtures and appropriate controls are subsequently transformed into XL1-Blue strain competent *E. coli* cells, according to the manufacturer's instructions (Stratagene). Successful transformants are selected by plating the cells on Luria-Bertani (LB) agar plates containing 30 .mu.g/ml kanamycin, and incubating overnight at 37.degree. C.

A selection of single colonies from the bacterial transformation plates are screened by PCR with T7 promoter [SEQ ID NO: 4] (1 .mu.M) and T7 terminator [SEQ ID NO: 5] (1 .mu.M) primers (Sigma Genosys, see Appendix I for primer sequences), which are complementary to regions of the pET vector flanking the cloning site. Amplification is carried out using Taq DNA polymerase (1 U, Bioline) in Taq reaction buffer (as supplied), supplemented with 2 mM MgSO.sub.4 and 0.2 mM dNTPs, using 25 thermal-cycling reactions as detailed above. Successful transformants generated a DNA fragment of approximately 500 bp, ascertained by 1.5% agarose gel electrophoresis.

Bacterial transformants that generated the correct size of PCR products are inoculated into 6 ml of sterile LB-kanamycin medium and incubated overnight at 37.degree. C. with 200 rpm shaking. pETBMC01 plasmid DNA is recovered from the bacterial cultures using a QIAprep® Spin Mini-prep kit according to the manufacturer's instructions (Qiagen). The presence of the .beta.2m fragment in these plasmids is further verified by automated DNA sequencing.

The sequence of the oligomerisation domain of COMP is obtained from the Genbank database (accession #1705995) and a region encoding the coiled-coil domain (amino acids 21-85) is selected based on self-association experiments of COMP (Efinov et al., FEBS Letters 341:54-58 (1994)). A biotin acceptor sequence 'BP': SLNDIFEAQKIEWHE [SEQ ID NO: 6] is incorporated at the C terminus and an additional 14 amino acid linker, PQPQPKPQPKPEPET [SEQ ID NO:7] is included to provide a physical separation between the COMP oligomerising domain and BP.

The whole region is synthesized using the overlapping complementary oligonucleotides, and purified COMP-BP and 1 /.mu.g pETBMC01 vector are digested for 4 hrs at 37.degree. C. using Hind III (10 U) and Xho I (10 U) restriction enzymes (NEB), as described in Section 1.1. The digestion products are purified, ligated, transformed and PCR screened as in Section 1.1. Plasmids positive from the screen are purified and sequenced as described in Section 1.1.

The poly-glycine linker is synthesized by annealing overlapping oligonucleotides. Since the nucleotide sequence of the polyGlycine linker only incorporates the 5' overhang of the cut BamH I restriction site, and the 3' overhang of the cut Hind III nucleotide recognition motifs, there is no need to digest the annealed product to produce the complementary single-stranded overhangs suitable for subsequent ligation. The oligonucleotides are phosphorylated and annealed as described in Section 1.2.

pETBMC02 is digested with BamH I (10 U) and Hind III (10 U). Ligation of the annealed poly-glycine linker into pETBMC02 was as described previously (Section 1.1), assuming 96 fmoles of annealed oligonucleotide/.mu.l. The transformation and PCR-screening reactions are as described in Section 1.1, but in addition, the presence of an inserted linker is verified by a restriction enzyme digestion of the PCR screen product to ascertain the presence or absence of a Sal I restriction site. Successful transformants are not susceptible to Sal I digestion, given the removal of the site from the plasmid vector backbone. Purification of pETBMC03 and automated sequencing is as described in Section 1.1.

Analysis of X-ray crystallography models of MHC class I molecules reveal that the C terminus of .beta.2m closely abuts the .alpha.3 domain of the .alpha. chain. It is therefore desirable to achieve maximum flexibility at the start of the poly-glycine linker.

The extracellular portion of HLA-A*0201 .alpha. chain (EMBL M84379) comprises of 276 amino acids (equivalent to Gly1-Pro276 of the mature protein) encoded by bases 73-900 of the messenger RNA sequence. This region of the A*0201 sequence is amplified from a normal human lymphocyte cDNA library by PCR, using the primers A2S#1 [SEQ ID NO: 20] and A2S#2 [SEQ ID NO: 21] which incorporated NcoI and BamHI restriction sites respectively. The procedure for cloning the A*0201 insert into Nco I/BamH I-digested pET-11d vector (Novagen) is essentially as described for .beta.2m in Section 1.1.

An identical procedure is carried out to produce either .beta.2m-COMP or A*0201 .alpha. chain proteins. Plasmid DNA is transformed into an E. coli expression host strain in preparation for a large scale bacterial prep. Protein is produced as insoluble inclusion bodies within the bacterial cells, and is recovered by sonication. Purified inclusion bodies are solubilised in denaturing buffer and stored at −80.degree. C. until required.

Purified plasmid DNA is transformed into the BL21(DE3) pLysS E. coli strain, which carries a chromosomal copy of the T7 RNA polymerase required to drive protein expression from pET-based constructs. Transformations into BL21 (DE3)pLysS competent cells (Stratagene) are carried out with appropriate controls.

A single bacterial transformant colony is innoculated into 60 ml sterile LB medium, containing appropriate antibiotics for selection, and left to stand overnight in a warm room (.about.24.degree. C.) The resulting overnight culture is added to 6 liters of LB and grown at 37.degree. C. with shaking (.about.240 rpm), up to mid-log phase (OD-.sub.600=0.3-0.4). Protein expression is induced at this stage by addition of 1.0 ml of 1M IPTG to each flask. The cultures are left for a further 4 h at 37.degree. C. with shaking, after which the cells are harvested by centrifugation and the supernatant discarded.

The bacterial cell pellet is resuspended in ice-cold balanced salt solution and sonicated (XL series sonicator; Misonix Inc., USA) in a small glass beaker on ice in order to lyse the cells and release the protein inclusion bodies. Once the cells are completely lysed the inclusion bodies are spun down in 50 ml polycarbonate Oak Ridge centrifuge tubes in a Beckman high-speed centrifuge (J2 series) at 15,000 rpm for 10 min. The inclusion bodies are then washed three times in chilled Triton® wash This is followed by a final wash in detergent-free wash buffer.

The resultant purified protein preparation is solubilised in 20-50 ml of 8 M urea buffer, containing 50 mM MES, pH 6.5, 0.1 mM EDTA and 1 mM DTT, and left on an end-over-end rotator overnight at 4.degree. C. Insoluble particles are removed by centrifugation and the protein yield is determined using Bradford's protein assay reagent (Bio-Rad Laboratories) and by comparison with known standards. Urea-solubilised protein is dispensed in 10 mg aliquots and stored at −80.degree. C. for future use.

Assembly of .beta.2m-COMP from the urea-solubilised inclusion bodies is performed by diluting the protein into 20 mM CAPS buffer, pH 11.0, containing 0.2 M sodium chloride and 1 mM EDTA, to give a final protein concentration of 1.5 mg/ml. The protein is oxidised at room temperature by addition of oxidised and reduced glutathione to final concentrations of 20 mM and 2 mM, respectively. Following an overnight incubation, disulphide bond formation is analysed by non-reducing SDS-PAGE on 10% bis-tricine gels (Invitrogen).

The protein mixture is subsequently buffer exchanged into 20 mM Tris, pH 8.0, 50 mM sodium chloride ('S200 buffer'), and concentrated to a final volume of 4.5 ml, in preparation for enzymatic biotinylation with BirA (Affinity, Denver, Colo.). 0.5 ml of 10.times. BirA reaction buffer (as supplied) is added, and recombinant BirA enzyme at 10 /.mu.M final concentration, supplemented with 10 mM ATP, pH 7.0. A selection of protease inhibitors is also used to preserve the proteins: 0.2 mM PMSF, 2 /.mu.g/ml pepstatin and 2 /.mu.g/ml leupeptin. The reaction is left for 4 hours at room temperature.

Biotinylated .beta.2m-COMP is purified by size exclusion chromatography (SEC) on a Superdex®200 HR 26/60 column (Amersham Biosciences), running S200 buffer.

500 ml of refolding buffer is prepared as follows: 100 mM Tris, pH 8.0, 400 mM Larginine hydrochloride, 2 mM EDTA, 5 mM reduced glutathione and 0.5 mM oxidised glutathione, dissolved in deionised water and left stirring at 4.degree. C. 15 mg of lyophilised synthetic peptide GLCTL- VAML is dissolved in 0.5 ml dimethylsulfoxide and added to the refolding buffer whilst stirring. 50 mg of biotinylated pentameric .beta.2m-COMP and 30 mg of A*0201 .alpha. chain is added sequentially, injected through a 23 gauge hypodermic needle directly into the vigorously-stirred buffer, to ensure adequate dispersion. The refolding mixture is then left stirring gently for 16 hours at 4.degree. C.

The protein refolding mixture is subsequently concentrated from 500 ml to 20 ml using a MiniKros hollow fibre ultrafiltration cartridge (Spectrum Labs, Rancho Dominguez, Calif.) with a 30 kD molecular weight cutoff. Further concentration of the complex from 20 ml to 5 ml is carried out in Centricon Plus-20 centrifugal concentrators (30 kD molecular weight cut-off) according to the manufacturers instructions, followed by buffer exchange into S200 buffer using disposable PD10 desalting columns (Amersham Biosciences), according to the manufacturer's instructions. Final volume is 7.5 ml. The concentrated protein refold mixture is first purified by SEC on a Superdex® 200 HR 26/60 gel filtration chromatography column, as in Section 4.2. Fractions containing protein complexes in the region of 310 kD is collected.

Fractions collected from SEC are pooled and subjected to further purification by anion exchange chromatography on a MonoQ® HR 5/5 column (Amersham Biosciences), running a salt gradient from 0-0.5 M sodium chloride in 20 mM Tris over 15 column volumes. The dominant peak is collected. Protein recovery is determined using the Bradford assay.

Since each streptavidin molecule is able to bind up to 4 biotin entities, final labelling with phycoerythrin (PE)-conjugated streptavidin is carried out in a molar ratio of 1:0.8, streptavidin to biotinylated pentamer complex respectively, taking into account the initial biotinylation efficiency measurement made for .beta.2m-COMP in Section 4.2. The total required amount of pentamer complex is subdivided (e.g. into 5 equal amounts) and titrated successively into streptavidin-PE. The concentration of A*0201 pentamer-streptavidin complex is adjusted to 1 mg/ml with phosphate buffered saline (PBS), supplemented with 0.01% azide and 1% BSA.

This resultant fluorescent Pentamer reagent is stored at 4.degree. C.

Example 14. Prediction of MHC Class 1 BK Virus Peptide Binders

This example describes the total approach, applied to the BK virus genome. It thus involves the translation of the genome in both directions, i.e. in six possible reading frames.

Prediction of MHC class 1 BK virus peptide sequences for use in construction of MHC'mers designed to be used for analytical, diagnostic, prognostic, therapeutic and vaccine purposes, through the interaction of the MHC'mers with BK virus-specific T-cells. Prediction is carried out using the total approach. Thus, the 8-, 9-, 10- and 11-mer peptide sequences are generated from six amino acid sequences representing direct translation of the BK virus genome sequence in all six reading frames. The 8-, 9-, 10- and 11-mer peptide sequences are derived from the genome sequence by application of the software program described in (FIG. 2). The 8-, 9-, 10- and 11-mer peptide sequences are shown in table I.

Example 15. Prediction of MHC Class 2 BK Virus Peptide Binders

This example describes the total approach, applied to the BK virus genome. It thus involves the translation of the genome in both directions, i.e. in six possible reading frames.

Prediction of MHC class 2 BK virus peptide sequences for use in construction of MHC'mers designed to be used for analytical, diagnostic, prognostic, therapeutic and vaccine purposes, through the interaction of the MHC'mers with BK virus-specific T-cells. Prediction is carried out using the total approach. Thus, the 13-, 14-, 15- and 16-mer peptide sequences are generated from six amino acid sequences representing direct translation of the BK virus genome sequence in all six reading frames. The 13-, 14-, 15- and 16-mer peptide sequences are derived from the genome sequence by application of the software program described in (FIG. 2). The 13-, 14-, 15- and 16-mer peptide sequences are shown in table O.

Example 16. Prediction of MHC Class 1 Peptide Binders for BK Agnoprotein Using Directed Approach This example describes the directed approach, applied to a known protein sequence, the Agnoprotein encoded by the BK virus genome. The purpose is to predict BK virus peptide sequences that binds to MHC class 1 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table N. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 17. Prediction of MHC Class 1 Peptide Binders for BK Small t Protein Using Directed Approach This example describes the directed approach, applied to a known protein sequence, the small t protein encoded by the BK virus genome. The purpose is to predict BK virus peptide sequences that binds to MHC class 1 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table L. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 18. Prediction of MHC Class 1 Peptide Binders for BK Large T Protein Using Directed Approach This example describes the directed approach, applied to a known protein sequence, the Large T protein encoded by the BK virus genome. The purpose is to predict BK virus peptide sequences that binds to MHC class 1 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table M. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 19. Prediction of MHC Class 1 Peptide Binders for BK VP1 Protein Using Directed Approach This example describes the directed approach, applied to a known protein sequence, the VP1 protein encoded by the BK virus genome. The purpose is to predict BK virus peptide sequences that binds to MHC class 1 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table K. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 20. Prediction of MHC Class 1 Peptide Binders for BK VP2-3 Protein Using Directed Approach This example describes the directed approach, applied to a known protein sequence, the VP2-3 protein encoded by the human genome. The purpose is to predict BK virus peptide sequences that binds to MHC class 1 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table J. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 21. Prediction of MHC Class 1 Peptide Binders for Human Cancer Protein Bcl-2 Using Directed Approach This example describes the directed approach, applied to a known protein sequence, the cancer protein Bcl-2 encoded by the human genome. The purpose is to predict Bcl-2 peptide sequences that binds to MHC class 1 molecules for use in construction of MHC'mers designed to be used for analytical, diagnostic, prognostic, therapeutic and vaccine purposes, through the interaction of the MHC'mers with human Bcl-2 specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table C. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 22. Prediction of MHC Class 1 Peptide Binders for Human Cancer Protein BclX(L) Using Directed Approach This example describes the directed approach, applied to a known protein sequence, the cancer protein BclX(L) encoded by the human genome. The purpose is to predict BclX(L) peptide sequences that binds to MHC class 1 molecules for use in construction of MHC'mers designed to be used for analytical, diagnostic, prognostic, therapeutic and vaccine purposes, through the interaction of the MHC-'mers with human BclX(L) specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table B. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 23. Prediction of MHC Class 1 Human Cancer Protein Survivin Peptide Binders This example describes the prediction of MHC class 1 human Survivin peptide sequences for use in construction of MHC'mers designed to be used for analytical, diagnostic, prognostic, therapeutic and vaccine purposes, through the interaction of the MHC'mers with human Survivin specific T-cells. Prediction of the 8-, 9-, 10- and 11-mer peptide sequences are carried out using the peptide generation software program described in FIG. 2. The outcome is shown in table F.

Example 24. Prediction of MHC Class 2 Peptide Binders for BK Agnoprotein Using Directed Approach This example describes the directed approach, applied to a known protein sequence, the Agnoprotein encoded by the BK virus genome. The purpose is to predict BK virus peptide sequences that binds to MHC class 2 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 14 HLA class 2 alleles included in the www.cbs.dtu.dk/services/NetMHC/ database (FIG. 11).

The result of the prediction software is used to find all strong and weak 15-mer peptide binders of the 14 HLA class 2 alleles. It also finds the important central nonamer core peptide sequence of each binding peptide. The result can be seen in table T. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 25. Prediction of MHC Class 2 Peptide Binders for BK Small t Protein Using Directed Approach This example describes the directed approach, applied to a known protein sequence, the small t protein encoded by the BK virus genome. The purpose is to predict BK virus peptide sequences that binds to MHC class 2 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 14 HLA class 2 alleles included in the www.cbs.dtu.dk/services/NetMHC/ database (FIG. 11).

The result of the prediction software is used to find all strong and weak 15-mer peptide binders of the 14 HLA class 2 alleles. It also finds the important central nonamer core peptide sequence of each binding peptide. The result can be seen in table R. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 26. Prediction of MHC Class 2 Peptide Binders for BK Large T Protein Using Directed Approach This example describes the directed approach, applied to a known protein sequence, the Large T protein encoded by the BK virus genome. The purpose is to predict BK virus peptide sequences that binds to MHC class 2 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 14 HLA class 2 alleles included in the www.cbs.dtu.dk/services/NetMHC/ database (FIG. 11).

The result of the prediction software is used to find all strong and weak 15-mer peptide binders of the 14 HLA class 2 alleles. It also finds the important central nonamer core peptide sequence of each binding peptide. The result can be seen in table S. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 27. Prediction of MHC Class 2 Peptide Binders for BK VP1 Protein Using Directed Approach This example describes the directed approach, applied to a known protein sequence, the VP1 protein encoded by the BK virus genome. The purpose is to predict BK virus peptide sequences that binds to MHC class 2 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 14 HLA class 2 alleles included in the www.cbs.dtu.dk/services/NetMHC/ database (FIG. 11).

The result of the prediction software is used to find all strong and weak 15-mer peptide binders of the 14 HLA class 2 alleles. It also finds the important central nonamer core peptide sequence of each binding peptide. The result can be seen in table Q. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 28. Prediction of MHC Class 2 Peptide Binders for BK VP2-3 Protein Using Directed Approach This example describes the directed approach, applied to a known protein sequence, the VP1 protein encoded by the BK virus genome. The purpose is to predict BK virus peptide sequences that binds to MHC class 2 molecules for use in construction of MHC'mers designed to be used for analytical, diagnostic, prognostic, therapeutic and vaccine purposes, through the interaction of the MHC'mers with BK virus specific T-cells. Prediction is carried out using the known preferences of the 14 HLA class 2 alleles included in the www.cbs.dtu.dk/services/NetMHC/ database (FIG. 11).

The result of the prediction software is used to find all strong and weak 15-mer peptide binders of the 14 HLA class 2 alleles. It also finds the important central nonamer core peptide sequence of each binding peptide. The result can be seen in table P. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 29. Prediction of MHC Class 2 Human Cancer Protein Mcl-1 Peptide Binders This example describes the prediction of MHC class 2 human Mcl-1 peptide sequences for use in construction of MHC'mers designed to be used for analytical, diagnostic, prognostic, therapeutic and vaccine purposes, through the interaction of the MHC'mers with human Mcl-1 specific T-cells. Prediction of the 13-, 14-, 15- and 16-mer peptide sequences are carried out using the peptide generation software program described in FIG. 2. The outcome is shown in table G.

Example 30. Prediction of MHC Class 2 Peptide Binders for Human Cancer Protein Bcl-2 Using Directed Approach This example describes the directed approach, applied to a known protein sequence, the cancer protein Bcl-2 encoded by the human genome. The purpose is to predict Bcl-2 peptide sequences that binds to MHC class 2 molecules for use in construction of MHC'mers designed to be used for analytical, diagnostic, prognostic, therapeutic and vaccine purposes, through the interaction of the MHC'mers with human Bcl-2 specific T-cells. Prediction is carried out using the known preferences of the 14 HLA class 2 alleles included in the www.cbs.dtu.dk/services/NetMHCII/ database (FIG. 11).

The result of the prediction software is used to find all strong and weak 15-mer peptide binders of the 14 HLA class 2 alleles. It also finds the important central nonamer core peptide sequence of each binding peptide. The result can be seen in table E. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 31. Prediction of MHC Class 2 Peptide Binders for Human Cancer Protein BclX(L) Using Directed Approach This example describes the directed approach, applied to a known protein sequence, the cancer protein BclX(L) encoded by the human genome. The purpose is to predict BclX(L) peptide sequences that binds to MHC class 2 molecules for use in construction of MHC'mers designed to be used for analytical, diagnostic, prognostic, therapeutic and vaccine purposes, through the interaction of the MHC'mers with human BclX(L) specific T-cells. Prediction is carried out using the known preferences of the 14 HLA class 2 alleles included in the www.cbs.dtu.dk/services/NetMHCII/ database (FIG. 11).

The result of the prediction software is used to find all strong and weak 15-mer peptide binders of the 14 HLA class 2 alleles. It also finds the important central nonamer core peptide sequence of each binding peptide. The result can be seen in table D. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 32. Prediction of MHC Class 1 and 2 *Borrelia afzelii* OspC Peptide Binders This example describes the prediction of MHC class 1 and 2 *Borrelia afzelii* OspC peptide sequences for use in construction of MHC'mers designed to be used for analytical, diagnostic, prognostic, therapeutic and vaccine purposes, through the interaction of the MHC'mers with *Borrelia afzelii* OspC specific T-cells. Prediction of the 8-, 9-, 10-, 11-, 13-, 14-, 15- and 16-mer peptide sequences are carried out using the peptide generation software program described in FIG. 2. The outcome is shown in table U.

Example 33. Prediction of MHC Class 1 *Borrelia burgdorferi* OspA Peptide Binders This example describes the directed approach, applied to a known protein sequence, the *Borrelia burgdorferi* protein OspA encoded by the *Borrelia* genome. The purpose is to predict OspA peptide sequences that binds to MHC class 1 molecules for use in construction of MHC'mers designed to be used for analytical, diagnostic, prognostic, therapeutic and vaccine purposes, through the interaction of the MHC'mers with human OspA specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table V. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 34. Prediction of MHC Class 1 *Borrelia garinii* Flab Peptide Binders This example describes the directed approach, applied to a known protein sequence, the *Borrelia garinii* protein FlaB encoded by the *Borrelia* genome. The purpose is to predict FlaB peptide sequences that binds to MHC class 1 molecules for use in construction of MHC'mers designed to be used for analytical, diagnostic, prognostic, therapeutic and vaccine purposes, through the interaction of the MHC'mers with human FlaB specific T-cells. Prediction is carried out using the known preferences of the 42 HLA class 1 alleles included in the www.cbs.dtu.dk/services/NetMHC/ database (FIG. 11).

The result of the prediction software is used to find all strong and weak 8-, 9-, 10- and 11-mer peptide binders of the 42 HLA class 1 alleles. The result can be seen in table X. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 35. Prediction of MHC Class 1 and 2 *Mycobacterium tuberculosis* CFP10 Peptide Binders This example describes the prediction of MHC class 1 and 2 *Mycobacterium tuberculosis* CFP10 peptide sequences for use in construction of MHC'mers designed to be used for analytical, diagnostic, prognostic, therapeutic and vaccine purposes, through the interaction of the MHC'mers with *Mycobacterium tuberculosis* CFP10 specific T-cells. Prediction of the 8-, 9-, 10-, 11-, 13-, 14-, 15- and 16-mer peptide sequences are carried out using the peptide generation software program described in FIG. 2. The outcome is shown in table Y.

Example 36. Prediction of MHC Class 1 LCMV Gp1 Nonamer Peptide Binders for Mouse H-2Kd An Example of Non-Human MHC Peptide Binding Motifs.

This example describes the directed approach, applied to the known protein sequence of a mouse virus protein LCMV gp1 in context of mouse MHC class 1.

Prediction of LCMV gp1 peptide sequences that binds to the MHC class 1 molecule H-2Kd for use in construction of MHC'mers designed to be used for as analytical, diagnostic, prognostic, therapeutic and vaccine purposes, through the interaction of the MHC'mers with LCMV specific mouse T-cells. Prediction is carried out using the known preferences of the given H-2 molecules for peptide binding as laid down in the prediction program found on www.syfpeithi.de. The generated 9-mer peptides are ranked according to their binding efficiency to the individual HLA class 1 molecules. The output is shown in FIG. 2.

Example 37. Test of Predicted BclX(L) 10-mer Binding Peptide Functionality in Elispot In example 22 the best binding BclX(L) 10-mer peptide for HLA-A*0201 was identified to be YLNDHLEPWI (SEQ ID NO.: 46196). This peptide has then been tested in ELISPOT to see if it were able to detect the presence Bcl-X(L)-specific, CD8 positive T cells in PBL (Peripheral Blood Lymphocytes) from a breast cancer patient. PBL from a breast cancer patient was analyzed by ELISPOT ex vivo either with or without the Bcl-X(L)173-182 peptide (YLNDHLEPWI (SEQ ID NO.: 46196)), 106 PBL/well in doublets. The number of spots was counted using the Immunospot Series 2.0 Analyzer (CTL Analysers). The result is given as number of spots above the pictures of the result as shown in FIG. 15 and it clearly shows the presence of BclX(L) specific T-cells and thereby the functionality of the peptide as compared to the absence of added peptide.

Example 38. Test of Predicted BclX(L) 10-mer Binding Peptide Functionality in Flow Cytometry In example 22 the best binding BclX(L) 10-mer peptide for HLA-A*0201 was identified to be YLNDHLEPWI (SEQ ID NO.: 46196). In the present example the functionality of the peptide is shown in a flow cytometric analysis of PBL from the patient was analyzed ex vivo by Flow cytometry to identify Bcl-X(L)173-182 specific CD8 T cells using the dextramer complex HLA-A2/Bcl-X(L)173-182-APC, 7-AAD-PerCP, CD3-FITC, and CD8-APC-Cy7. The dextramer complex HLA-A2/HIV-1 pol476-484-APC was used as negative control. The result (FIG. 16) clearly demonstrate that a MHC Dextramer HLA-A*0201/YLNDHLEPWI (SEQ ID NO.: 46196) complex detects BclX(L) antigen specific CD-8 cells in the patient sample at a level of 0.03% as compared with the negative control using HIV specific MHC Dextramer.

Example 39. Use of BclX(L) Specific MHC Dextramer for Sorting of Antigen Specific CD8 T Cells from Patient Sample The antigen specific CD8 positive T-cells of example 38 were sorted out during the flow cytometric analysis using the MHC Dextramer HLA-A*0201/YLNDHLEPWI (SEQ ID NO.: 46196). The detectable population of dextramer positive CD8 T cells was sorted as single cells into 96 well plates using the following protocol:

Small lymphocytes were gated by forward and side scatter profile, before cloning according to CD8/MHC-multimer double staining. CD8/MHC-multimer double-positive cells were sorted as single cells into 96 well plates (Nunc) already containing $10^5$ cloning mix cells/well. The cloning mix was prepared containing $10^6$ irradiated (20 Gy) lymphocytes from three healthy donors per nil in X-vivo with 5% heat-inactivated human serum, 25 mM HEPES buffer (GibcoBRL), 1 μg/ml phytohemagglutinin (PHA) (Peprotech) and 120 U/ml IL-2. The cloning mix was incubated for two hours at 37° C./5% $CO_2$, prior to cloning. After cloning, the plates were incubated at 37° C./5% $CO_2$. Every 3-4 days 50 μL1 fresh media were added containing IL-2 to a final concentration of 120 U/ml. Following 10-14 days of incubation, growing clones were further expanded using cloning mix cells. Consequently, each of the growing clones were transferred (split) into two or three wells (depending on the number of growing cells) of a new 96 well plate containing $5\times10^4$ cloning mix cells/well. Clones that were not growing at this time were incubated for another week with IL-2, and then expanded. Subsequently, the specificity of the growing clones was tested in a $^{51}$Cr-release assay or by FACS.

Out of twenty-isolated dextramer positive CD8 T cells, ten were able to be expanded into T-cell clones.

Example 40. Demonstration of Specific Cytolytic Activity of Isolated BclX(L) Specific CD8 T-Cells The ten expanded T cell clones isolated by Flow sorting as shown in example 39 were tested for their specificity by analysis in a standard 51-Cr release assay. For this purpose, T2 cells loaded with either Bcl-X(L)173-182 peptide or an irrelevant peptide (BA4697-105, GLQHWVPEL) were used as target cells. Five CD8 T-cell clones (Clone 8, 9, 10, 11, and 12) effectively lysed T2 cells pulsed with Bcl-X(L)173-182 without killing of T2 cells pulsed with an irrelevant peptide (FIG. 17). One of these BclX(L)173-182 specific CD8 T-cell clones [Clone 9] were expanded for further analyses. The remaining five expanded clones (Clone 7, 13, 15, 17, and 18) did not show specific lysis against T2 cells pulsed with Bcl-X(L)173-182 peptide (FIG. 8).

Example 41. Demonstration of the Cytotoxic Capacity of a BclX(L)173-182 Specific CD8 T Cell Clone Isolated by Flow Aided Sorting of Antigen (HLA-A*0201/YLNDHLEPWI (SEQ ID NO.: 46196) Specific T Cells The Bcl-X(L)173-182 specific clone 9 was expanded for additional 2 weeks before the cytotoxic potential was examined further in 51Cr-release assays. Two assays were performed a Cell lysis of T2 cells pulsed with Bcl-X(L)173-182 peptide or an irrelevant peptide (BA4697-105, GLQHWVPEL) in three E:T ratios. b Cell lysis of T2 cells pulsed with different concentrations of Bcl-X(L)173-182 peptide at the E:T ratio 1:1 The result is given in FIG. 18. As can be seen

Example 42. Synthesis of a Comprehensive Library of Antigenic Peptides of Variable Size Derived from a Full-Length Antigen Sequence In this example it is described how virtually all of the possible 8'- to 20'-mer peptide epitopes of an antigen may be synthetically prepared by modification of the standard Fmoc peptide synthesis protocol.

N-☐-amino acids are incorporated into a peptide of the desired sequence with one end of the sequence remaining attached to a solid support matrix. All soluble reagents can be removed from the peptide-solid support matrix by filtration and washed away at the end of each coupling step. After each of the coupling steps, and after the removal of reagents, a fraction of the generated peptides are removed and recovered from the polymeric support by cleavage of the cleavable linker that links the growing peptide to solid support.

The solid support can be a synthetic polymer that bears reactive groups such as —OH. These groups are made so that they can react easily with the carboxyl group of an N-☐-protected amino acid, thereby covalently binding it to the polymer. The amino protecting group can then be removed and a second N-☐-protected amino acid can be coupled to the attached amino acid. These steps are repeated until the desired sequence is obtained. At the end of the synthesis, a different reagent is applied to cleave the bond between the C-terminal amino acid and the polymer support; the peptide then goes into solution and can be obtained from the solution.

Initially, the first Fmoc amino acid (starting at the C-terminal end of the antigen sequence) is coupled to a precursor molecule on an insoluble support resin via an acid labile linker. Deprotection of Fmoc is accomplished by treatment of the amino acid with a base, usually piperidine. Before coupling the next amino acid, a fraction of the synthesized peptide (for example 0.1%) is detached from the solid support, and recovered. Then additional beads carrying only the precursor molecule including the linker (for example corresponding to 0.1% of the total amount of solid support in the reaction) is added. Then the next Fmoc amino acid is coupled utilizing a pre-activated species or in situ activation.

This cycle of amino acid coupling, removal of reagents, detachment of a small fraction of synthesized peptide and recovery of these, and activation of the immobilized peptide to prepare for the next round of coupling, goes on until the entire antigen sequence has been processed.

The recovered peptides thus represent different fragments of the antigen, with varying lengths. The peptide pool thus contains most or all of the possible peptide epitopes of the antigen, and may be used in the preparation of MHC multimers as a pool.

The entire process, including the detachment of a fraction of the peptides after each round of coupling, follows standard Fmoc peptide synthesis protocols, and involves weak acids such as TFA or TMSBr, typical scavengers such as thiol compounds, phenol and water, and involves standard protecting groups.

Example 43

This is an example of how MHC multimers may be used for detection of cancer specific T cells in blood samples from patients.

In this example the MHC multimer used are MHC complexes coupled to fluorophor-labelled dextran (Dextramers). The dextramers are used for direct detection of TCR in flow Cytometry. The antigen origin is cancer, thus, immune monitoring of a cancer.

MHC multimers carrying cancer specific peptides is in this example used to detect the presence of cancer specific T cells in the blood from cancer patients.

Purified MHC-peptide complexes consisting of HLA-A*1101 heavy chain, human beta2microglobulin and peptide derived from a region in Survivin (Table F) or a negative control peptide were generated by in vitro refolding, purified and biotinylated as described elsewhere herein. Biotinylated MHC-peptide complexes were then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes were added in an amount corresponding to a ratio of three MHC-peptide molecules per SA molecule and each molecule dextran contains 3.7 SA molecule and 8.95 molecules APC. The final concentration of dextran was 3.8× 10e-8 M. The following MHC(peptide)/APC dextran constructs were made:
1. APC-SA conjugated 270 kDa dextran coupled with HLA-A*1101 in complex with beta2microglobulin and the peptide DLAQCFFCFK derived from Survivin.
2. APC-SA conjugated 270 kDa dextran coupled with HLA-A*1101 in complex with beta2microglobulin and the non-sense peptide.

The binding of the above described MHC(peptide)/APC dextran was used to determine the presence of Survivin specific T cells in the blood from cancer patients by flow cytometry following a standard flow cytometry protocol.

Blood from a cancer patient is isolated and 100 ul of this blood is incubated with 10 µl of the MHC(peptide)/APC dextran constructs described above for 10 minutes in the dark at room temperature. 5 µl of each of each of the antibodies mouse-anti-human CD3/PB (clone UCHT1 from Dako), and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the MHC(peptide)/APC dextran construct 1 described above and thereby the presence of Survivin specific T cells in the blood. Blood analysed with MHC (peptide)/APC dextran construct 2 show no staining of CD3 and CD8 positive cells with this MHC(peptide)/APC dextran construct.

The sensitivity of the above described test may be enhanced by addition of labeled antibodies specific for activation markers expressed in or on the surface of the Survivin specific T cells.

We conclude that the MHC(peptide)/APC dextran constructs can be used to detect the presence of Survivin specific T cells in the blood of cancer.

Example 44

This is an example of how MHC multimers may be used for detection of cancer specific T cells in blood samples from patients.

In this example the MHC multimer used are MHC complexes coupled to fluorophor-labelled multimerisation domain Streptavidin (SA, used for direct detection of TCR in flow Cytometry. The antigen origin is cancer, thus, immune monitoring of a cancer.

MHC multimers carrying cancer specific peptides is in this example used to detect the presence of cancer specific T cells in the blood from cancer patients.

Purified MHC-peptide complexes consisting of HLA-A*1101 heavy chain, human beta2microglobulin and peptide derived from a region in Survivin (Table F) or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:
3. APC-SA coupled with HLA-A*1101 in complex with beta2microglobulin and the peptide DLAQCFFCFK derived from Survivin.
4. APC-SA coupled with HLA-A*1101 in complex with beta2microglobulin and the non-sense peptide.

The binding of the above described MHC(peptide)/APC dextran can be used to determine the presence of Survivin specific T cells in the blood from cancer patients by flow cytometry following a standard flow cytometry protocol.

Blood from a cancer patient is isolated and 100 ul of this blood is incubated with either of the SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the SA-MHC(peptide)/APC tetramers 3 described above and thereby the presence of Survivin specific T cells in the blood. Blood analysed with SA-MHC (peptide)/APC tetramers 4 should show no staining of CD3 and CD8 positive cells with this SA-MHC(peptide)/APC tetramer.

The sensitivity of the above described test may be enhanced by addition of labeled antibodies specific for activation markers expressed in or on the surface of the Survivin specific T cells.

We conclude that the APC-SA coupled MHC(peptide) constructs may be used to detect the presence of Survivin specific T cells in the blood of cancer patients.

Example 45

This is an example of how MHC multimers may be used for detection of cancer specific T cells in blood samples from patients.

In this example the MHC multimer used are MHC complexes coupled to any fluorophor-labelled multimerisation as described elsewhere herein. The MHC multimers are used for direct detection of TCR in flow Cytometry. The antigen origin is cancer, thus, immune monitoring of a cancer.

MHC multimers carrying cancer specific peptides is in this example used to detect the presence of cancer specific T cells in the blood from cancer patients.

Purified MHC-peptide complexes consisting of HLA-A*1101 heavy chain, human beta2microglobulin and peptide derived a region in Survivin (Table F) or a negative control peptide were generated by in vitro refolding and purified or purified from antigen presenting cells. MHC-peptide complexes are then coupled to a multimerisation domain together with APC.

The following MHC(peptide)/APC multimers are made:
5. APC-multimerisation domain coupled with HLA-A*1101 in complex with beta2microglobulin and the peptide DLAQCFFCFK derived from Survivin.
6. APC-multimerisation domain coupled with HLA-A*1101 in complex with beta2microglobulin and the non-sense peptide.

The binding of the above described MHC(peptide)/APC multimers can be used to determine the presence of Survivin specific T cells in the blood from cancer patients by flow cytometry following a standard flow cytometry protocol.

Blood from a cancer patient is isolated and 100 ul of this blood is incubated with either of the MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the MHC(peptide)/APC multimers 5 described above and thereby the presence of Survivin specific T cells in the blood. Blood analysed with MHC(peptide)/APC multimer 6 should show no staining of CD3 and CD8 positive cells with this SA-MHC(peptide)/APC multimer.

The sensitivity of the above described test may be enhanced by addition of labeled antibodies specific for activation markers expressed in or on the surface of the Survivin specific T cells.

We conclude that the APC-multimerisation domain coupled MHC(peptide) constructs may be used to detect the presence of Survivin specific T cells in the blood of cancer patients.

Example 46

This is an example of how MHC multimers may be used for detection of Epstein-Barr Virus (EBV) specific T cells in blood samples from humans infected with EBV.

In this example the MHC multimer used are MHC complexes coupled to fluorophor-labelled dextran (Dextramers). The dextramers are used for direct detection of TCR in flow cytometry.

The antigen origin is EBV, thus, immune monitoring of EBV infection MHC multimers carrying EBV specific peptides is in this example used to detect the presence of EBV specific T cells in the blood of patients infected with Epstein-Barr virus.

Purified MHC-peptide complexes consisting of HLA-B*0702 heavy chain, human beta2microglobulin and peptide derived from a region in EBV nuclear antigen (EBNA) or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran is 3.8×10e-8 M. The following MHC(peptide)/APC dextran constructs are made:

7. APC-SA conjugated 270 kDa dextran coupled with HLA-B*0702 in complex with beta2microglobulin and the peptide RPPIFIRRL derived from EBNA 3A.
8. APC-SA conjugated 270 kDa dextran coupled with HLA-B*0702 in complex with beta2microglobulin and the peptide QPRAPIRPI derived from EBNA 6.
9. APC-SA conjugated 270 kDa dextran coupled with HLA-B*0702 in complex with beta2microglobulin and the HIV peptide TPGPGVRYPL.

The binding of the above described MHC(peptide)/APC dextran is used to determine the presence of EBV specific T cells in the blood from EBV infected individuals by flow cytometry following a standard flow cytometry protocol.

Blood from a patient with EBV infection is isolated and 100 ul of this blood is incubated with 10 µl of the MHC (peptide)/APC dextran constructs described above for 10 minutes in the dark at room temperature. 5 µl of each of each of the antibodies mouse-anti-human CD3/PB (clone UCHT1 from Dako), and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 300×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC dextran construct 1 or 2 described above and thereby the presence of EBV specific T cells indicate that the patient are infected with Epstein-Barr virus. Blood analysed with MHC(peptide)/APC dextran construct 3 show no staining of CD3 and CD8 positive cells with this MHC(peptide)/APC dextran construct.

The sensitivity of the above described test may be enhanced by addition of labeled antibodies specific for activation markers expressed in or on the surface of the EBV specific T cells.

We conclude that the MHC(peptide)/APC dextran constructs can be used to detect the presence of EBV specific T cells in the blood of patients infected with Epstein-Barr virus.

Example 47

This is an example of how MHC multimers may be used for detection of Epstein-Barr Virus (EBV) specific T cells in blood samples from humans infected with EBV.

In this example the MHC multimer used are MHC complexes coupled to fluorophor-labelled multimerisation domain Streptavidin (SA), used for direct detection of TCR in flow cytometry. The antigen origin is EBV, thus, immune monitoring of EBV infection MHC multimers carrying EBV specific peptides is in this example used to detect the presence of EBV specific T cells in the blood of patients infected with Epstein-Barr virus.

Purified MHC-peptide complexes consisting of HLA-B*0702 heavy chain, human beta2microglobulin and peptide derived from a region in EBV nuclear antigen (EBNA) or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

10. APC-SA coupled with HLA-B*0702 in complex with beta2microglobulin and the peptide RPPIFIRRL derived from EBNA 3A.
11. APC-SA coupled with HLA-B*0702 in complex with beta2microglobulin and the peptide QPRAPIRPI derived from EBNA 6.
12. APC-SA coupled with HLA-B*0702 in complex with beta2microglobulin and the HIV peptide TPGPGVRYPL.

The binding of the above described MHC(peptide)/APC dextran can be used to determine the presence of EBV specific T cells in the blood from Epstein-Barr virus infected individuals by flow cytometry following a standard flow cytometry protocol.

Blood from a patient with EBV is isolated and 100 ul of this blood is incubated with either of the SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the SA-MHC(peptide)/APC tetramers 4 or 5 described above and thereby the presence of EBV specific T cells will indicate that the patient are infected with Epstein-Barr virus. Blood analysed with SA-MHC(peptide)/APC tetramers 6 should show no staining of CD3 and CD8 positive cells with this SA-MHC(peptide)/APC tetramer.

The sensitivity of the above described test may be enhanced by addition of labeled antibodies specific for activation markers expressed in or on the surface of the EBV specific T cells.

We conclude that the APC-SA coupled MHC(peptide) constructs may be used to detect the presence of EBV specific T cells in the blood of patients infected with Epstein-Barr virus Example 48

This is an example of how MHC multimers may be used for detection of Epstein-Barr Virus (EBV) specific T cells in blood samples from humans infected with EBV.

In this example the MHC multimer used are MHC complexes coupled to any fluorophor-labelled multimerisation as described elsewhere herein. The MHC multimers are used for direct detection of TCR in flow cytometry. The antigen origin is EBV, thus, immune monitoring of EBV infection MHC multimers carrying EBV specific peptides is in this example used to detect the presence of EBV specific T cells in the blood of patients infected with Epstein-Barr virus.

Purified MHC-peptide complexes consisting of HLA-B*0702 heavy chain, human beta2microglobulin and peptide derived a region in EBV nuclear antigen (EBNA) or a negative control peptide were generated by in vitro refolding and purified or purified from antigen presenting cells. MHC-peptide complexes are then coupled to a multimerisation domain together with APC.

The following MHC(peptide)/APC multimers are made:
13. APC-multimerisation domain coupled with HLA-B*0702 in complex with beta2microglobulin and the peptide RPPIFIRRL derived from EBNA 3A.
14. APC-multimerisation domain coupled with HLA-B*0702 in complex with beta2microglobulin and the peptide QPRAPIRPI derived from EBNA 6.
15. APC-multimerisation domain coupled with HLA-A*0201 in complex with beta2microglobulin and the HIV peptide TPGPGVRYPL.

The binding of the above described MHC(peptide)/APC multimers can be used to determine the presence of EBV specific T cells in the blood from EBV infected individuals by flow cytometry following a standard flow cytometry protocol.

Blood from a patient with EBV infection is isolated and 100 ul of this blood is incubated with either of the MHC (peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC multimers 7 or 8 described above and thereby the presence of EBV specific T cells will indicate that the patient are infected with Epstein-Barr virus. Blood analysed with MHC(peptide)/APC multimer 9 should show no staining of CD3 and CD8 positive cells with this SA-MHC(peptide)/APC multimer.

The sensitivity of the above described test may be enhanced by addition of labeled antibodies specific for activation markers expressed in or on the surface of the EBV specific T cells.

We conclude that the APC-multimerisation domain coupled MHC(peptide) constructs may be used to detect the presence of EBV specific T cells in the blood of patients infected with Epstein-Barr virus.

Example 49

This is an example of how MHC multimers may be used for detection of influenza matrix peptide in blood samples from humans infected with influenza.

In this example the MHC multimer used are MHC complexes coupled to fluorophor-labelled dextran (Dextramers). The dextramers are used for direct detection of TCR in flow cytometry. The antigen origin is Influenza, thus, immune monitoring of influenza.

The MHC multimer used are MHC complexes coupled to labeled dextran.

MHC multimers carrying influenza specific peptides is in this example used to detect the presence of influenza specific T cells in the blood of patients infected with influenza virus.

Purified MHC-peptide complexes consisting of HLA-A*0201 heavy chain, human beta2microglobulin and peptide derived from a region in influenza matrix peptide (Flu-MP) or a negative control peptide were generated by in vitro refolding, purified and biotinylated as described elsewhere herein. Biotinylated MHC-peptide complexes were then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes were added in an amount corresponding to a ratio of three MHC-peptide molecules per SA molecule and each molecule dextran contains 3.7 SA molecule and 8.95 molecules APC. The final concentration of dextran was 3.8×10e-8 M. The following MHC(peptide)/APC dextran constructs were made:
16. APC-SA conjugated 270 kDa dextran coupled with HLA-A*0201 in complex with beta2microglobulin and the peptide GILGFVFTL derived from Flu-MP.
17. APC-SA conjugated 270 kDa dextran coupled with HLA-A*0201 in complex with beta2microglobulin and the non-sense peptide GLAGDVSAV.

The binding of the above described MHC(peptide)/APC dextran was used to determine the presence of influenza specific T cells in the blood from influenza infected individuals by flow cytometry following a standard flow cytometry protocol.

Blood from a influenza infected patient is isolated and 100 ul of this blood is incubated with 10 μl of the MHC(peptide)/APC dextran constructs described above for 10 minutes in the dark at room temperature. 5 μl of each of each of the antibodies mouse-anti-human CD3/PB (clone UCHT1 from Dako), and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and the MHC(peptide)/APC dextran construct 1 described above and thereby the presence of influenza specific T cells indicate that the patient are infected with influenza virus. Blood analysed with MHC(peptide)/APC dextran construct 2 show no staining of CD3 and CD8 positive cells with this MHC(peptide)/APC dextran construct.

The sensitivity of the above described test may be enhanced by addition of labeled antibodies specific for activation markers expressed in or on the surface of the influenza specific T cells.

We conclude that the MHC(peptide)/APC dextran constructs can be used to detect the presence of influenza specific T cells in the blood of patients infected with influenza virus.

Example 50

This is an example of how MHC multimers may be used for detection of influenza matrix peptide in blood samples from humans infected with influenza.

In this example the MHC multimer used are MHC complexes coupled to fluorophor-labelled multimerisation domain Streptavidin (SA), used for direct detection of TCR in flow cytometry. The antigen origin is Influenza, thus, immune monitoring of influenza.

The MHC multimer used are MHC complexes coupled to labeled dextran.

MHC multimers carrying influenza specific peptides is in this example used to detect the presence of influenza specific T cells in the blood of patients infected with influenza virus.

Purified MHC-peptide complexes consisting of HLA-A*0201 heavy chain, human beta2microglobulin and peptide derived from a region in influenza matrix peptide (Flu-MP) or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:
18. APC-SA coupled with HLA-A*0201 in complex with beta2microglobulin and the peptide GILGFVFTL derived from Flu-MP.
19. APC-SA coupled with HLA-A*0201 in complex with beta2microglobulin and the non-sense peptide GLAGDVSAV.

The binding of the above described MHC(peptide)/APC dextran can be used to determine the presence of influenza specific T cells in the blood from influenza infected individuals by flow cytometry following a standard flow cytometry protocol.

Blood from a cancer patient is isolated and 100 ul of this blood is incubated with either of the SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the SA-MHC(peptide)/APC tetramers 3 described above and thereby the presence of influenza specific T cells will indicate that the patient are infected with influenza virus. Blood analysed with SA-MHC(peptide)/APC tetramers 4 should show no staining of CD3 and CD8 positive cells with this SA-MHC(peptide)/APC tetramer.

The sensitivity of the above described test may be enhanced by addition of labeled antibodies specific for activation markers expressed in or on the surface of the influenza specific T cells.

We conclude that the APC-SA coupled MHC(peptide) constructs may be used to detect the presence of influenza specific T cells in the blood of patients infected with influenza virus.

Example 51

This is an example of how MHC multimers may be used for detection of influenza matrix peptide in blood samples from humans infected with influenza.

In this example the MHC multimer used are MHC complexes coupled to any fluorophor-labelled multimerisation as described elsewhere herein. The MHC multimers are used for direct detection of TCR in flow cytometry. The antigen origin is Influenza, thus, immune monitoring of influenza.

The MHC multimer used are MHC complexes coupled to labeled dextran.

MHC multimers carrying influenza specific peptides is in this example used to detect the presence of influenza specific T cells in the blood of patients infected with influenza virus.

Purified MHC-peptide complexes consisting of HLA-A*0201 heavy chain, human beta2microglobulin and peptide derived a region in influenza matrix peptide (Flu-MP) or a negative control peptide were generated by in vitro refolding and purified or purified from antigen presenting cells. MHC-peptide complexes are then coupled to a multimerisation domain together with APC.

The following MHC(peptide)/APC multimers are made:
20. APC-multimerisation domain coupled with HLA-A*0201 in complex with beta2microglobulin and the peptide GILGFVFTL derived from Flu-MP.
21. APC-multimerisation domain coupled with HLA-A*0201 in complex with beta2microglobulin and the non-sense peptide GLAGDVSAV.

The binding of the above described MHC(peptide)/APC multimers can be used to determine the presence of influenza specific T cells in the blood from influenza infected by flow cytometry following a standard flow cytometry protocol.

Blood from a influenza infected patient is isolated and 100 ul of this blood is incubated with either of the MHC (peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the MHC(peptide)/APC multimers 5 described above and thereby the presence of influenza specific T cells will indicate that the patient are infected with influenza virus. Blood analysed with MHC(peptide)/APC multimer 6 should show no staining of CD3 and CD8 positive cells with this SA-MHC(peptide)/APC multimer.

The sensitivity of the above described test may be enhanced by addition of labeled antibodies specific for activation markers expressed in or on the surface of the influenza specific T cells.

We conclude that the APC-multimerisation domain coupled MHC(peptide) constructs may be used to detect the presence of influenza specific T cells in the blood of patients infected with influenza virus.

Example 52

This is an example of how MHC multimers may be used for detection of Multiple sclerosis (MS) specific T cells in blood samples from MS patients.

In this example the MHC multimer used are MHC complexes coupled to fluorophor-labelled dextran (Dextramers). The dextramers are used for direct detection of TCR in flow Cytometry. The antigen origin is MS, thus, immune monitoring of MS.

MHC multimers carrying MS specific peptides is in this example used to detect the presence of MS specific T cells in the blood of MS patients.

Purified MHC-peptide complexes consisting of HLA-DR2 heavy chains and peptide derived from a region in Myelin Basic Protein (MBP) in MS or a negative control peptide are generated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran was 3.8×10e-8 M. The following MHC(peptide)/APC dextran constructs are made:

22. APC-SA conjugated 270 kDa dextran coupled with HLA-DR2 in complex with the peptide MBP 83-102 YDENPVVHFF KNIVTPRTPP derived from Multiple sclerosis.
23. APC-SA conjugated 270 kDa dextran coupled with HLA-DR2 in complex with the peptide MBP 144-163 VDAQGTLSKIFKLGGRDSRS derived from Multiple sclerosis.
24. APC-SA conjugated 270 kDa dextran coupled with HLA-DR2 in complex with a non-sense peptide.

The binding of the above described MHC(peptide)/APC dextran was used to determine the presence of MS specific T cells in the blood from MS patients by flow cytometry following a standard flow cytometry protocol.

Blood from a MS patient is isolated and 100 ul of this blood is incubated with 10 µl of the MHC(peptide)/APC dextran constructs described above for 10 minutes in the dark at room temperature. 5 µl of each of each of the antibodies mouse-anti-human CD3/PB (clone UCHT1 from Dako), and mouse-anti-human CD4/PE (clone MT310 from Dako) are added and the incubation continues for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD4/PE and either of the MHC(peptide)/APC dextran construct 1 or 2 described above and thereby the presence of MS specific T cells in the blood. Blood analysed with MHC (peptide)/APC dextran construct 3 show no staining of CD3 and CD4 positive cells with this MHC(peptide)/APC dextran construct.

The sensitivity of the above described test may be enhanced by addition of labeled antibodies specific for activation markers expressed in or on the surface of the MS specific T cells.

We conclude that the MHC(peptide)/APC dextran constructs can be used to detect the presence of MS specific T cells in the blood of MS patients.

Example 53

This is an example of how MHC multimers may be used for detection of Multiple sclerosis (MS) specific T cells in blood samples from MS patients.

In this example the MHC multimer used are MHC complexes coupled to fluorophor-labelled multimerisation domain Streptavidin (SA, used for direct detection of TCR in flow Cytometry. The antigen origin is MS, thus, immune monitoring of MS.

MHC multimers carrying MS specific peptides is in this example used to detect the presence of MS specific T cells in the blood of MS patients.

Purified MHC-peptide complexes consisting of HLA-DR2 heavy chains and peptide derived from a region in Myelin Basic Protein (MBP) in MS or a negative control peptide are generated as described elsewhere herein. Biotinylated MHC-peptide complexes are then coupled SA labelled with APC. MHC-peptide complexes are added in an amount corresponding to a ratio of 5 MHC-peptide molecules per SA molecule. Then SA/APC carrying four MHC complexes are purified from free SA, free monomeric MHC complex, SA carrying three, two and one MHC complexes.

The following SA-MHC(peptide)/APC tetramers are made:

25. APC-SA coupled with HLA-DR2 in complex with the peptide MBP 83-102 YDENPVVHFFKNIVTPRTPP derived from Multiple sclerosis.
26. APC-SA coupled with HLA-DR2 in complex with the peptide MBP 144-163 VDAQGTLSKIFKLGGRDSRS derived from Multiple sclerosis.
27. APC-SA coupled with HLA-DR2 in complex with a non-sense peptide.

The binding of the above described MHC(peptide)/APC dextran can be used to determine the presence of MS specific T cells in the blood from MS patients by flow cytometry following a standard flow cytometry protocol.

Blood from a MS patient is isolated and 100 ul of this blood is incubated with either of the SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD4/PE (clone MT310 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD4/PE and either of the SA-MHC(peptide)/APC tetramers 4 or 5 described above and thereby the presence of MS specific T cells in the blood. Blood analysed with SA-MHC (peptide)/APC tetramers 6 should show no staining of CD3 and CD4 positive cells with this SA-MHC(peptide)/APC tetramer.

The sensitivity of the above described test may be enhanced by addition of labeled antibodies specific for activation markers expressed in or on the surface of the MS specific T cells.

We conclude that the APC-SA coupled MHC(peptide) constructs may be used to detect the presence of MS specific T cells in the blood of MS patients.

Example 54

This is an example of how MHC multimers may be used for detection of Multiple sclerosis (MS) specific T cells in blood samples from MS patients.

In this example the MHC multimer used are MHC complexes coupled to any fluorophor-labelled multimerisation as described elsewhere herein. The MHC multimers are used for direct detection of TCR in flow Cytometry. The antigen origin is MS, thus, immune monitoring of MS.

MHC multimers carrying MS specific peptides is in this example used to detect the presence of MS specific T cells in the blood of MS patients.

Purified MHC-peptide complexes consisting of HLA-DR2 heavy chains and peptide derived from a region in Myelin Basic Protein (MBP) in MS or a negative control peptide are generated. MHC-peptide complexes are then coupled to a multimerisation domain together with APC.

The following MHC(peptide)/APC multimers are made:
28. APC-multimerisation domain coupled with HLA-DR2 in complex with the peptide MBP 83-102 YDENPVVHFFKNIVTPRTPP derived from Multiple sclerosis.
29. APC-multimerisation domain coupled with HLA-DR2 in complex with the peptide MBP 144-163 VDAQGTLSKIFKLGGRDSRS derived from Multiple sclerosis.
30. APC-multimerisation domain coupled with HLA-DR2 in complex with a non-sense peptide.

The binding of the above described MHC(peptide)/APC multimers can be used to determine the presence of MS specific T cells in the blood from MS patients by flow cytometry following a standard flow cytometry protocol.

Blood from a MS patient is isolated and 100 ul of this blood is incubated with either of the MHC(peptide)/APC multimers described above for 10 minutes in the dark at room temperature. 5 µl of each of each of the antibodies mouse-anti-human CD3/PB (clone UCHT1 from Dako) and mouse-anti-human CD4/PE (clone MT310 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD4/PE and either of the MHC(peptide)/APC multimers 7 or 8 described above and thereby the presence of MS specific T cells in the blood. Blood analysed with MHC(peptide)/APC multimer 9 should show no staining of CD3 and CD4 positive cells with this SA-MHC(peptide)/APC multimer.

The sensitivity of the above described test may be enhanced by addition of labeled antibodies specific for activation markers expressed in or on the surface of the MS specific T cells.

We conclude that the APC-multimerisation domain coupled MHC(peptide) constructs may be used to detect the presence of MS specific T cells in the blood of MS patients.

Example 55

This is an example of how MHC multimers may be used for detection of Rheumatoid arthritis (RA) specific T cells in blood samples from RA patients.

In this example the MHC multimer used are MHC complexes coupled to fluorophor-labelled dextran (Dextramers). The dextramers are used for direct detection of TCR in flow cytometry. The antigen origin is RA, thus, immune monitoring of RA.

MHC multimers carrying RA specific peptides is in this example used to detect the presence of RA specific T cells in the blood of MS patients.

Purified MHC-peptide complexes consisting of HLA-DR4 heavy chains and peptide derived from a region in Collagen Type II (CII) in RA or a negative control peptide are generated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran was 3.8× 10e-8 M. The following MHC(peptide)/APC dextran constructs are made:
31. APC-SA conjugated 270 kDa dextran coupled with HLA-DR4 in complex with the peptide CII 261-273 AGFKGEQGPKGEP derived from Rheumatoid arthritis
32. APC-SA conjugated 270 kDa dextran coupled with HLA-DR4 in complex with a non-sense peptide.

The binding of the above described MHC(peptide)/APC dextran was used to determine the presence of RA specific T cells in the blood from RA patients by flow cytometry following a standard flow cytometry protocol.

Blood from a RA patient is isolated and 100 ul of this blood is incubated with 10 µl of the MHC(peptide)/APC dextran constructs described above for 10 minutes in the dark at room temperature. 5 µl of each of each of the antibodies mouse-anti-human CD3/PB (clone UCHT1 from Dako), and mouse-anti-human CD4/PE (clone MT310 from Dako) are added and the incubation continues for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD4/PE and the MHC(peptide)/APC dextran construct 1 described above and thereby the presence of RA specific T cells in the blood. Blood analysed with MHC(peptide)/APC dextran construct 2 show no staining of CD3 and CD4 positive cells with this MHC(peptide)/APC dextran construct.

The sensitivity of the above described test may be enhanced by addition of labeled antibodies specific for activation markers expressed in or on the surface of the RA specific T cells.

We conclude that the MHC(peptide)/APC dextran constructs can be used to detect the presence of RA specific T cells in the blood of RA patients.

Example 56

This is an example of how MHC multimers may be used for detection of Rheumatoid arthritis (RA) specific T cells in blood samples from RA patients In this example the MHC multimer used are MHC complexes coupled to fluorophor-labelled multimerisation domain Streptavidin (SA), used for direct detection of TCR in flow cytometry. The antigen origin is RA, thus, immune monitoring of RA.

MHC multimers carrying RA specific peptides is in this example used to detect the presence of RA specific T cells in the blood of RA patients.

Purified MHC-peptide complexes consisting of HLA-DR4 heavy chains and peptide derived from a region in Collagen type II (CII) in RA or a negative control peptide are generated as described elsewhere herein. Biotinylated MHC-peptide complexes are then coupled SA labelled with APC. MHC-peptide complexes are added in an amount corresponding to a ratio of 5 MHC-peptide molecules per SA molecule. Then SA/APC carrying four MHC complexes are purified from free SA, free monomeric MHC complex, SA carrying three, two and one MHC complexes.

The following SA-MHC(peptide)/APC tetramers are made:

33. APC-SA coupled with HLA-DR4 in complex with the peptide CII 261-273 AGFKGEQGPKGEP derived from Rheumatoid arthritis.
34. APC-SA coupled with HLA-DR4 in complex with a non-sense peptide.

The binding of the above described MHC(peptide)/APC dextran can be used to determine the presence of RA specific T cells in the blood from RA patients by flow cytometry following a standard flow cytometry protocol.

Blood from a RA patient is isolated and 100 ul of this blood is incubated with either of the SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD4/PE (clone MT310 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD4/PE and the SA-MHC(peptide)/APC tetramers 3 described above and thereby the presence of RA specific T cells in the blood. Blood analysed with SA-MHC(peptide)/APC tetramers 4 should show no staining of CD3 and CD4 positive cells with this SA-MHC(peptide)/APC tetramer.

The sensitivity of the above described test may be enhanced by addition of labeled antibodies specific for activation markers expressed in or on the surface of the RA specific T cells.

We conclude that the APC-SA coupled MHC(peptide) constructs may be used to detect the presence of RA specific T cells in the blood of RA patients.

Example 57

This is an example of how MHC multimers may be used for detection of Rheumatoid arthritis (RA) specific T cells in blood samples from RA patients.

In this example the MHC multimer used are MHC complexes coupled to any fluorophor-labelled multimerisation as described elsewhere herein. The MHC multimers are used for direct detection of TCR in flow cytometry. The antigen origin is RA, thus, immune monitoring of RA. MHC multimers carrying RA specific peptides is in this example used to detect the presence of RA specific T cells in the blood of MS patients.

This is an example of how MHC multimers may be used for detection of Rheumatoid arthritis (RA) specific T cells in blood samples from RA patients. The MHC multimer used are MHC complexes coupled to MHC multimers carrying RA specific peptides is in this example used to detect the presence of RA specific T cells in the blood of RA patients.

Purified MHC-peptide complexes consisting of HLA-DR4 heavy chains and peptide derived from a region in Myelin Basic Protein (MBP) in MS or a negative control peptide are generated. MHC-peptide complexes are then coupled to a multimerisation domain together with APC.

The following MHC(peptide)/APC multimers are made:

35. APC-multimerisation domain coupled with HLA-DR4 in complex with the peptide CII 261-273 AGFK-GEQGPKGEP derived from Rheumatoid arthritis.
36. APC-multimerisation domain coupled with HLA-DR4 in complex with a non-sense peptide.

The binding of the above described MHC(peptide)/APC multimers can be used to determine the presence of RA specific T cells in the blood from RA patients by flow cytometry following a standard flow cytometry protocol.

Blood from a RA patient is isolated and 100 ul of this blood is incubated with either of the MHC(peptide)/APC multimers described above for 10 minutes in the dark at room temperature. 5 µl of each of each of the antibodies mouse-anti-human CD3/PB (clone UCHT1 from Dako) and mouse-anti-human CD4/PE (clone MT310 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD4/PE and the MHC(peptide)/APC multimers 5 described above and thereby the presence of RA specific T cells in the blood. Blood analysed with MHC(peptide)/APC multimer 6 should show no staining of CD3 and CD4 positive cells with this SA-MHC(peptide)/APC multimers.

The sensitivity of the above described test may be enhanced by addition of labeled antibodies specific for activation markers expressed in or on the surface of the RA specific T cells.

We conclude that the APC-multimerisation domain coupled MHC(peptide) constructs may be used to detect the presence of RA specific T cells in the blood of RA patients.

Example 58

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled dextran (Dextramers). The dextramers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-A*0201 heavy chain, human beta2microglobulin and peptide derived from regions in *Mycobacterium tuberculosis* Antigen 85B (Ag85B) or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contained 3.7 SA molecule and 8.95 molecules APC. The final concentration of dextran was 3.8×10e-8 M. The following MHC(peptide)/APC dextran constructs are made:

37. APC-SA conjugated 270 kDa dextran coupled with HLA-A*0201 in complex with beta2microglobulin and the peptide KLVANNTRL derived from Ag85B.
38. APC-SA conjugated 270 kDa dextran coupled with HLA-A*0201 in complex with beta2microglobulin and the peptide YLLDGLRAQ derived from Ag85B.
39. APC-SA conjugated 270 kDa dextran coupled with HLA-A*0201 in complex with beta2microglobulin and the peptide FLTSELPQW derived from Ag85B.
40. APC-SA conjugated 270 kDa dextran coupled with HLA-A*0201 in complex with beta2microglobulin and the non-sense peptide GLAGDVSAV.

The binding of the above described MHC(peptide)/APC dextran can be used to determine the presence of Ag85B specific T cells in the blood from TB infected individuals by flow cytometry following a standard flow cytometry protocol.

Blood from a patient with TB is isolated and 100 ul of this blood is incubated with 10 µl of one of the MHC(peptide)/APC dextran constructs described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC dextran constructs 1, 2 or 3 described above and thereby the presence of TB specific T cells will indicate that the patient are infected with *Mycobacterium tuberculosis*. Blood analysed with MHC(peptide)/APC dextran construct 4 should show no staining of CD3 and CD8 positive cells with this MHC (peptide)/APC dextran construct.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 59

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled the multimerisation domain Streptavidin (SA), used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-A*0201 heavy chain, human beta2microglobulin and peptide derived from regions in *Mycobacterium tuberculosis* Antigen 85B (Ag85B) or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

41. APC-SA coupled with HLA-A*0201 in complex with beta2microglobulin and the peptide KLVANNTRL derived from Ag85B.
42. APC-SA coupled with HLA-A*0201 in complex with beta2microglobulin and the peptide YLLDGLRAQ derived from Ag85B.
43. APC-SA coupled with HLA-A*0201 in complex with beta2microglobulin and the peptide FLTSELPQW derived from Ag85B.
44. APC-SA coupled with HLA-A*0201 in complex with beta2microglobulin and the non-sense peptide GLAGDVSAV The binding of the above described MHC(peptide)/APC dextran can be used to determine the presence of Ag85B specific T cells in the blood from TB infected individuals by flow cytometry following a standard flow cytometry protocol.

Blood from a patient with TB is isolated and 100 ul of this blood is incubated with either of the four SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the SA-MHC(peptide)/APC tetramers 5, 6 or 7 described above and thereby the presence of TB specific T cells will indicate that the patient are infected with *Mycobacterium tuberculosis*. Blood analysed with SA-MHC (peptide)/APC tetramers 8 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 60

This is an example of how MHC multimers may be used for diagnosis of Tuberculosis (TB) in blood samples from humans infected with *Mycobacterium tuberculosis*.

In this example the MHC multimer used are MHC complexes coupled to any fluorophor-labelled multimerisation as described elsewhere herein. The MHC multimers are used for direct detection of TCR in flow cytometry. The antigen origin is TB, thus, immune monitoring of TB. TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

This is an example of how MHC multimers may be used for diagnosis of Tuberculosis (TB) in blood samples from humans infected with *Mycobacterium tuberculosis*. The MHC multimer used are MHC complexes coupled to TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-A*0201 heavy chain, human beta2microglobulin and peptide derived from regions in *Mycobacterium tuberculosis* Antigen 85B (Ag85B) or a negative control peptide are generated by in vitro refolding and purified or purified from antigen presenting cells. MHC-peptide complexes are then coupled to a multimerisation domain together with APC.

The following MHC(peptide)/APC multimers are made:
45. APC-multimerisation domain coupled with HLA-A*0201 in complex with beta2microglobulin and the peptide KLVANNTRL derived from Ag85B.
46. APC-multimerisation domain coupled with HLA-A*0201 in complex with beta2microglobulin and the peptide YLLDGLRAQ derived from Ag85B.
47. APC-multimerisation domain coupled with HLA-A*0201 in complex with beta2microglobulin and the peptide FLTSELPQW derived from Ag85B.
48. APC-multimerisation domain coupled with HLA-A*0201 in complex with beta2microglobulin and the non-sense peptide GLAGDVSAV The binding of the above described MHC(peptide)/APC multimers can be used to determine the presence of Ag85B specific T cells in the blood from TB infected individuals by flow cytometry following a standard flow cytometry protocol.

Blood from a patient with TB is isolated and 100 ul of this blood is incubated with either of the four MHC(peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC multimers 9, 10 or 11 described above and thereby the presence of TB specific T cells will indicate that the patient are infected with *Mycobacterium tuberculosis*. Blood analysed with MHC (peptide)/APC multimer 12 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 61

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled dextran (Dextramers). The dextramers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*0801 heavy chain, human beta2microglobulin and peptide derived from regions in *Mycobacterium tuberculosis* Antigen 85B (Ag85B) or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contained 3.7 SA molecule and 8.95 molecules APC. The final concentration of dextran was 3.8×10e-8 M. The following MHC(peptide)/APC dextran constructs are made:
49. APC-SA conjugated 270 kDa dextran coupled with HLA-B*0801 in complex with beta2microglobulin and the peptide MGRDIKVQF derived from Ag85B.
50. APC-SA conjugated 270 kDa dextran coupled with HLA-B*0801 in complex with beta2microglobulin and the peptide DIKVQFQSG derived from Ag85B.
51. APC-SA conjugated 270 kDa dextran coupled with HLA-B*0801 in complex with beta2microglobulin and the peptide ENFVRSSNL derived from Ag85B.
52. APC-SA conjugated 270 kDa dextran coupled with HLA-B*0801 in complex with beta2microglobulin and the non-sense peptide.

The binding of the above described MHC(peptide)/APC dextran can be used to determine the presence of Ag85B specific T cells in the blood from TB infected individuals by flow cytometry following a standard flow cytometry protocol.

Blood from a patient with TB is isolated and 100 ul of this blood is incubated with 10 µl of one of the MHC(peptide)/APC dextran constructs described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC dextran constructs 13, 14 or 15 described above and thereby the presence of TB specific T cells will indicate that the patient are infected with *Mycobacterium tuberculosis*. Blood analysed with MHC(peptide)/APC dextran construct 16 should show no staining of CD3 and CD8 positive cells with this MHC (peptide)/APC dextran construct.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 62

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled the multimerisation domain Streptavidin (SA), used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-A*0201 heavy chain, human beta2microglobulin and peptide derived from regions in *Mycobacterium tuberculosis* Antigen 85B (Ag85B) or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:
53. APC-SA coupled with HLA-B*0801 in complex with beta2microglobulin and the peptide MGRDIKVQF derived from Ag85B.
54. APC-SA coupled with HLA-B*0801 in complex with beta2microglobulin and the peptide DIKVQFQSG derived from Ag85B.
55. APC-SA coupled with HLA-B*0801 in complex with beta2microglobulin and the peptide ENFVRSSNL derived from Ag85B.
56. APC-SA coupled with HLA-B*0801 in complex with beta2microglobulin and the non-sense peptide.

The binding of the above described MHC(peptide)/APC dextran can be used to determine the presence of Ag85B specific T cells in the blood from TB infected individuals by flow cytometry following a standard flow cytometry protocol.

Blood from a patient with TB is isolated and 100 ul of this blood is incubated with either of the four SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the SA-MHC(peptide)/APC tetramers 17, 18 or 19 described above and thereby the presence of TB specific T cells will indicate that the patient are infected with *Mycobacterium tuberculosis*. Blood analysed with SA-MHC(peptide)/APC tetramers 20 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 63

This is an example of how MHC multimers may be used for diagnosis of Tuberculosis (TB) in blood samples from humans infected with *Mycobacterium tuberculosis*.

In this example the MHC multimer used are MHC complexes coupled to any fluorophor-labelled multimerisation as described elsewhere herein. The MHC multimers are used for direct detection of TCR in flow cytometry. The antigen origin is TB, thus, immune monitoring of TB. TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*0801 heavy chain, human beta2microglobulin and peptide derived from regions in *Mycobacterium tuberculosis* Antigen 85B (Ag85B) or a negative control peptide are generated by in vitro refolding and purified or purified from antigen presenting cells. MHC-peptide complexes are then coupled to a multimerisation domain together with APC.

The following MHC(peptide)/APC multimers are made:

57. APC-multimerisation domain coupled with HLA-B*0801 in complex with beta2microglobulin and the peptide MGRDIKVQF derived from Ag85B.
58. APC-multimerisation domain coupled with HLA-B*0801 in complex with beta2microglobulin and the peptide DIKVQFQSG derived from Ag85B.
59. APC-multimerisation domain coupled with HLA-B*0801 in complex with beta2microglobulin and the peptide ENFVRSSNL derived from Ag85B.
60. APC-multimerisation domain coupled with HLA-B*0801 in complex with beta2microglobulin and the non-sense peptide.

The binding of the above described MHC(peptide)/APC multimers can be used to determine the presence of Ag85B specific T cells in the blood from TB infected individuals by flow cytometry following a standard flow cytometry protocol.

Blood from a patient with TB is isolated and 100 ul of this blood is incubated with either of the four MHC(peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC multimers 21, 22 or 23 described above and thereby the presence of TB specific T cells will indicate that the patient are infected with *Mycobacterium tuberculosis*. Blood analysed with MHC (peptide)/APC multimer 24 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 64

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled dextran (Dextramers). The dextramers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*44 heavy chain, human beta2microglobulin and peptide derived from regions in antigen Mtb39 or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contained 3.7 SA molecule and 8.95 molecules APC. The final concentration of dextran was 3.8×10e-8 M.

The following MHC(peptide)/APC dextran constructs are made:

61. APC-SA conjugated 270 kDa dextran coupled with HLA-B*44 in complex with beta2microglobulin and the peptide MWAQDAAAMF derived from Mtb39.
62. APC-SA conjugated 270 kDa dextran coupled with HLA-B*44 in complex with beta2microglobulin and the peptide AAERGPGQML derived from Mtb39.
63. APC-SA conjugated 270 kDa dextran coupled with HLA-B*44 in complex with beta2microglobulin and the non-sense peptide.

The binding of the above described MHC(peptide)/APC dextran can be used to determine the presence of Mtb39 specific T cells in the blood from TB infected individuals by flow cytometry following a standard flow cytometry protocol.

Blood from a patient with TB is isolated and 100 ul of this blood is incubated with 10 μl of one of the MHC(peptide)/APC dextran constructs described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC dextran constructs 25 or 26 described above and thereby the presence of TB specific T cells will indicate that the patient are infected with *Mycobacterium tuberculosis*. Blood analysed with MHC(peptide)/APC dextran construct 27 should show no staining of CD3 and CD8 positive cells with this MHC (peptide)/APC dextran construct.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 65

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled the multimerisation domain Streptavidin (SA), used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*44 heavy chain, human beta2microglobulin and peptide derived from regions in antigen Mtb39 or a negative control peptide are generated by in vitro refolding, purified and biotinylated as described elsewhere herein. Biotinylated MHC-peptide complexes are then coupled SA labelled with APC. MHC-peptide complexes are added in an amount corresponding to a ratio of 5 MHC-peptide molecules per SA molecule. Then SA/APC carrying four MHC complexes are purified from free SA, free monomeric MHC complex, SA carrying three, two and one MHC complexes.

The following SA-MHC(peptide)/APC tetramers are made:
64. APC-SA coupled with HLA-B*44 in complex with beta2microglobulin and the peptide MWAQDAAAMF derived from Ag85B.
65. APC-SA coupled with HLA-B*44 in complex with beta2microglobulin and the peptide AAERGPGQML derived from Ag85B.
66. APC-SA coupled with HLA-B*44 in complex with beta2microglobulin and the non-sense peptide.

The binding of the above described MHC(peptide)/APC dextran can be used to determine the presence of Mtb39 specific T cells in the blood from TB infected individuals by flow cytometry following a standard flow cytometry protocol.

Blood from a patient with TB is isolated and 100 ul of this blood is incubated with either of the four SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the SA-MHC(peptide)/APC tetramers 28 or 29 described above and thereby the presence of TB specific T cells will indicate that the patient are infected with *Mycobacterium tuberculosis*. Blood analysed with SA-MHC (peptide)/APC tetramers 30 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 66

This is an example of how MHC multimers may be used for diagnosis of Tuberculosis (TB) in blood samples from humans infected with *Mycobacterium tuberculosis*.

In this example the MHC multimer used are MHC complexes coupled to any fluorophor-labelled multimerisation as described elsewhere herein. The MHC multimers are used for direct detection of TCR in flow cytometry. The antigen origin is TB, thus, immune monitoring of TB. TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*44 heavy chain, human beta2microglobulin and peptide derived from regions in antigen Mtb39 or a negative control peptide are generated by in vitro refolding and purified or purified from antigen presenting cells. MHC-peptide complexes are then coupled to a multimerisation domain together with APC.

The following MHC(peptide)/APC multimers are made:
67. APC-multimerisation domain coupled with HLA-B*44 in complex with beta2microglobulin and the peptide MWAQDAAAMF derived from Mtb39.
68. APC-multimerisation domain coupled with HLA-B*44 in complex with beta2microglobulin and the peptide AAERGPGQML derived from Mtb39.
69. APC-multimerisation domain coupled with HLA-B*44 in complex with beta2microglobulin and the non-sense peptide.

The binding of the above described MHC(peptide)/APC multimers can be used to determine the presence of Mtb39 specific T cells in the blood from TB infected individuals by flow cytometry following a standard flow cytometry protocol.

Blood from a patient with TB is isolated and 100 ul of this blood is incubated with either of the four MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC multimers 31 or 32 described above and thereby the presence of TB specific T cells will indicate that the patient are infected with

*Mycobacterium tuberculosis*. Blood analysed with MHC (peptide)/APC multimer 33 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 67

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled dextran (Dextramers). The dextramers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*14 heavy chain, human beta2microglobulin and peptide derived from regions in culture filtrate protein 10 (CFP10) antigen (Table Y) or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contained 3.7 SA molecule and 8.95 molecules APC. The final concentration of dextran was 3.8×10e-8 M. The following MHC (peptide)/APC dextran constructs are made:
- 70. APC-SA conjugated 270 kDa dextran coupled with HLA-B*14 in complex with beta2microglobulin and the peptide RADEEQQQAL derived from CFP10.
- 71. APC-SA conjugated 270 kDa dextran coupled with HLA-B*14 in complex with beta2microglobulin and the non-sense peptide.

The binding of the above described MHC(peptide)/APC dextran can be used to determine the presence of CFP10 specific T cells in the blood from TB infected individuals by flow cytometry following a standard flow cytometry protocol.

Blood from a patient with TB is isolated and 100 ul of this blood is incubated with 10 µl of one of the MHC(peptide)/APC dextran constructs described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the MHC(peptide)/APC dextran constructs 34 described above and thereby the presence of TB specific T cells will indicate that the patient are infected with *Mycobacterium tuberculosis*. Blood analysed with MHC(peptide)/APC dextran construct 25 should show no staining of CD3 and CD8 positive cells with this MHC(peptide)/APC dextran construct.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 68

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled the multimerisation domain Streptavidin (SA), used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*14 heavy chain, human beta2microglobulin and peptide derived from regions in culture filtrate protein 10 (CFP10) antigen (Table Y) or a negative control peptide are generated by in vitro refolding, purified and biotinylated as described elsewhere herein. Biotinylated MHC-peptide complexes are then coupled SA labelled with APC. MHC-peptide complexes are added in an amount corresponding to a ratio of 5 MHC-peptide molecules per SA molecule. Then SA/APC carrying four MHC complexes are purified from free SA, free monomeric MHC complex, SA carrying three, two and one MHC complexes.

The following SA-MHC(peptide)/APC tetramers are made:
- 72. APC-SA coupled with HLA-B*14 in complex with beta2microglobulin and the peptide RADEEQQQAL derived from CFP10.
- 73. APC-SA coupled with HLA-B*44 in complex with beta2microglobulin and the non-sense peptide.

The binding of the above described MHC(peptide)/APC dextran can be used to determine the presence of CFP10 specific T cells in the blood from TB infected individuals by flow cytometry following a standard flow cytometry protocol.

Blood from a patient with TB is isolated and 100 ul of this blood is incubated with either of the four SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the SA-MHC(peptide)/APC tetramers 36 described above and thereby the presence of TB specific T cells will indicate that the patient are infected with *Mycobacterium tuberculosis*. Blood analysed with SA-MHC(peptide)/APC tetramers 37 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 69

This is an example of how MHC multimers may be used for diagnosis of Tuberculosis (TB) in blood samples from humans infected with *Mycobacterium tuberculosis*.

In this example the MHC multimer used are MHC complexes coupled to any fluorophor-labelled multimerisation as described elsewhere herein. The MHC multimers are used for direct detection of TCR in flow cytometry. The antigen origin is TB, thus, immune monitoring of TB. TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*14 heavy chain, human beta2microglobulin and peptide derived from regions in culture filtrate protein 10 (CFP10) antigen (Table Y) or a negative control peptide are generated by in vitro refolding and purified or purified from antigen presenting cells. MHC-peptide complexes are then coupled to a multimerisation domain together with APC.

The following MHC(peptide)/APC multimers are made:
74. APC-multimerisation domain coupled with HLA-B*14 in complex with beta2microglobulin and the peptide RADEEQQQAL derived from CFP10.
75. APC-multimerisation domain coupled with HLA-B*14 in complex with beta2microglobulin and the non-sense peptide.

The binding of the above described MHC(peptide)/APC multimers can be used to determine the presence of CFP10 specific T cells in the blood from TB infected individuals by flow cytometry following a standard flow cytometry protocol.

Blood from a patient with TB is isolated and 100 ul of this blood is incubated with either of the four MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the MHC(peptide)/APC multimers 38 described above and thereby the presence of TB specific T cells will indicate that the patient are infected with *Mycobacterium tuberculosis*. Blood analysed with MHC(peptide)/APC multimer 39 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 70

This is an example of how MHC multimers may be used for diagnosis of Lyme Disease in blood samples from humans infected with *Borrelia* bacteria.

In this example the MHC multimer used are MHC complexes coupled to fluorophor-labelled dextran (Dextramers). The dextramers are used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *borrelia* specific peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in Outer surface protein A (Table V) or Flagellin B (Table X) conserved among the three species *Borrelia Burgdorferi*, *Borrelia Garinii* and *Borrelia Afzelii* or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran is 3.8×10e-8 M. The following MHC(peptide)/APC dextran constructs are made:

76. APC-SA conjugated 270 kDa dextran coupled with HLA-A*0201 in complex with beta2microglobulin and the peptide ALIACKQNV derived from OspA.
77. APC-SA conjugated 270 kDa dextran coupled with HLA-A*0201 in complex with beta2microglobulin and the peptide FTKEDTIT derived from OspA.
78. APC-SA conjugated 270 kDa dextran coupled with HLA-A*0201 in complex with beta2microglobulin and the peptide SIQIEIEQL derived from Fla B
79. APC-SA conjugated 270 kDa dextran coupled with HLA-A*0201 in complex with beta2microglobulin and the peptide NLNEVEKVL derived from Fla B
80. APC-SA conjugated 270 kDa dextran coupled with HLA-A*0201 in complex with beta2microglobulin and the peptide SLAKIENAI derived from Fla B
81. APC-SA conjugated 270 kDa dextran coupled with HLA-A*0201 in complex with beta2microglobulin and the non-sense peptide GLAGDVSAV The binding of the above described MHC(peptide)/APC dextran is used to determine the presence of Osp A or Fla B specific T cells in the blood from *Borrelia* infected individuals by flow cytometry following a standard flow cytometry protocol.

Blood from a patient with Lyme disease is isolated and 100 ul of this blood is incubated with 10 μl of each of the MHC(peptide)/APC dextran constructs described above for 10 minutes in the dark at room temperature. 5 μl of each of each of the antibodies mouse-anti-human CD3/PB (clone UCHT1 from Dako), mouse-anti-human CD4/FITC (clone MT310 from Dako) and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 300×g and the supernatant removed. The washing step is repeated twice. The washed cells are resuspended in 400-500 μl PBS+1% BSA; pH=7.2 and analyzed on flowcytometer.

The presence of cells labeled with anti-CD3/PB, anti-CD8/PE and the MHC(peptide)/APC dextran constructs 1, 2, 3, 4 and 5 described above and thereby the presence of *Borrelia* specific T cells indicate that the patient are infected with *Borrelia* bacteria. Blood analysed with MHC(peptide)/APC dextran construct 6 show no staining of CD3 and CD8 positive cells with this MHC(peptide)/APC dextran construct.

The result is shown in FIG. 19.

The sensitivity of the above described diagnostic test may be enhanced by addition of labeled antibodies specific for activation markers expressed in or on the surface of the *Borrelia* specific T cells.

We conclude that the MHC(peptide)/APC dextran constructs can be used to detect the presence of *Borrelia* specific T cells in the blood of patients infected with *Borrelia*.

Example 71

This is an example of how MHC multimers may be used for diagnosis of Lyme Disease in blood samples from humans infected with *Borrelia* bacteria.

In this example the MHC multimer used are MHC complexes coupled to the fluorophor-labelled multimerisation domain Streptavidin (SA), used for direct detection of TCR in flow Cytometry. The antigen origin is *Borrelia*, thus, immune monitoring of a *Borrelia* infection. Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *borrelia* specific peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in Outer surface protein A (Table V) or Flagellin B (Table X) conserved among the three species *Borrelia Burgdorferi*, *Borrelia Garinii* and *Borrelia Afzelii* or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

82. APC-SA coupled with HLA-A*0201 in complex with beta2microglobulin and the peptide ALIACKQNV derived from OspA.
83. APC-SA coupled with HLA-A*0201 in complex with beta2microglobulin and the peptide FTKEDTIT derived from OspA.
84. APC-SA coupled with HLA-A*0201 in complex with beta2microglobulin and the peptide SIQIEIEQL derived from Fla B.
85. APC-SA coupled with HLA-A*0201 in complex with beta2microglobulin and the peptide NLNEVEKVL derived from Fla B.
86. APC-SA coupled with HLA-A*0201 in complex with beta2microglobulin and the peptide SLAKIENAI derived from Fla B.
87. APC-SA coupled with HLA-A*0201 in complex with beta2microglobulin and the non-sense peptide GLAGDVSAV The binding of the above described MHC(peptide)/APC dextran can be used to determine the presence of Osp A or Fla B specific T cells in the blood from *Borrelia* infected individuals by flow cytometry following a standard flow cytometry protocol.

Blood from a patient with Lyme disease is isolated and 100 ul of this blood is incubated with either of the four SA-MHC(peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the SA-MHC(peptide)/APC tetramers 7, 8, 9, 10 or 11 described above and thereby the presence of *Borrelia* specific T cells will indicate that the patient are infected with *Borrelia* bacteria. Blood analysed with SA- MHC(peptide)/APC tetramers 12 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the *Borrelia* specific T cells.

We conclude that the APC-SA coupled MHC(peptide) constructs may be used to detect the presence of *Borrelia* specific T cells in the blood of patients infected with *Borrelia*.

Example 72

This is an example of how MHC multimers may be used for diagnosis of Lyme Disease in blood samples from humans infected with *Borrelia* bacteria.

In this example the MHC multimer used are MHC complexes coupled to any fluorophor-labelled multimerisation as described elsewhere herein. The MHC multimers are used for direct detection of TCR in flow cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *borrelia* specific peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in Outer surface protein A (Table V) or Flagellin B (Table X) conserved among the three species *Borrelia Burgdorferi*, *Borrelia Garinii* and *Borrelia Afzelii* or a negative control peptide were generated by in vitro refolding and purified or purified from antigen presenting cells. MHC-peptide complexes are then coupled to a multimerisation domain together with APC.

The following MHC(peptide)/APC multimers are made:
88. APC-multimerisation domain coupled with HLA-A*0201 in complex with beta2microglobulin and the peptide ALIACKQNV derived from OspA.
89. APC-multimerisation domain coupled with HLA-A*0201 in complex with beta2microglobulin and the peptide FTKEDTIT derived from OspA.
90. APC-multimerisation domain coupled with HLA-A*0201 in complex with beta2microglobulin and the peptide SIQIEIEQL derived from Fla B.
91. APC-multimerisation domain coupled with HLA-A*0201 in complex with beta2microglobulin and the peptide NLNEVEKVL derived from Fla B.
92. APC-multimerisation domain coupled with HLA-A*0201 in complex with beta2microglobulin and the peptide SLAKIENAI derived from Fla B.
93. APC-multimerisation domain coupled with HLA-A*0201 in complex with beta2microglobulin and the non-sense peptide GLAGDVSAV The binding of the above described MHC(peptide)/APC multimers can be used to determine the presence of Osp A or Fla B specific T cells in the blood from *Borrelia* infected individuals by flow cytometry following a standard flow cytometry protocol.

Blood from a patient with Lyme disease is isolated and 100 ul of this blood is incubated with either of the four MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flow-cytometer.

The presence of cells labeled with anti-CD3/PB, anti-CD8/PE and either of the MHC(peptide)/APC multimers 13, 14, 15, 16 or 17 described above and thereby the presence of *Borrelia* specific T cells will indicate that the patient are infected with *Borrelia* bacteria.

Blood analysed with MHC(peptide)/APC multimer 18 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the *Borrelia* specific T cells.

We conclude that the APC-multimerisation domain coupled MHC(peptide) constructs may be used to detect the presence of *Borrelia* specific T cells in the blood of patients infected with *Borrelia*.

Example 73

This is an example of how MHC multimers may be used for diagnosis of Lyme Disease in blood samples from humans infected with *Borrelia* bacteria.

In this example the MHC multimer used are MHC complexes coupled to fluorophor-labelled dextran (Dextramers). The dextramers are used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *borrelia* specific peptides is in this example used to detect the presence of *Borrelia* specific T cells in the blood of patients infected with *Borrelia*.

Purified MHC-peptide complexes consisting of HLA-A*0301 heavy chain, human beta2microglobulin and peptide derived from regions in Outer surface protein C (Table U) conserved among the three species *Borrelia Burgdorferi*, *Borrelia Garinii* and *Borrelia Afzelii* or a negative control peptide were generated by in vitro refolding, purified and biotinylated as described elsewhere herein. Biotinylated MHC-peptide complexes were then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes were added in an amount corresponding to a ratio of three MHC-peptide molecules per SA molecule and each molecule dextran contained 3.7 SA molecule and 8.95 molecules APC. The final concentration of dextran was 3.8×10e-8 M. The following MHC(peptide)/APC dextran constructs were made:
94. APC-SA conjugated 270 kDa dextran coupled with HLA-A*0301 in complex with beta2microglobulin and the peptide TLITEKLSK derived from OspC.
95. APC-SA conjugated 270 kDa dextran coupled with HLA-A*0301 in complex with beta2microglobulin and the peptide ELANKAIGK derived from OspC.
96. APC-SA conjugated 270 kDa dextran coupled with HLA-A*0301 in complex with beta2microglobulin and the HIV peptide QVPLRPMTYK.

The binding of the above described MHC(peptide)/APC dextran can be used to determine the presence of Osp C specific T cells in the blood from *Borrelia* infected individuals by flow cytometry following a standard flow cytometry protocol.

Blood from a patient with Lyme disease is isolated and 100 ul of this blood is incubated with 10 μl of one of the MHC(peptide)/APC dextran constructs described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC dextran constructs 19 or 20 described above and thereby the presence of *Borrelia* specific T cells will indicate that the patient are infected with *Borrelia* bacteria. Blood analysed with MHC(peptide)/APC dextran construct 21 should show no staining of CD3 and CD8 positive cells with this MHC(peptide)/APC dextran construct.

The sensitivity of the above described diagnostic test may be enhanced by addition of labeled antibodies specific for activation markers expressed in or on the surface of the *Borrelia* specific T cells.

We conclude that the APC-SA conjugated 270 kDa dextran coupled MHC(peptide) constructs may be used to detect the presence of *Borrelia* specific T cells in the blood of patients infected with *Borrelia*.

Example 74

This is an example of how MHC multimers may be used for diagnosis of Lyme Disease in blood samples from humans infected with *Borrelia* bacteria.

In this example the MHC multimer used are MHC complexes coupled to the fluorophor-labelled multimerisation domain Streptavidin (SA), used for direct detection of TCR in flow Cytometry. The antigen origin is *Borrelia*, thus, immune monitoring of a *Borrelia* infection. Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *borrelia* specific peptides is in this example used to detect the presence of *Borrelia* specific T cells in the blood of patients infected with *Borrelia*.

Purified MHC-peptide complexes consisting of HLA-A*0301 heavy chain, human beta2microglobulin and peptide derived from regions in Outer surface protein C (Table U) conserved among the three species *Borrelia Burgdorferi*, *Borrelia Garinii* and *Borrelia Afzelii* or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:
97. APC-SA coupled with HLA-A*0301 in complex with beta2microglobulin and the peptide TLITEKLSK derived from OspC.
98. APC-SA coupled with HLA-A*0301 in complex with beta2microglobulin and the peptide ELANKAIGK derived from OspC.
99. APC-SA coupled with HLA-A*0201 in complex with beta2microglobulin and the HIV peptide QVPLRPMTYK.

The binding of the above described MHC(peptide)/APC dextran can be used to determine the presence of Osp C specific T cells in the blood from *Borrelia* infected individuals by flow cytometry following a standard flow cytometry protocol.

Blood from a patient with Lyme disease is isolated and 100 ul of this blood is incubated with either of the four SA-MHC(peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the SA-MHC(peptide)/APC tetramers 22 or 23 described above and thereby the presence of *Borrelia* specific T cells will indicate that the patient are infected with *Borrelia* bacteria. Blood analysed with SA-MHC(peptide)/APC tetramers 24 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the *Borrelia* specific T cells.

We conclude that the APC-SA coupled MHC(peptide) constructs may be used to detect the presence of *Borrelia* specific T cells in the blood of patients infected with *Borrelia*.

Example 75

This is an example of how MHC multimers may be used for diagnosis of Lyme Disease in blood samples from humans infected with *Borrelia* bacteria.

In this example the MHC multimer used are MHC complexes coupled to any fluorophor-labelled multimerisation as described elsewhere herein. The MHC multimers are used for direct detection of TCR in flow cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *borrelia* specific peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in Outer surface protein C (Table U) conserved among the three species *Borrelia Burgdorferi*, *Borrelia Garinii* and *Borrelia Afzelii* or a negative control peptide were generated by in vitro refolding and purified or purified from antigen presenting cells. MHC-peptide complexes are then coupled to a multimerisation domain together with APC.

The following MHC(peptide)/APC multimers are made:
100. APC-multimerisation domain coupled with HLA-A*0201 in complex with beta2microglobulin and the peptide TLITEKLSK derived from OspC.
101. APC-multimerisation domain coupled with HLA-A*0201 in complex with beta2microglobulin and the peptide ELANKAIG derived from OspC.
102. APC-multimerisation domain coupled with HLA-A*0201 in complex with beta2microglobulin and the HIV peptide QVPLRPMTYK.

The binding of the above described MHC(peptide)/APC multimers can be used to determine the presence of Osp C specific T cells in the blood from *Borrelia* infected individuals by flow cytometry following a standard flow cytometry protocol.

Blood from a patient with Lyme disease is isolated and 100 ul of this blood is incubated with either of the four MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC multimers 25 or 26 described above and thereby the presence of *Borrelia* specific T cells will indicate that the patient are infected with *Borrelia* bacteria. Blood analysed with MHC(peptide)/APC multimer 27 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the *Borrelia* specific T cells.

We conclude that the APC-multimerisation domain coupled MHC(peptide) constructs may be used to detect the presence of *Borrelia* specific T cells in the blood of patients infected with *Borrelia*.

Example 76

This is an example of how MHC multimers may be used for detection of Cytomegalovirus (CMV) specific T cells in blood samples from humans infected with CMV.

In this example the MHC multimer used are MHC complexes coupled to fluorophor-labelled dextran (Dextramers). The dextramers are used for direct detection of TCR in flow cytometry. The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*0201 heavy chain, human beta2microglobulin and peptide derived from a region in CMV internal matrix protein pp65 or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran is 3.8×10e-8 M. The following MHC(peptide)/APC dextran constructs are made:
103. APC-SA conjugated 270 kDa dextran coupled with HLA-A*0201 in complex with beta2microglobulin and the peptide NLVPMVATV derived from CMV pp65.
104. APC-SA conjugated 270 kDa dextran coupled with HLA-A*0201 in complex with beta2microglobulin and the non-sense peptide GLAGDVSAV The binding of the above described MHC(peptide)/APC dextran is used to determine the presence of CMV pp65 specific T cells in the blood from CMV infected individuals by flow cytometry following a standard flow cytometry protocol.

Blood from a patient with CMV infection is isolated and 100 ul of this blood is incubated with 10 µl of the MHC (peptide)/APC dextran constructs described above for 10 minutes in the dark at room temperature. 5 µl of each of each of the antibodies mouse-anti-human CD3/PB (clone UCHT1 from Dako), and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 300×g and the supernatant removed. The washing step is repeated twice. The washed cells are resuspended in 400-500 µl PBS+1% BSA; pH=7.2 and analyzed on flowcytometer. The presence of cells labeled with anti-CD3/PB, anti-CD8/PE and the MHC(peptide)/APC dextran construct 1 described above and thereby the presence of CMV specific T cells indicate that the patient are infected with Cytomegalovirus. Blood analysed with MHC (peptide)/APC dextran construct 2 show no staining of CD3 and CD8 positive cells with this MHC(peptide)/APC dextran construct. The result is shown I FIG. 20

The sensitivity of the above described test may be enhanced by addition of labeled antibodies specific for activation markers expressed in or on the surface of the CMV specific T cells.

We conclude that the MHC(peptide)/APC dextran constructs can be used to detect the presence of CMV specific T cells in the blood of patients infected with Cytomegalovirus.

Example 77

This is an example of how MHC multimers may be used for detection of Cytomegalovirus (CMV) specific T cells in blood samples from humans infected with CMV.

In this example the MHC multimer used are MHC complexes coupled to fluorophor-labelled multimerisation domain Streptavidin (SA), used for direct detection of TCR in flow cytometry. The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*0201 heavy chain, human beta2microglobulin and peptide derived from a region in CMV internal matrix protein pp65 or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:
- 105. APC-SA coupled with HLA-A*0201 in complex with beta2microglobulin and the peptide NLVPMVATV derived from CMV pp65.
- 106. APC-SA coupled with HLA-A*0201 in complex with beta2microglobulin and the non-sense peptide GLAGDVSAV The binding of the above described MHC(peptide)/APC dextran can be used to determine the presence of CMV pp65 specific T cells in the blood from Cytomegalovirus infected individuals by flow cytometry following a standard flow cytometry protocol.

Blood from a patient with CMV is isolated and 100 ul of this blood is incubated with either of the SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the SA-MHC(peptide)/APC tetramers 3 described above and thereby the presence of CMV specific T cells will indicate that the patient are infected with Cytomegalovirus. Blood analysed with SA-MHC(peptide)/APC tetramers 4 should show no staining of CD3 and CD8 positive cells with this SA-MHC(peptide)/APC tetramer.

The sensitivity of the above described test may be enhanced by addition of labeled antibodies specific for activation markers expressed in or on the surface of the CMV specific T cells.

We conclude that the APC-SA coupled MHC(peptide) constructs may be used to detect the presence of CMV specific T cells in the blood of patients infected with Cytomegalovirus.

Example 78

This is an example of how MHC multimers may be used for detection of Cytomegalovirus (CMV) specific T cells in blood samples from humans infected with CMV.

In this example the MHC multimer used are MHC complexes coupled to any fluorophor-labelled multimerisation as described elsewhere herein. The MHC multimers are used for direct detection of TCR in flow cytometry. The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*0201 heavy chain, human beta2microglobulin and peptide derived a region in CMV internal matrix protein pp65 or a negative control peptide were generated by in vitro refolding and purified or purified from antigen presenting cells. MHC-peptide complexes are then coupled to a multimerisation domain together with APC.

The following MHC(peptide)/APC multimers are made:
- 107. APC-multimerisation domain coupled with HLA-A*0201 in complex with beta2microglobulin and the peptide NLVPMVATV derived from CMV pp65.
- 108. APC-multimerisation domain coupled with HLA-A*0201 in complex with beta2microglobulin and the non-sense peptide GLAGDVSAV.

The binding of the above described MHC(peptide)/APC multimers can be used to determine the presence of CMV pp65 specific T cells in the blood from CMV infected individuals by flow cytometry following a standard flow cytometry protocol.

Blood from a patient with CMV infection is isolated and 100 ul of this blood is incubated with either of the MHC (peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and the MHC(peptide)/APC multimers 5 described above and thereby the presence of CMV specific T cells will indicate that the patient are infected with Cytomegalovirus. Blood analysed with MHC(peptide)/APC multimer 6 should show no staining of CD3 and CD8 positive cells with this SA-MHC(peptide)/APC multimer.

The sensitivity of the above described test may be enhanced by addition of labeled antibodies specific for activation markers expressed in or on the surface of the CMV specific T cells.

We conclude that the APC-multimerisation domain coupled MHC(peptide) constructs may be used to detect the presence of CMV specific T cells in the blood of patients infected with Cytomegalovirus.

Example 79

This is an example of how MHC multimers may be used for detection of Cytomegalovirus (CMV) specific T cells in blood samples from humans infected with CMV.

In this example the MHC multimer used are MHC complexes coupled to fluorophor-labelled dextran (Dextramers). The dextramers are used for direct detection of TCR in flow cytometry. The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*2402 heavy chain, human beta2microglobulin and peptide derived from a region in CMV internal matrix protein pp65 or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran is 3.8×10e-8 M. The following MHC(peptide)/APC dextran constructs are made:

109. APC-SA conjugated 270 kDa dextran coupled with HLA-A*2402 in complex with beta2microglobulin and the peptide QYDPVAALF derived from CMV pp65.
110. APC-SA conjugated 270 kDa dextran coupled with HLA-A*2402 in complex with beta2microglobulin and the peptide VYALPLKML derived from CMV pp65.
111. APC-SA conjugated 270 kDa dextran coupled with HLA-A*2402 in complex with beta2microglobulin and the non-sense peptide.

The binding of the above described MHC(peptide)/APC dextran is used to determine the presence of CMV pp65 specific T cells in the blood from CMV infected individuals by flow cytometry following a standard flow cytometry protocol.

Blood from a patient with CMV infection is isolated and 100 ul of this blood is incubated with 10 µl of the MHC (peptide)/APC dextran constructs described above for 10 minutes in the dark at room temperature. 5 µl of each of each of the antibodies mouse-anti-human CD3/PB (clone UCHT1 from Dako), and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 300×g and the supernatant removed. The washing step is repeated. The washed cells are resuspended in 400-500 µl PBS+1% BSA; pH=7.2 and analyzed on flowcytometer.

The presence of cells labeled with anti-CD3/PB, anti-CD8/PE and the MHC(peptide)/APC dextran constructs 7 or 8 described above and thereby the presence of CMV specific T cells indicate that the patient are infected with Cytomegalovirus. Blood analysed with MHC(peptide)/APC dextran construct 9 show no staining of CD3 and CD8 positive cells with this MHC(peptide)/APC dextran construct.

The sensitivity of the above described test may be enhanced by addition of labeled antibodies specific for activation markers expressed in or on the surface of the CMV specific T cells.

We conclude that the MHC(peptide)/APC dextran constructs can be used to detect the presence of CMV specific T cells in the blood of patients infected with Cytomegalovirus.

Example 80

This is an example of how MHC multimers may be used for detection of Cytomegalovirus (CMV) specific T cells in blood samples from humans infected with CMV.

In this example the MHC multimer used are MHC complexes coupled to fluorophor-labelled multimerisation domain Streptavidin (SA), used for direct detection of TCR in flow cytometry.

The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*2402 heavy chain, human beta2microglobulin and peptide derived from a region in CMV internal matrix protein pp65 or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

112. APC-SA coupled with HLA-A*2402 in complex with beta2microglobulin and the peptide QYDPVAALF derived from CMV pp65.
113. APC-SA coupled with HLA-A*2402 in complex with beta2microglobulin and the peptide VYALPLKML derived from CMV pp65.
114. APC-SA coupled with HLA-A*2402 in complex with beta2microglobulin and the non-sense peptide.

The binding of the above described MHC(peptide)/APC dextran can be used to determine the presence of CMV pp65 specific T cells in the blood from Cytomegalovirus infected individuals by flow cytometry following a standard flow cytometry protocol.

Blood from a patient with CMV is isolated and 100 ul of this blood is incubated with either of the SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the SA-MHC(peptide)/APC tetramers 10 or 11 described above and thereby the presence of CMV specific T cells will indicate that the patient are infected with Cytomegalovirus. Blood analysed with SA-MHC(peptide)/APC tetramers 12 should show no staining of CD3 and CD8 positive cells with this SA-MHC(peptide)/APC tetramer.

The sensitivity of the above described test may be enhanced by addition of labeled antibodies specific for activation markers expressed in or on the surface of the CMV specific T cells.

We conclude that the APC-SA coupled MHC(peptide) constructs may be used to detect the presence of CMV specific T cells in the blood of patients infected with Cytomegalovirus.

Example 81

This is an example of how MHC multimers may be used for detection of Cytomegalovirus (CMV) specific T cells in blood samples from humans infected with CMV.

In this example the MHC multimer used are MHC complexes coupled to any fluorophor-labelled multimerisation as described elsewhere herein. The MHC multimers are used for direct detection of TCR in flow cytometry. The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*2402 heavy chain, human beta2microglobulin and peptide derived a region in CMV internal matrix protein pp65 or a negative control peptide were generated by in vitro refolding and purified or purified from antigen presenting cells. MHC-peptide complexes are then coupled to a multimerisation domain together with APC.

The following MHC(peptide)/APC multimers are made:
115. APC-multimerisation domain coupled with HLA-A*2402 in complex with beta2microglobulin and the peptide QYDPVAALF derived from CMV pp65.
116. APC-multimerisation domain coupled with HLA-A*2402 in complex with beta2microglobulin and the peptide VYALPLKML derived from CMV pp65.
117. APC-multimerisation domain coupled with HLA-A*2402 in complex with beta2microglobulin and the non-sense peptide.

The binding of the above described MHC(peptide)/APC multimers can be used to determine the presence of CMV pp65 specific T cells in the blood from CMV infected individuals by flow cytometry following a standard flow cytometry protocol.

Blood from a patient with CMV infection is isolated and 100 ul of this blood is incubated with either of the MHC (peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC multimers 13 or 14 described above and thereby the presence of CMV specific T cells will indicate that the patient are infected with Cytomegalovirus. Blood analysed with MHC(peptide)/APC multimer 15 should show no staining of CD3 and CD8 positive cells with this SA-MHC(peptide)/APC multimer.

The sensitivity of the above described test may be enhanced by addition of labeled antibodies specific for activation markers expressed in or on the surface of the CMV specific T cells.

We conclude that the APC-multimerisation domain coupled MHC(peptide) constructs may be used to detect the presence of CMV specific T cells in the blood of patients infected with Cytomegalovirus.

Example 82

This is an example of measurement of antigen reactive T-Cells by IFN-γ capture in blood samples by ELISPOT.

This is an example of indirect detection of TCR, where individual cells are immobilized and measured by a chromogen assay.

The example provides a sensitive assay for the detection of T-cells reactive to an antigen by detecting a soluble factor whose secretion is induced by stimulation of the T-cell by the antigen.

A summary flow chart of the method is shown in FIG. 20. In brief, peripheral blood is diluted threefold in Dulbecco's phosphate buffered saline (DPBS), underlain with 15 ml of Ficoll (Pharmacia Ficoll-Paque #17-0840-02, Piscataway, N.J.) per 40 ml diluted blood in a 50 ml polypropylene centrifuge tube, and spun at 2000 RPM for 20 minutes in a Beckman CS-6R centrifuge (Beckman Inc., Palo Alto, Calif.). The buffy layer at the DPBS/Ficoll interface is removed, washed twice with DPBS and once with human tissue culture medium (hTCM: αMEM+5% heat inactivated human AB serum (Ultraserum, BioWhittaker, Walkersville, Md.), penicillin/streptomycin, 1-glutamine) at low RCF to remove platelets. Sixty percent of the PBMCs are resuspended in freezing medium (10% dimethyl sulfoxide (Sigma Chemical Co., St. Louis, Mo.), 90% fetal bovine serum to a concentration of $5 \times 10^6$ cells/ml, frozen in a programmable Cryo-Med (New Baltimore, Mich.) cell freezer, and stored under liquid nitrogen until needed.

The purified PBMCs are plated at $2 \times 10^5$ cells/well at a volume of 0.1 ml in 96 well Costar cell culture plates. An equal volume of antigen at 10 µg/ml is added to triplicate or sextuplet sets of wells and the plate is incubated in a 37° C., 5% $CO_2$ incubator. On day five, 10 µl/well of 100 U/ml stock recombinant IL-2 (Advanced Biotechnologies Inc., Columbia, Md.) is added to each well. On day 8, frozen PBMCs are thawed, washed in DPBS+0.5% bovine serum albumin (BSA) to remove DMSO, resuspended to a concentration of $4 \times 10^6$ cells/ml in hTCM, and γ-irradiated (3,000 RADS). Fifty microliters/well are dispensed along with 50 µl of the appropriate antigen at a stock concentration of 40 µl/ml to give a final antigen concentration of 10 µg/ml.

To prepare a capture plate, IFN-γ capture antibody (monoclonal mouse anti-human IFN-g, Endogen #M700A, Cambridge, Mass.) is diluted to 10 µg/ml in sterile 0.1 M $Na(CO_3)_2$ pH 8.2 buffer, aliquotted at 50 µl/well in flat bottomed 96 well sterile microtiter plates (Corning Costar Corp.), and incubated at 4° C. for a minimum of 24 hours. Prior to use, excess antibody is removed and wells are washed twice with dPBS+1% Tween 20 (PBST). To block further nonspecific protein binding, plates are incubated with 250 µl/well of PBS+5% BSA at room temperature for 1 hour. After discarding the blocking solution, wells are washed once with PBST (0.1% Tween), followed by hTCM in preparation for the antigen stimulated cells.

On day 9 of the assay, twenty four hours after the second antigen stimulation, the stimulation plate is spun for 5 minutes at 1500 RPM in a Beckman CS-6R centrifuge and 90 µl of supernatant is carefully removed from each well with a micropipette. The pelleted cells are resuspended in 100 µl of hTCM, pooled in sterile tubes (Corning Costar corp sterile ClusterTAb #4411, Cambridge, Mass.), mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 μl of a 1:500 dilution of rabbit anti-human IFN-γ polyclonal antibody (Endogen #P700, Cambridge, Mass.) in PBST+1% BSA is added to each well for 3.5 hours at room temperature with gentle rocking. Unbound anti-IFN-γ polyclonal antibody is removed by three washes with PBST, followed by a wash with 250 μl of 1×Tris-buffered saline+0.05% Tween 20 (TBST). Next, a 100 μl aliquot of 1:5000 alkaline phosphatase-conjugated mouse anti-rabbit polyclonal antibody (Jackson Immunological #211-055-109, West Grove, Pa.) diluted in TBST is added to each well and incubated at room temperature for 1.5-2 hours with gentle rocking. Excess enzyme-conjugated antibody is removed by three washes with PBST and two washes with alkaline phosphatase buffer (APB=0.1 M NaCl, 0.05 M MgCl.sub.2, 0.1 M Tris HCl, pH 9.5) followed by addition of the substrate mix of p-Toluidine salt and nitroblue tetrazolium chloride (BCIP/NBT, GIBCO BRL #18280-016, Gaithersburg, Md.). To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed by NIH image software. Captured images are enhanced using the Look Up Table which contrasts the images. Thresholding is then applied to every image and a wand tool is used to highlight the border to effectively subtract the edge of the well so that background counts won't be high and artificial. Density slicing over a narrow range is then used to highlight the spots produced from secreting cells. Pixel limits are set to subtract out small debris and large particles, and the number of spots falling within the prescribed pixel range are counted by the software program. Totals from each well are then manually recorded for future analysis. Alternatively, spots can be counted by other commercially available or customized software applications, or may be quantitated manually by a technician using standard light microscopy. Spots can also be counted manually under a light microscope.

We conclude that the protocol detailed above can be used for the enumeration of single IFN-γ secreting T cells.

Example 83

This is an example of measurement of antigen reactive T-Cells by IFN-γ capture in blood samples from Multiple Sclerosis (MS) patients by ELISPOT.

This is an example of indirect detection of TCR, where individual cells are immobilized and measured by a chromogen assay. The antigenic peptide origin is MS, thus, immune monitoring of MS.

The example provides a sensitive assay for the detection of T-cells reactive to the antigen Myelin Basic Protein (MBP), by detecting a soluble factor whose secretion is induced by stimulation of the T-cell by the antigen.

This example is similar to the experiment above. PBMCs from Multiple Sclerosis patients are isolated, prepared and stored as described in the example above.

The purified PBMCs are plated at $2\times10^5$ cells/well at a volume of 0.1 ml in 96 well Costar cell culture plates. An equal volume of antigen, MBP 83-102 (YDENPVVHFF KNIVTPRTPP) or 144-163 (VDAQGTLSKIFKLGGRD-SRS), at 10 μg/ml is added to triplicate or sextuplet sets of wells and the plate is incubated in a 37° C., 5% $CO_2$ incubator. On day five, 10 μl/well of 100 U/ml stock recombinant IL-2 is added to each well. On day 8, frozen PBMCs are thawed, washed in DPBS+0.5% BSA to remove DMSO, resuspended to a concentration of $4\times10^6$ cells/ml in hTCM, and γ-irradiated (3,000 RADS). 50 μl/well are dispensed along with 50 μl of the appropriate antigen at a stock concentration of 40 μl/ml to give a final antigen concentration of 10 μg/ml.

A capture plate with IFN-γ antibody is prepared, washed and blocked as described in the example above.

On day 9 of the assay, twenty four hours after the second antigen stimulation, the stimulation plate is spun for 5 minutes at 1500 RPM and 90 μl of supernatant is carefully removed from each well with a micropipette. The pelleted cells are resuspended in 100 μl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 μl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 μl of 1×Tris-buffered saline+0.05% Tween 20 (TBST). Next, a 100 μl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed as described in the example above We conclude that the experiment detailed above can be used for the enumeration of single IFN-γ secreting T cells in blood from Multiple Sclerosis patients.

Example 84

This is an example of measurement of antigen reactive T-Cells by IFN-γ capture in blood samples from Multiple Sclerosis (MS) patients by ELISPOT.

This is an example of indirect detection of TCR, where individual cells are immobilized and measured by a chromogen assay. Antigenic peptide origin is MS, thus, immune monitoring of MS.

The example provides a sensitive assay for the detection of T-cells reactive to the antigen Myelin Oligodendrocyte Glycoprotein (MOG), by detecting a soluble factor whose secretion is induced by stimulation of the T-cell by the antigen.

This example is similar to the experiment above PBMCs from Multiple Sclerosis patients are isolated, prepared and stored as described in the example above.

The purified PBMCs are plated at $2\times10^5$ cells/well at a volume of 0.1 ml in 96 well Costar cell culture plates. An equal volume of antigen, MOG 1-20 (GQFRVIGPRHPI- RALVGDEV) or 41-60 (RPPFSRVVHLYRNGKDQDGD), at 10 μg/ml is added to triplicate or sextuplet sets of wells and the plate is incubated in a 37° C., 5% $CO_2$ incubator. On day five, 10 μl/well of 100 U/ml stock recombinant IL-2 is added to each well. On day 8, frozen PBMCs are thawed, washed in DPBS+0.5% BSA to remove DMSO, resuspended to a concentration of $4 \times 10^6$ cells/ml in hTCM, and γ-irradiated (3,000 RADS). 50 μl/well are dispensed along with 50 μl of the appropriate antigen at a stock concentration of 40 μl/ml to give a final antigen concentration of 10 μg/ml.

A capture plate with IFN-γ antibody is prepared, washed and blocked as described in the example above.

On day 9 of the assay, twenty four hours after the second antigen stimulation, the stimulation plate is spun for 5 minutes at 1500 RPM and 90 μl of supernatant is carefully removed from each well with a micropipette. The pelleted cells are resuspended in 100 μl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 μl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 μl of 1×Tris-buffered saline+0.05% Tween 20 (TBST). Next, a 100 μl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed as described in the example above We conclude that the experiment detailed above can be used for the enumeration of single IFN-δ secreting T cells in blood from Multiple Sclerosis patients.

Example 85

This is an example of measurement of antigen reactive T-Cells by IFN-γ capture in blood samples from Rheumatoid Arthritis (RA) patients by ELISPOT.

This is an example of indirect detection of TCR, where individual cells are immobilized and measured by a chromogen assay. Antigenic peptide origin is RA, thus, immune monitoring of RA.

The example provides a sensitive assay for the detection of T-cells reactive to the antigen type II collagen (CII) 261-273, by detecting a soluble factor whose secretion is induced by stimulation of the T-cell by the antigen.

This example is similar to the experiment above. PBMCs from Rheumatoid Arthritis patients are isolated, prepared and stored as described in the example above.

The purified PBMCs are plated at $2 \times 10^5$ cells/well at a volume of 0.1 ml in 96 well Costar cell culture plates. An equal volume of antigen, CII 261-273 (AGFKGEQGPK-GEP), at 10 μg/ml is added to triplicate or sextuplet sets of wells and the plate is incubated in a 37° C., 5% $CO_2$ incubator. On day five, 10 μl/well of 100 U/ml stock recombinant IL-2 is added to each well. On day 8, frozen PBMCs are thawed, washed in DPBS+0.5% BSA to remove DMSO, resuspended to a concentration of $4 \times 10^6$ cells/ml in hTCM, and γ-irradiated (3,000 RADS). 50 μl/well are dispensed along with 50 μl of the appropriate antigen at a stock concentration of 40 μl/ml to give a final antigen concentration of 10 μg/ml.

A capture plate with IFN-γ antibody is prepared, washed and blocked as described in the example above.

On day 9 of the assay, twenty four hours after the second antigen stimulation, the stimulation plate is spun for 5 minutes at 1500 RPM and 90 μl of supernatant is carefully removed from each well with a micropipette. The pelleted cells are resuspended in 100 μl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 μl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 μl of 1×Tris-buffered saline+0.05% Tween 20 (TBST). Next, a 100 μl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed as described in the example above We conclude that the experiment detailed above can be used for the enumeration of single IFN-γ secreting T cells in blood from Rheumatoid Arthritis patients.'

Example 86

This is an example of measurement of antigen reactive T-Cells by IFN-γ capture in blood samples from Melanoma patients by ELISPOT.

This is an example of indirect detection of TCR, where individual cells are immobilized and measured by a chromogen assay. The antigenic peptide origin is Melanoma, thus, immune monitoring of cancer.

The example provides a sensitive assay for the detection of T-cells reactive to the antigen MELAN-A/MART-1 27-35, by detecting a soluble factor whose secretion is induced by stimulation of the T-cell by the antigen.

This example is similar to the experiment above. PBMCs from Melanoma patients are isolated, prepared and stored as described in the example above.

The purified PBMCs are plated at $2 \times 10^5$ cells/well at a volume of 0.1 ml in 96 well Costar cell culture plates. An equal volume of antigen, MELAN-A/MART-1 27-35 (AA- GIGILTV), at 10 µg/ml is added to triplicate or sextuplet sets of wells and the plate is incubated in a 37° C., 5% $CO_2$ incubator. On day five, 10 µl/well of 100 U/ml stock recombinant IL-2 is added to each well. On day 8, frozen PBMCs are thawed, washed in DPBS+0.5% BSA to remove DMSO, resuspended to a concentration of $4\times10^6$ cells/ml in hTCM, and γ-irradiated (3,000 RADS). 50 µl/well are dispensed along with 50 µl of the appropriate antigen at a stock concentration of 40 µl/ml to give a final antigen concentration of 10 µg/ml.

A capture plate with IFN-γ antibody is prepared, washed and blocked as described in the example above.

On day 9 of the assay, twenty four hours after the second antigen stimulation, the stimulation plate is spun for 5 minutes at 1500 RPM and 90 µl of supernatant is carefully removed from each well with a micropipette. The pelleted cells are resuspended in 100 µl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 µl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 µl of 1×Tris-buffered saline+0.05% Tween 20 (TBST). Next, a 100 µl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed as described in the example above We conclude that the experiment detailed above can be used for the enumeration of single IFN-γ secreting T cells in blood from Melanoma patients.

Example 87

This is an example of measurement of antigen reactive T-Cells by IFN-γ capture in blood samples by ELISPOT.

This is an example of indirect detection of TCR, where individual cells are immobilized and measured by a chromogen assay. The antigenic peptide origin is a library of antigens.

The example provides a sensitive assay for the detection of T-cells reactive to the antigen of a library generated as described in example 42, by detecting a soluble factor whose secretion is induced by stimulation of the T-cell by the antigen.

This example is similar to the experiment above. PMBC are isolated, prepared and stored as described in the example above.

The purified PBMCs are plated at $2\times10^5$ cells/well at a volume of 0.1 ml in 96 well Costar cell culture plates. An equal volume of antigens from the library, at 10 µg/ml is added to triplicate or sextuplet sets of wells and the plate is incubated in a 37° C., 5% $CO_2$ incubator. On day five, 10 µl/well of 100 U/ml stock recombinant IL-2 is added to each well. On day 8, frozen PBMCs are thawed, washed in DPBS+0.5% BSA to remove DMSO, resuspended to a concentration of $4\times10^6$ cells/ml in hTCM, and γ-irradiated (3,000 RADS). 50 µl/well are dispensed along with 50 µl of the appropriate antigen at a stock concentration of 40 µl/ml to give a final antigen concentration of 10 µg/ml.

A capture plate with IFN-γ antibody is prepared, washed and blocked as described in the example above.

On day 9 of the assay, twenty four hours after the second antigen stimulation, the stimulation plate is spun for 5 minutes at 1500 RPM and 90 µl of supernatant is carefully removed from each well with a micropipette. The pelleted cells are resuspended in 100 µl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 µl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 µl of 1×Tris-buffered saline+0.05% Tween 20 (TBST). Next, a 100 µl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed as described in the example above We conclude that the experiment detailed above can be used for the enumeration of single IFN-γ secreting T cells in blood.

Example 88

This is an example of how antigen specific T-cells can be detected using a direct detection method detecting T cell immobilized in solid tissue. In this example MHC dextramers are used to detect antigen specific T cells on frozen tissue sections using enzymatic chromogenic precipitation detection.

Equilibrate the cryosection tissue (e.g. section of spleen from transgenic mice) to −20° C. in the cryostate. Cut 5 µm sections and then dry sections on slides at room temperature. Store slides frozen until use at −20° C.

Equilibrate frozen sections to room temperature. Fix with acetone for 5 min.

Immediately after fixation transfer slides to TBS buffer (50 mM Tris-HCL pH 7.6, 150 mM NaCl) for 10 min.

Incubate slides with FITC-conjugated MHC-dextramers at appropriate dilution (1:40-1:80) and incubate for 30 min at room temperature. Other dilution ranges, as well as incubation time and temperature, may be desirable.

Decant solution and gently tap slides against filter paper, submerge in TBS buffer.

Decant and wash for 10 min in TBS buffer.

Incubate with rabbit polyclonal anti-FITC antibody (Dako P5100) at 1:100 dilution in TBS at room temperature for 30 min.

Repeat step 5 and 6.

Incubate with Envision anti-Rabbit HRP (Dako K4003) at room temperature for 30 min. Other visualization systems may be used.

Repeat step 5 and 6.

Develop with DAB+ (Dako K3468) in fume hood for 10 min. Other substrates may be used Rinse slides in tap-water for 5 min.

Counterstain with hematoxylin (Dako 53309) for 2 min.

Repeat step 12, mount slides.

The slides stained with MHC-Dextramers can now be evaluated by microscopy.

Example 89

This is an example of how antigen specific T-cells can be detected using a direct detection method detecting T cell immobilized in solid tissue. In this example MHC dextramers are used to detect antigen specific T cells on paraffin embedded tissue sections using enzymatic chromogenic precipitation detection.

Formaldehyde fixed paraffin-embedded tissue are cut in section and mounted on the glass slice, for subsequent IHC staining with MHC-dextramers. Tissue fixed and prepared according to other protocols may be used as well. E.g. fresh tissue, lightly fixed tissue section (e.g. tissue fixed in 2% formaldehyde) or formalin-fixed, paraffin-embedded tissue section.

Optimal staining may require target retrieval treatment with enzymes as well as heating in a suitable buffer before incubation with antibodies and MHC-dextramer.

The sample is stained for DNA using DAPI stain, followed by incubated with an antigen specific MHCdex/FITC reagent, followed by addition of anti-FITC antibody labeled with HRP. Then the substrate for HRP, "DAP" is added and the reaction allows to progress.

The sample is analyzed by light microscopy for the present of a colored precipitate on the cells (DAPI stained nucleus) positive for the specific MHC/dex reagent.

A digital image of the stained sample is obtained, and this can be analyzed manually in the same way as by microscopy. However, a digital image may be used for automatic determination of where and how many cells that are positive, related to the total amount of cells, determined by the DAPI staining, or other criteria or stainings.

Items

The present invention is further disclosed herein below by citation of the following, non-limiting items of the invention.

1. A MHC complex comprising one or more functional MHC molecule(s) capable of binding a peptide P,
wherein, when more than one MHC molecule is present, the MHC complex further comprises a multimerization domain preferably comprising at least one binding entity and/or a carrier,
wherein, when the multimerization domain is present, the more than one functional MHC molecules are attached either to the at least one binding entity and/or to the carrier, wherein, when the more than one functional MHC molecules are attached to the carrier, the MHC molecules are either attached directly to the carrier or attached to the carrier via one or more binding entities.

2. The MHC complex according to item 1, wherein the MHC molecule is a vertebrate MHC molecule such as a human, a murine, a rat, a porcine, a bovine or an avian molecule.

3. The MHC complex according to item 1 or 2, wherein the MHC molecule is a human MHC molecule.

4. The MHC complex according to any one of items 1-3, wherein the MHC molecule is a MHC Class I molecule selected from the group consisting of a heavy chain, a heavy chain combined with a $\beta_2$m, a heavy chain combined with a peptide, and a heavy chain/$\beta_2$m dimer with a peptide;
or a MHC Class II molecule selected from the group consisting of an $\alpha/\beta$ dimer, an $\alpha/\beta$ dimer with a peptide, $\alpha/\beta$ dimer combined through an affinity tag and a $\alpha/\beta$ dimer combined through an affinity tag with a peptide;
or a MHC Class I like molecule or MHC Class II like molecule.

5. The MHC complex according to any one of items 1-4, wherein the MHC molecule is a peptide free MHC molecule.

6. The MHC complex according to any one of items 1-5, wherein more than one MHC molecule is present, and wherein at least two of said MHC molecules are different.

7. The MHC complex according to any one of items 1-5, wherein more than one MHC molecule is present, and wherein the MHC molecules are the same.

8. The MHC complex according to any one of items 1-7, wherein at least two of the peptides harboured by the MHC complexes are different.

9. The MHC complex according to any one of items 1-7, wherein the peptides harboured by the MHC complexes are the same.

10. The MHC complex according to any one of items 1-9, wherein the MHC molecule(s) are attached to the carrier directly.

11. The MHC complex according to any one of items 1-9, wherein the MHC molecule(s) are attached to the carrier via one or more binding entities.

12. The MHC complex according to item 11, wherein each binding entity has attached thereto from 1 to 10 MHC molecules.

13. The MHC complex according to item 11, wherein each binding entity has attached thereto from 1 to 8 MHC molecules.

14. The MHC complex according to item 11, wherein each binding entity has attached thereto from 1 to 6 MHC molecules.

15. The MHC complex according to item 11, wherein each binding entity has attached thereto from 1 to 4 MHC molecules.

16. The MHC complex according to item 11, wherein each binding entity has attached thereto from 1 to 3 MHC molecules.

17. The MHC complex according to item 11, wherein each binding entity has attached thereto 1 or 2 MHC molecules.

18. The MHC complex according to any one of items 1-17, wherein the total number of MHC molecules of the construct is from 1 to 100.

19. The MHC complex according to any one of items 1-17, wherein the total number of MHC molecules of the construct is from 1 to 50.

20. The MHC complex according to any one of items 1-17, wherein the total number of MHC molecules of the construct is from 1 to 25.

21. The MHC complex according to item 1, wherein the binding entity is selected from streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-tranferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity).

22. The MHC complex according to any one of items 1-21, further comprising one or more biologically active molecules.

23. The MHC complex according to claim 22, wherein the biologically active molecules is selected from proteins, co-stimulatory molecules, cell modulating molecules, receptors, accessory molecules, adhesion molecules, natural ligands, and toxic molecules, and antibodies and recombinant binding molecules thereto, and combinations thereof.

24. The MHC complex according to items 22 or 23, wherein the biologically active molecule is attached to the carrier either directly or via one or more of the binding entities.

25. The MHC complex according to any one of items 22-24, wherein the biologically active molecule is selected from proteins such as MHC Class I-like proteins like MIC A, MIC B, CD1d, HLA E, HLA F, HLA G, HLA H, ULBP-1, ULBP-2, and ULBP-3,
co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, B7.1 (CD80), B7.2 (CD86), B7RP-1, B7-H3, PD-L1, PD-L2, CD134L, CD137L, ICOSL, LIGHT expressed on APC and/or tumour cells,
cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin,
accessory molecules such as LFA-1, CD11a/18, CD54 (ICAM-1), CD106 (VCAM), and CD49a,b,c,d,e,f/CD29 (VLA-4),
adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P,
toxic molecules such as cyclophosphamide, methrotrexate, Azathioprine, mizoribine, 15-deoxyspergualin, neomycin, staurosporine, genestein, herbimycin A, *Pseudomonas* exotoxin A, saporin, Rituxan, Ricin, gemtuzumab ozogamicin, Shiga toxin, heavy metals like inorganic and organic mercurials, and FN18-CRM9, radioisotopes such as incorporated isotopes of iodide, cobalt, selenium, tritium, and phosphor, and haptens such as DNP, and digoxiginin,
and antibodies thereto, or antibody derivatives or fragments thereof, and combinations thereof.

26. The MHC complex according to any of items 1-25 further comprising one or more labelling compounds.

27. The MHC complex according to item 26, wherein one or more labelling compounds are attached to the carrier.

28. The MHC complex according to item 26, wherein one or more labelling compounds are attached to one or more of the binding entities.

29. The MHC complex according to item 26, wherein one or more labelling compounds are attached to the MHC molecule(s).

30. The MHC complex according to item 26, wherein one or more labelling compounds are attached to the carrier and/or one or more of the binding entities and/or one or more of the MHC molecules.

31. The MHC complex according to any one of items 26-30, wherein the labelling compound is directly or indirectly detectable.

32. The MHC complex according to any of items 26-31, wherein the labelling compound is a fluorescent label, an enzyme label, a radioisotope, a chemiluminescent label, a bioluminescent label, a polymer, a metal particle, a hapten, an antibody, or a dye.

33. The MHC complex according to any one of items 26-32, wherein the labelling compound
is selected from fluorescent labels such as 5-(and 6)-carboxyfluorescein, 5- or 6-carboxyfluorescein, 6-(fluorescein)-5-(and 6)-carboxamido hexanoic acid, fluorescein isothiocyanate (F)TC), rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeston Red, Green fluorescent protein (GFP) and analogues thereof, and conjugates of R-phycoerythrin or allophycoerythrin and e.g. Cy5 or Texas Red, and inorganic fluorescent labels based on semiconductor nanocrystals (like quantum dot and Qdot™ nanocrystals), and time-resolved fluorescent labels based on lanthanides like Eu3+ and Sm3+,
from haptens such as DNP, biotin, and digoxiginin, or
is selected from enzymatic labels such as horse radish peroxidase (HRP), alkaline phosphatase (AP), beta-galactosidase (GAL), glucose-6-phosphate dehydrogenase, beta-N-acetyl-glucosaminidase, β-glucuronidase, invertase, Xanthine Oxidase, firefly luciferase and glucose oxidase (GO), or
is selected from luminescence labels such as luminol, isoluminol, acridinium esters, 1,2-dioxetanes and pyridopyridazines, or
is selected from radioactivity labels such as incorporated isotopes of iodide, cobalt, selenium, tritium, and phosphor.

34. The MHC complex according to any one of items 1-33, wherein the carrier is selected from
polysaccharides including dextrans, carboxy methyl dextran, dextran polyaldehyde, carboxymethyl dextran lactone, and cyclodextrins,
pullulans, schizophyllan, scleroglucan, xanthan, gellan, O-ethylamino guaran, chitins and chitosans including 6-O-carboxymethyl chitin and N-carboxymethyl chitosan,
derivatised cellolosics including carboxymethyl cellulose, carboxymethyl hydroxyethyl cellulose, hydroxyethyl cellulose, 6-amino-6-deoxy cellulose and O-ethylamine cellulose,
hydroxylated starch, hydroxypropyl starch, hydroxyethyl starch, carrageenans, alginates, and agarose, synthetic polysaccharides including ficoll and carboxymethylated ficoll, vinyl polymers including poly(acrylic acid), poly(acryl amides), poly(acrylic esters), poly(2-hydroxy ethyl methacrylate), poly(methyl methacrylate), poly(maleic acid), poly(maleic anhydride), poly(acrylamide), poly(ethyl-co-vinyl acetate), poly(methacrylic acid), poly(vinyl-alcohol), poly(vinyl alcohol-co-vinyl chloroacetate), aminated poly (vinyl alcohol), and co block polymers thereof, poly ethylene glycol (PEG) or polypropylene glycol or poly(ethylene oxide-co-propylene oxides) containing polymer backbones including linear, comb-shaped or StarBurst™ dendrimers, poly amino acids including polylysines, polyglutamic acid, polyurethanes, poly(ethylene imines), pluriol.

proteins including albumins, immunoglobulins, and viruslike proteins (VLP), and polynucleotides, DNA, PNA, LNA, oligonucleotides and oligonucleotide dendrimer constructs.

35. The MHC complex according to any one of items 1-34, wherein the carrier is a soluble carrier.

36. The MHC complex according to any one of items 1-35 in soluble form.

37. The MHC complex according to any one of items 1-36 immobilised onto a solid or semi-solid support.

38. The MHC complex according to item 37, immobilised directly to the solid or semi-solid support.

39. The MHC complex according to item 37, immobilised to the solid or semi-solid support via a linker, a spacer, or an antibody, an antibody derivative or a fragment thereof.

40. The MHC complex according to any one of items 37-39, wherein the support is selected from particles, beads, biodegradable particles, sheets, gels, filters, membranes (e.g. nylon membranes), fibres, capillaries, needles, microtitre strips, tubes, plates or wells, combs, pipette tips, micro arrays, and chips.

41. The MHC complex according to item 40, wherein the support is selected from beads and particles.

42. The MHC complex according to item 41, wherein the beads and particles are polymeric beads, polymeric particles, magnetic beads, magnetic particles, supermagnetic beads, or supermagnetic particles.

43. The MHC complex according to any one of items 1-42 for use in a flow cytometric method.

44. The MHC complex according to any one of items 1-42 for use in a histological method.

45. The MHC complex according to any one of items 1-42 for use in a cytological method.

46. A method for detecting the presence of MHC recognising cells in a sample comprising the steps of
(a) providing a sample suspected of comprising MHC recognising cells,
(b) contacting the sample with a MHC complex according to items 1-42, and
(c) determining any binding of the MHC complex, which binding indicates the presence of MHC recognising cells.

47. A method for monitoring MHC recognising cells comprising the steps of
(a) providing a sample suspected of comprising MHC recognising cells,
(b) contacting the sample with a MHC complex according to items 1-42, and
(c) determining any binding of the MHC complex, thereby monitoring MHC recognising cells.

48. A method for establishing a prognosis of a disease involving MHC recognising cells comprising the steps of
(a) providing a sample suspected of comprising MHC recognising cells,
(b) contacting the sample with a MHC complex according to items 1-42, and
(c) determining any binding of the MHC complex, thereby establishing a prognosis of a disease involving MHC recognising cells.

49. A method for determining the status of a disease involving MHC recognising cells comprising the steps of
(a) providing a sample suspected of comprising MHC recognising cells,
(b) contacting the sample with a MHC complex according to items 1-42, and
(c) determining any binding of the MHC complex, thereby determining the status of a disease involving MHC recognising cells.

50. A method for diagnosing a disease involving MHC recognising cells comprising the steps of
(a) providing a sample suspected of comprising MHC recognising cells,
(b) contacting the sample with a MHC complex according to items 1-42, and
(c) determining any binding of the MHC complex, thereby diagnosing a disease involving MHC recognising cells.

51. A method for determining the effectiveness of a medicament against a disease involving MHC recognising cells comprising the steps of
(a) providing a sample from a subject receiving treatment with a medicament,
(b) contacting the sample with a MHC complex according to items 1-42, and
(c) determining any binding of the MHC complex, thereby determining the effectiveness of the medicament.

52. The method according to any one of items 46-51, wherein the MHC recognising cells are involved in a disease of inflammatory, auto-immune, allergic, viral, cancerous, infectious, allo- or xenogene (graft versus host and host versus graft) origin.

53. The method according to item 52, wherein the disease is a chronic inflammatory bowel disease such as Crohn's disease or ulcerative colitis, sclerosis, type I diabetes, rheumatoid arthritis, psoriasis, atopic dermatitis, asthma, malignant melanoma, renal carcinoma, breast cancer, lung cancer, cancer of the uterus, cervical cancer, prostatic cancer, brain cancer, head and neck cancer, leukaemia, cutaneous lymphoma, hepatic carcinoma, colorectal cancer, bladder cancer, rejection-related disease, Graft-versus-host-related disease, or a viral disease associated with hepatitis, AIDS, measles, pox, chicken pox, rubella or herpes.

54. The method according to any one of items 46-53, wherein the MHC recognising cells selected from subpopulations of CD3+ T-cells, gamma,delta T-cells, alpha,beta T-cells, CD4+ T-cells, T helper cells, CD8+ T-cells, Suppressor T-cells, CD8+ cytotoxic T-cells, CTLs, NK cells, NKT cells, LAK cells, and MAK.

55. The method according to any one of items 46-51, wherein the sample is selected from histological material, cytological material, primary tumours, secondary organ metastasis, fine needle aspirates, spleen tissue, bone marrow specimens, cell smears, exfoliative cytological specimens, touch preparations, oral swabs, laryngeal swabs, vaginal swabs, bronchial lavage, gastric lavage, from the umbilical cord, and from body fluids such as blood (e.g. from a peripheral blood mononuclear cell (PBMC) population isolated from blood or from other blood-derived preparations such as leukopheresis products), from sputum samples, expectorates, and bronchial aspirates.

56. The method according to any one of items 46-55, wherein the determination of the binding is carried out by inspection in a microscope, by light, by fluorescence, by electron transmission, or by flow cytometry.

57. The method according to any one of items 46-56, wherein the sample is mounted on a support.

58. The method according to item 57, wherein the support is a solid or semi-solid support.

59. The method according to item 57 or 58, wherein the support is selected from glass slides, microtiter plates having one or more wells, beads, particles, membranes, filters, filter membranes, polymer slides, polymer membranes, chamber slides, dishes, and petridishes.

60. A composition comprising a MHC complex according to any one of items 1-42 in a solubilising medium.

61. The composition according to item 60, wherein the MHC complex comprises peptide filled MHC molecules.

62. The composition according to item 60, wherein the MHC complex comprises peptide free MHC molecules.

63. The composition according to item 62, wherein peptides to fill the peptide free MHC molecules, and the MHC complex comprising peptide free molecules are provided separately.

64. A composition comprising a MHC complex according to any one of items 1-42, wherein the MHC complex is immobilised onto a solid or semi-solid support.

65. The composition according to item 64, wherein the support is selected from glass slides, microtiter plates having one or more wells, beads, particles, membranes, filters, filter membranes, polymer slides, polymer membranes, chamber slides, dishes, and petridishes.

66. The composition according to item 64 or 65, wherein the beads and particles are polymeric beads, polymeric particles, magnetic beads, magnetic particles, supermagnetic beads, or supermagnetic particles.

67. The composition according to item 64, wherein the MHC complex comprises peptide filled MHC molecules.

68. The composition according to item 64, wherein the MHC complex comprises peptide free MHC molecules.

69. The composition according to item 68, wherein peptides to fill the peptide free MHC molecules, and the MHC complex comprising peptide free molecules are provided separately.

70. Use of a MHC complex according to any one of items 1-42 as a detection system.

71. Use of a MHC complex according to any one of items 1-42 for diagnosing a disease involving MHC recognising cells.

72. Use of a MHC complex according to any one of items 1-42 for monitoring a disease involving MHC recognising cells.

73. Use of a MHC complex according to any one of items 1-42 for establishing a prognosis for a disease involving MHC recognising cells.

74. Use of a MHC complex according to any one of items 1-42 for determining the status of a disease involving MHC recognising cells.

75. Use of a MHC complex according to any one of items 1-42 for determining the effectiveness of a medicament against a disease involving MHC recognising cells.

76. Use according to any one of items 71, wherein the MHC recognising cells are involved in a disease of inflammatory, auto-immune, allergic, viral, cancerous, infectious, allo- or xenogene (graft-versus-host and host-versus-graft) origin.

77. Use according to item 76, wherein the disease is a chronic inflammatory bowel disease such as Crohn's disease or ulcerative colitis, sclerosis, type I diabetes, rheumatoid arthritis, psoriasis, atopic dermatitis, asthma, malignant melanoma, renal carcinoma, breast cancer, lung cancer, cancer of the uterus, cervical cancer, prostatic cancer, brain cancer, head and neck cancer, leukaemia, cutaneous lymphoma, hepatic carcinoma, colorectal cancer, bladder cancer, rejection-related disease, Graft-versus-host-related disease, or a viral disease associated with hepatitis, AIDS, measles, pox, chicken pox, rubella or herpes.

78. Use according to any one of items 70-77, wherein the MHC recognising cells are selected from subpopulations of CD3+ T-cells, gamma,delta T-cells, alpha,beta T-cells, CD4+ T-cells, T helper cells, CD8+ T-cells, Suppressor T-cells, CD8+ cytotoxic T-cells, CTLs, NK cells, NKT cells, LAK cells, and MAK.

79. The MHC complex according to any one of items 1-42 for use as a therapeutic composition.

80. The MHC complex according to any one of items 1-42 for use in in vivo therapy.

81. The MHC complex according to any one of items 1-42 for use in ex vivo therapy.

82. A therapeutic composition comprising as active ingredient a MHC complex as defined in any one of items 1-42.

83. The therapeutic composition according to item 82, wherein the MHC complex is immobilised to a biodegradable solid or semi-solid support.

84. The therapeutic composition according to item 82 or 83, wherein the MHC complex comprises
a carrier having attached thereto one or more MHC molecules, said MHC molecules being attached to the carrier either directly or via one or more binding entities.

85. The therapeutic composition according to item 82 or 83, wherein the MHC molecule is a vertebrate MHC molecule such as a human, a murine, a rat, a porcine, a bovine or an avian molecule.

86. The therapeutic composition according to any one of items 82-85, wherein the MHC molecule is a human MHC molecule.

87. The therapeutic composition according to any one of items 82-86, wherein the MHC molecule is
a MHC Class I molecule selected from the group consisting of a heavy chain, a heavy chain combined with a $\beta_2$m, a heavy chain combined with a peptide, and a heavy chain/ $\square_2$m dimer with a peptide;
or a MHC Class II molecule selected from the group consisting of an $\alpha/\beta$ dimer, an $\alpha/\beta$ dimer with a peptide, $\alpha/\beta$ dimer combined through an affinity tag and a $\alpha/\beta$ dimer combined through an affinity tag with a peptide
or a MHC Class I like molecule or a MHC Class II like molecule.

88. The therapeutic composition according to any one of items 82-87, wherein the MHC molecule is a peptide free MHC molecule.

89. The therapeutic composition according to any one of items 82-88, wherein at least two of the MHC molecules are different.

90. The therapeutic composition according to any one of items 82-88, wherein the MHC molecules are the same.

91. The therapeutic composition according to any one of items 82-88, wherein at least two of the peptides harboured by the MHC molecules are different.

92. The therapeutic composition according to any one of items 82-88, wherein the peptides harboured by the MHC molecules are the same.

93. The therapeutic composition according to any one of items 82-92, wherein the MHC molecules are attached to the carrier directly.

94. The therapeutic composition according to any one of items 82-92, wherein the MHC molecules are attached to the carrier via one or more binding entities.

95. The therapeutic composition according to item 94, wherein each binding entity has attached thereto from 1 to 10 MHC molecules.

96. The therapeutic composition according to item 94, wherein each binding entity has attached thereto from 1 to 8 MHC molecules.

97. The therapeutic composition according to item 94, wherein each binding entity has attached thereto from 1 to 6 MHC molecules.

98. The therapeutic composition according to item 94, wherein each binding entity has attached thereto from 1 to 4 MHC molecules.

99. The therapeutic composition according to item 94, wherein each binding entity has attached thereto from 1 to 3 MHC molecules.

100. The therapeutic composition according to item 94, wherein each binding entity has attached thereto 1 or 2 MHC molecules.

101. The therapeutic composition according to any one of items 82-100, wherein the total number of MHC molecules of the construct is from 1 to 100.

102. The therapeutic composition according to any one of items 82-100, wherein the total number of MHC molecules of the construct is from 1 to 50.

103. The therapeutic composition according to any one of items 82-100, wherein the total number of MHC molecules of the construct is from 1 to 25.

104. The therapeutic composition according to item 94, wherein the binding entity is selected from streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-tranferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity).

105. The therapeutic composition according to any one of items 82-104 further comprising one or more biologically active molecules.

106. The therapeutic composition according to item 105, wherein the biologically active molecules is selected from proteins, co-stimulatory molecules, cell modulating molecules, receptors, accessory molecules, adhesion molecules, natural ligands, and toxic molecules, and antibodies and recombinant binding molecules thereto, and combinations thereof.

107. The therapeutic composition according to item 105 or 106, wherein the biologically active molecule is attached to the carrier either directly or via one or more of the binding entities.

108. The therapeutic composition according to any one of items 105-107, wherein the biologically active molecule is selected from proteins such as MHC Class I-like proteins like MIC A, MIC B, CD1d, HLA E, HLA F, HLA G, HLA H, ULBP-1, ULBP-2, and ULBP-3, co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, B7.1 (CD80), B7.2 (CD86), B7RP-1, B7-H3, PD-L1, PD-L2, CD134L, CD137L, ICOSL, LIGHT expressed on APC and/or tumour cells, cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin, accessory molecules such as LFA-1, CD11a/18, CD54 (ICAM-1), CD106 (VCAM), and CD49a,b,c,d,e,f/CD29 (VLA-4), adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P, toxic molecules such as cyclophosphamide, methrotrexate, Azathioprine, mizoribine, 15-deoxuspergualin, neomycin, staurosporine, genestein, herbimycin A, *Pseudomonas* exotoxin A, saporin, Rituxan, Ricin, gemtuzumab ozogamicin, Shiga toxin, heavy metals like inorganic and organic mercurials, and FN18-CRM9, radioisotopes such as incorporated isotopes of iodide, cobalt, selenium, tritium, and phosphor, and haptens such as DNP, and digoxiginin, and antibodies thereto, or antibody derivatives or fragments thereof, and combinations thereof.

109. The therapeutic composition according to any one of items 82-108, wherein the carrier is selected from polysaccharides including dextrans, carboxy methyl dextran, dextran polyaldehyde, carboxymethyl dextran lactone, and cyclodextrins, pullulans, schizophyllan, scleroglucan, xanthan, gellan, O-ethylamino guaran, chitins and chitosans including 6-O-carboxymethyl chitin and N-carboxymethyl chitosan, derivatised cellolosics including carboxymethyl cellulose, carboxymethyl hydroxyethyl cellulose, hydroxyethyl cellulose, 6-amino-6-deoxy cellulose and O-ethylamine cellulose, hydroxylated starch, hydroxypropyl starch, hydroxyethyl starch, carrageenans, alginates, and agarose, synthetic polysaccharides including ficoll and carboxymethylated ficoll, vinyl polymers including poly(acrylic acid), poly(acryl amides), poly(acrylic esters), poly(2-hydroxy ethyl methacrylate), poly(methyl methacrylate), poly(maleic acid), poly(maleic anhydride), poly(acrylamide), poly(ethyl-co-vinyl acetate), poly(methacrylic acid), poly(vinyl-alcohol), poly(vinyl alcohol-co-vinyl chloroacetate), aminated poly(vinyl alcohol), and co block polymers thereof, poly ethylene glycol (PEG) or polypropylene glycol or poly(ethylene oxide-co-propylene oxides) containing polymer backbones including linear, comb-shaped or Star-Burst™ dendrimers, poly amino acids including polylysines, polyglutamic acid, polyurethanes, poly(ethylene imines), pluriol.

proteins including albumins, immunoglobulins, and virus-like proteins (VLP), and polynucleotides, DNA, PNA, LNA, oligonucleotides and oligonucleotide dendrimer constructs.

110. The therapeutic composition according to any one of items 82-109, wherein the carrier is a soluble carrier.

111. The therapeutic composition according to any one of items 82-110 further comprising one or more adjuvants and/or excipients.

112. The therapeutic composition according to item 111, wherein the adjuvant is selected from saponins such as Quil A and Qs-21, oil in water emulsions such as MF59, MPL, PLG, PLGA, aluminium salts, calcium phosphate, water in oil emulsions such as IFA (Freund's incomplete adjuvant) and CFA (Freund's complete adjuvant), interleukins such as IL-1β, IL-2, IL-7, IL-12, and INFγ, Adju-Phos®, glucan, antigen formulation, biodegradable microparticles, Cholera Holotoxin, liposomes, DDE, DHEA, DMPC, DMPG, DOC/Alum Complex, ISCOMs®, muramyl dipeptide, monophosphoryl lipid A, muramyl tripeptide, and phospatidylethanolamine In a preferred embodiment, the adjuvant is selected from saponins such as Quil A and Qs-21, MF59, MPL, PLG, PLGA, calcium phosphate, and aluminium salts.

113. The therapeutic composition according to item 113, wherein the excipient is selected from diluents, buffers, suspending agents, wetting agents, solubilising agents, pH-adjusting agents, dispersing agents, preserving agents, and/or colorants.

114. The therapeutic composition according to any one of items 82-113 for the treatment, prevention, stabilisation, or alleviation of disease involving MHC recognising cells.

115. The therapeutic composition according to item 114, wherein the MHC recognising cells are involved in a disease of inflammatory, auto-immune, allergic, viral, cancerous, infectious, allo- or xenogene (graft versus host and host versus graft) origin.

116. The therapeutic composition according to item 115, wherein the disease is a chronic inflammatory bowel disease such as Crohn's disease or ulcerative colitis, sclerosis, type I diabetes, rheumatoid arthritis, psoriasis, atopic dermatitis, asthma, malignant melanoma, renal carcinoma, breast cancer, lung cancer, cancer of the uterus, prostatic cancer, brain cancer, head and neck cancer, leukaemia, cutaneous lymphoma, hepatic carcinoma, colorectal cancer, bladder cancer, rejection-related disease, Graft-versus-host-related disease, or a viral disease associated with hepatitis, AIDS, measles, pox, chicken pox, rubella or herpes.

117. The therapeutic composition according to any one of items 82-116 formulated for parenteral administration, including intravenous, intramuscular, intraarticular, subcutaneous, intradermal, epicutantous/transdermal, and intraperitoneal administration, for infusion, for oral administration, for nasal administration, for rectal administration, or for topic administration.

118. A therapeutic composition comprising as active ingredient an effective amount of MHC recognising cells, the MHC recognising cells being obtained by
bringing a sample from a subject comprising MHC recognising cells into contact with the MHC complex according to any one of items 1-42, whereby the MHC recognising cells become bound to the MHC complex,
isolating the bound MHC complex and the MHC recognising cells, and
expanding such MHC recognising cells to a clinically relevant number.

119. The therapeutic composition according to item 118, wherein the isolated MHC recognising cells are liberated from the MHC complex prior to expansion.

120. The therapeutic composition according to items 118 or 119, wherein the MHC complex is immobilised onto a solid or semi-solid support.

121. The therapeutic composition according to item 120, wherein the MHC complex is immobilised onto the solid or semi-solid support prior to contact with the sample.

122. The therapeutic composition according to item 120, wherein the MHC complex is immobilised onto the solid or semi-solid support following contact with the sample.

123. The therapeutic composition according to any one of items 118-122, wherein the expansion is carried out in the presence of one or more MHC complexes, optionally one or more biologically active molecules and optionally feeder cells such as dendritic cells or feeder cells.

124. The therapeutic composition according to any one of items 120-123, wherein the MHC complex is immobilised onto the solid or semi-solid support directly.

125. The therapeutic composition according to any one of items 120-124, wherein the MHC complex is immobilised to the solid or semi-solid support via a linker, a spacer, or an antibody, an antibody derivative or a fragment thereof.

126. The therapeutic composition according to any one of items 120-125, wherein the solid or semi-solid support is selected from particles, beads, biodegradable particles, sheets, gels, filters, membranes, fibres, capillaries, needles, microtitre strips, tubes, plates or wells, combs, pipette tips, micro arrays, chips, and microtiter plates having one or more wells.

127. The therapeutic composition according to any one of items 120-126, wherein the solid support is selected from particles and beads.

128. The therapeutic composition according to item 127, wherein the particles and beads are polymeric, magnetic or superparamagnetic.

129. The therapeutic composition according to any one of items 118-128, wherein the isolation is performed by applying a magnetic field or by flow cytometry.

130. The therapeutic composition according to any one of items 118-128, wherein the MHC complex comprises
a carrier having attached thereto one or more MHC molecules, said MHC molecules being attached to the carrier either directly or via one or more binding entities.

131. The therapeutic composition according to any one of items 118-130, wherein the MHC molecule is a vertebrate MHC molecule such as a human, a murine, a rat, a porcine, a bovine or an avian molecule.

132. The therapeutic composition according to any one of items 118-131, wherein the MHC molecule is a human MHC molecule.

133. The therapeutic composition according to any one of items 118-132, wherein the MHC molecule is
a MHC Class I molecule selected from the group consisting of a heavy chain, a heavy chain combined with a $\square_2$m, a heavy chain combined with a peptide, and a heavy chain/$\square_2$m dimer with a peptide;
or a MHC Class II molecule selected from the group consisting of an $\bar\alpha\square$ dimer, an $\bar\alpha\square$ dimer with a peptide, $\square\square$dimer combined through an affinity tag and a $\square\square$dimer combined through an affinity tag with a peptide;
or a MHC Class I like molecule or a MHC Class II molecule.

134. The therapeutic composition according to any one of items 118-133, wherein the MHC molecule is a peptide free MHC molecule.

135. The therapeutic composition according to any one of items 118-134, wherein at least two of the MHC molecules are different.

136. The therapeutic composition according to any one of items 118-135, wherein the MHC molecules are the same.

137. The therapeutic composition according to any one of items 118-136, wherein at least two of the peptides harboured by the MHC molecules are different.

138. The therapeutic composition according to any one of items 118-137, wherein the peptides harboured by the MHC molecules are the same.

139. The therapeutic composition according to any one of items 118-138, wherein the MHC molecules are attached to the carrier directly.

140. The therapeutic composition according to any one of items 118-138, wherein the MHC molecules are attached to the carrier via one or more binding entities.

141. The therapeutic composition according to item 140, wherein each binding entity has attached thereto from 1 to 10 MHC molecules.

142. The therapeutic composition according to item 140, wherein each binding entity has attached thereto from 1 to 8 MHC molecules.

143. The therapeutic composition according to item 140, wherein each binding entity has attached thereto from 1 to 6 MHC molecules.

144. The therapeutic composition according to item 140, wherein each binding entity has attached thereto from 1 to 4 MHC molecules.

145. The therapeutic composition according to item 140, wherein each binding entity has attached thereto from 1 to 3 MHC molecules.

146. The therapeutic composition according to item 140, wherein each binding entity has attached thereto 1 or 2 MHC molecules.

147. The therapeutic composition according to any one of items 118-146, wherein the total number of MHC molecules of the construct is from 1 to 100.

148. The therapeutic composition according to any one of items 118-146, wherein the total number of MHC molecules of the construct is from 1 to 50.

149. The therapeutic composition according to any one of items 118-146, wherein the total number of MHC molecules of the construct is from 1 to 25.

150. The therapeutic composition according to item 140, wherein the binding entity is selected from streptavidin streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-tranferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity).

151. The therapeutic composition according to any one of items 118-150 further comprising one or more biologically active molecules.

152. The therapeutic composition according to item 151, wherein the biologically active molecules is selected from proteins, co-stimulatory molecules, cell modulating molecules, receptors, accessory molecules, adhesion molecules, natural ligands, and toxic molecules, and antibodies and recombinant binding molecules thereto, and combinations thereof.

153. The therapeutic composition according to item 150 or 151, wherein the biologically active molecule is attached to the carrier either directly or via one or more of the binding entities.

154. The therapeutic composition according to any one of items 151-153, wherein the biologically active molecule is selected from
proteins such as MHC Class I-like proteins like MICA, MIC B, CD1d, HLA E, HLA F, HLA G, HLA H, ULBP-1, ULBP-2, and ULBP-3,
co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, B7.1 (CD80), B7.2 (CD86), B7RP-1, B7-H3, PD-L1, PD-L2, CD134L, CD137L, ICOSL, LIGHT expressed on APC and/or tumour cells,
cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin,
accessory molecules such as LFA-1, CD11a/18, CD54 (ICAM-1), CD106 (VCAM), and CD49a,b,c,d,e,f/CD29 (VLA-4), adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P,
toxic molecules such as cyclophosphamide, methrotrexate, Azathioprine, mizoribine, 15-deoxuspergualin, neomycin, staurosporine, genestein, herbimycin A, *Pseudomonas* exotoxin A, saporin, Rituxan, Ricin, gemtuzumab ozogamicin, Shiga toxin, heavy metals like inorganic and organic mercurials, and FN18-CRM9, radioisotopes such as incorporated isotopes of iodide, cobalt, selenium, tritium, and phosphor, and haptens such as DNP, and digoxiginin,
and antibodies thereto, or antibody derivatives or fragments thereof, and combinations thereof.

155. The therapeutic composition according to any one of items 118-154, wherein the carrier is selected from
polysaccharides including dextrans, carboxy methyl dextran, dextran polyaldehyde, carboxymethyl dextran lactone, and cyclodextrins,
pullulans, schizophyllan, scleroglucan, xanthan, gellan, O-ethylamino guaran, chitins and chitosans including 6-O-carboxymethyl chitin and N-carboxymethyl chitosan,
derivatised cellolosics including carboxymethyl cellulose, carboxymethyl hydroxyethyl cellulose, hydroxyethyl cellulose, 6-amino-6-deoxy cellulose and O-ethylamine cellulose,
hydroxylated starch, hydroxypropyl starch, hydroxyethyl starch, carrageenans, alginates, and agarose,
synthetic polysaccharides including ficoll and carboxymethylated ficoll,
vinyl polymers including poly(acrylic acid), poly(acryl amides), poly(acrylic esters), poly(2-hydroxy ethyl methacrylate), poly(methyl methacrylate), poly(maleic acid), poly(maleic anhydride), poly(acrylamide), poly(ethyl-co-vinyl acetate), poly(methacrylic acid), poly(vinyl-alcohol), poly(vinyl alcohol-co-vinyl chloroacetate), aminated poly(vinyl alcohol), and co block polymers thereof, poly ethylene glycol (PEG) or polypropylene glycol or poly(ethylene oxide-co-propylene oxides) containing polymer backbones including linear, comb-shaped or StarBurst™ dendrimers, poly amino acids including polylysines, polyglutamic acid, polyurethanes, poly(ethylene imines), pluriol.

proteins including albumins, immunoglobulins, and virus-like proteins (VLP), and polynucleotides, DNA, PNA, LNA, oligonucleotides and oligonucleotide dendrimer constructs.

156. The therapeutic composition according to any one of items 118-155 further comprising one or more labelling compounds.

157. The therapeutic composition according to item 156, wherein one or more labelling compounds are attached to the carrier.

158. The therapeutic composition according to item 156, wherein one or more labelling compounds are attached to one or more of the binding entities.

159. The therapeutic composition according to item 156, wherein one or more labelling compounds are attached to the one or more MHC molecules.

160. The therapeutic composition according to item 156, wherein one or more labelling compounds are attached to the carrier and/or one or more of the binding entities and/or one or more of the MHC molecules.

161. The therapeutic composition according to any one of items 156-160, wherein the labelling compound is directly or indirectly detectable.

162. The therapeutic composition according to any one of items 156-161, wherein the labelling compound is a fluorescent label, an enzyme label, a radioisotope, a chemiluminescent label, a bioluminescent label, a polymer, a metal particle, a hapten, an antibody, or a dye.

163. The therapeutic composition according to any one of items 156-162, wherein the labelling compound is selected from fluorescent labels such as 5-(and 6)-carboxyfluorescein, 5- or 6-carboxyfluorescein, 6-(fluorescein)-5-(and 6)-carboxamido hexanoic acid, fluorescein isothiocyanate (FITC), rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeton Red, Green fluorescent protein (GFP) and analogues thereof, and conjugates of R-phycoerythrin or allophycoerythrin and e.g. Cy5 or Texas Red, and inorganic fluorescent labels based on semiconductor nanocrystals (like quantum dot and Qdot™ nanocrystals), and time-resolved fluorescent labels based on lanthanides like Eu3+ and Sm3+, from haptens such as DNP, biotin, and digoxiginin, or is selected from haptens such as DNP, fluorescein isothiocyanate (FITC), biotin, and digoxiginin, or is selected from enzymatic labels such as horse radish peroxidase (HRP), alkaline phosphatase (AP), beta-galactosidase (GAL), glucose-6-phosphate dehydrogenase, beta-N-acetyl-glucosaminidase, β-glucuronidase, invertase, Xanthine Oxidase, firefly luciferase and glucose oxidase (GO), or is selected from luminescence labels such as luminol, isoluminol, acridinium esters, 1,2-dioxetanes and pyridopyridazines, or is selected from radioactivity labels such as incorporated isotopes of iodide, cobalt, selenium, tritium, and phosphor.

164. The therapeutic composition according to any one of items 118-163, wherein the carrier is a soluble carrier.

165. The therapeutic composition according to any one of items 118-164 further comprising one or more excipients.

166. The therapeutic composition according to items 165, wherein the excipient is selected from diluents, buffers, suspending agents, wetting agents, solubilising agents, pH-adjusting agents, dispersing agents, preserving agents, and/or colorants.

167. The therapeutic composition according to any one of items 118-166 for the treatment, prevention, stabilisation, or alleviation of a disease involving MHC recognising cells.

168. The therapeutic composition according to item 167, wherein MHC recognising cells are involved in a disease of inflammatory, auto-immune, allergic, viral, cancerous, infectious, allo- or xenogene (graft versus host and host versus graft) origin.

169. The therapeutic composition according to item 167 or 168, wherein the disease is a chronic inflammatory bowel disease such as Crohn's disease or ulcerative colitis, sclerosis, type I diabetes, rheumatoid arthritis, psoriasis, atopic dermatitis, asthma, malignant melanoma, renal carcinoma, breast cancer, lung cancer, cancer of the uterus, prostatic cancer, brain cancer, head and neck cancer, leukaemia, cutaneous lymphoma, hepatic carcinoma, colorectal cancer, bladder cancer, rejection-related disease, Graft-versus-host-related disease, or a viral disease associated with hepatitis, AIDS, measles, pox, chicken pox, rubella or herpes.

170. The therapeutic composition according to any one of items 118-169 formulated for parenteral administration, including intravenous, intramuscular, intraarticular, subcutaneous, intradermal, epicutantous/transdermal, and intraperitoneal administration, for infusion, for oral administration, for nasal administration, for rectal administration, or for topic administration.

171. The therapeutic composition according to any one of items 82-170 for use in in vivo therapy.

172. A method of treating an animal, including a human being, comprising administering a therapeutic composition according to any one of items 82-170 in an effective amount.

173. A method of up-regulating, down-regulating, modulate an immune response in an animal, including a human being, comprising administering a therapeutic composition according to any one of items 82-170 in an effective amount.

174. A method of inducing anergy of a cell in an animal, including a human being, comprising administering a therapeutic composition according to any one of items 82-170 in an effective amount.

175. An adoptive cellular immunotherapeutic method comprising administrating to an animal, including a human being, a therapeutic composition according to any one of items 82-170.

176. A method of obtaining MHC recognising cells comprising bringing into contact a MHC complex according to any one of items 1-42 and a sample suspected of comprising MHC recognising cells under conditions whereby the MHC recognising cells bind to the MHC complex, and isolating the bound MHC complex and MHC recognising cells.

177. The method according to item 176, wherein the isolation is carried out by applying a magnetic field or by flow cytometry.

178. A method for producing a therapeutic composition according to any one of items 82-170, comprising providing a MHC complex as defined in items 1-42, solubilising or dispersing the MHC complex in a medium suitable for therapeutic substances,
and optionally adding other adjuvants and/or excipients.

179. A method for producing a therapeutic composition according to any one of items 118-170, comprising
obtaining MHC recognising cells using a MHC complex according to any one of items 1-42,
expanding such MHC recognising cells to a clinically relevant number,
formulating the obtained cells in a medium suitable for administration, and
optionally adding adjuvants and/or excipients.

180. Use of a MHC complex according to any one of items 1-42 for ex vivo expansion of MHC recognising cells.

181. Use according to item 180, wherein the MHC complex is in soluble form.

182. Use according to item 180, wherein the MHC complex is immobilised onto a solid or semi-solid support.

183. Use according to item 182, wherein the solid or semi-solid support is selected from particles, beads, biodegradable particles, sheets, gels, filters, membranes (e.g. nylon membranes), fibres, capillaries, needles, microtitre strips, tubes, plates or wells, combs, pipette tips, micro arrays, chips, and slides.

184. Use according to item 182 or 183, wherein the solid or semi-solid support is selected from beads and particles.

185. Use according to item 184, wherein the solid or semi-solid support is selected from polymeric, magnetic or superparamagnetic particles and beads.

186. Use according to any one of items 180-185, wherein the MHC complex further comprises one or more biologically active molecules.

187. Use according to any one of items 180-186, wherein the biologically active molecule is selected from
proteins such as MHC Class I-like proteins like MIC A, MIC B, CD1d, HLA E, HLA F, HLA G, HLA H, ULBP-1, ULBP-2, and ULBP-3,
co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, B7.1 (CD80), B7.2 (CD86), B7RP-1, B7-H3, PD-L1, PD-L2, CD134L, CD137L, ICOSL, LIGHT expressed on APC and/or tumour cells,
cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin,
accessory molecules such as LFA-1, CD11a/18, CD54 (ICAM-1), CD106 (VCAM), and CD49a,b,c,d,e,f/CD29 (VLA-4),
adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P, toxic molecules such as cyclophosphamide, methrotrexate, Azathioprine, mizoribine, 15-deoxuspergualin, neomycin, staurosporine, genestein, herbimycin A, *Pseudomonas* exotoxin A, saporin, Rituxan, Ricin, gemtuzumab ozogamicin, Shiga toxin, heavy metals like inorganic and organic mercurials, and FN18-CRM9, radioisotopes such as incorporated isotopes of iodide, cobalt, selenium, tritium, and phosphor, and haptens such as DNP, and digoxiginin,
and antibodies thereto, or antibody derivatives or fragments thereof, and combinations thereof.

187. Use of a MHC molecule in a histological method.

188. Use of a MHC molecule in a cytological method.

189. Use of a MHC molecule according to item 187 or 188 in a method for determining the presence of MHC recognising cells in a sample, in which method the MHC recognising cells of the sample are mounted on a support.

190. Use of a MHC molecule according to item 187 or 188, in a method for monitoring the presence of MHC recognising cells in a sample, in which method the MHC recognising cells of the sample are mounted on a support.

191. Use of a MHC molecule according to item 187 or 188 in a method for determining the status of a disease involving MHC recognising cells, in which method the MHC recognising cells of the sample are mounted on a support.

192. Use of a MHC molecule according to item 187 or 188 in a method for establishing a prognosis of a disease involving MHC recognising cells, in which method the MHC recognising cells of the sample are mounted on a support.

193. Use of a MHC molecule according to any one of items 187-192, wherein the support is a solid or semi-solid support.

194. Use of a MHC molecule according to any one of items 187-193, wherein the support is selected from glass slides, membranes, filters, polymer slides, chamber slides, dishes, and petridishes.

195. Use according to any one of items 187-194, wherein the sample is selected from histological material, cytological material, primary tumours, secondary organ metastasis, fine needle aspirates, spleen tissue, bone marrow specimens, cell smears, exfoliative cytological specimens, touch preparations, oral swabs, laryngeal swabs, vaginal swabs, bronchial lavage, gastric lavage, from the umbilical cord, and from body fluids such as blood (e.g. from a peripheral blood mononuclear cell (PBMC) population isolated from blood or from other blood-derived preparations such as leukopheresis products), from sputum samples, expectorates, and bronchial aspirates.

196. The use according to any one of items 187-195, wherein the MHC molecule is
a MHC Class I molecule selected from the group consisting of a heavy chain, a heavy chain combined with a $\square_2$m, a heavy chain combined with a peptide, and a heavy chain/$\square_2$m dimer with a peptide;
or a MHC Class II molecule selected from the group consisting of an α/$\square$dimer, an α/$\square$ dimer with a peptide, $\square$/$\square$ dimer combined through an affinity tag and a $\square$/$\square$ dimer combined through an affinity tag with a peptide;
or a MHC Class I like molecule or a MHC Class II like molecule.

197. The use according to any one of items 187-196, wherein the MHC molecule is a vertebrate MHC molecule such as a human, a murine, a rat, a porcine, a bovine or an avian molecule.

198. The use according to any one of items 187-197, wherein the MHC molecule is a human MHC molecule.

199. The use according to any one of items 187-198, wherein the MHC molecule is a peptide free MHC molecule.

200. The use according to any one of items 187-199, wherein the MHC molecule is attached to a binding entity.

201. Use according to item 200, wherein the binding entity has attached thereto from 1 to 10 MHC molecules, such as from 1 to 9, from 1 to 8, from 1 to 7, from 1 to 6, from 1 to 5, from 1 to 4, from 1 to 3, or 1 or 2 MHC molecules.

202. Use according to item 200, wherein the binding entity is selected from streptavidin streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-tranferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity).

203. Use according to any one of items 187-202, wherein the MHC molecule further comprises a labelling compound.

204. Use according to item 203, wherein the labelling compound can be detected directly or indirectly.

205. Use according to item 203 or 204, wherein the labelling compound is a fluorescent label, an enzyme label, a radioisotope, a chemiluminescent label, a bioluminescent label, a polymer, a metal particle, a hapten, an antibody, or a dye.

206. Use according to any one of items 203-205, wherein the labelling compound is selected from
5-(and 6)-carboxyfluorescein, 5- or 6-carboxyfluorescein, 6-(fluorescein)-5-(and 6)-carboxamido hexanoic acid, fluorescein isothiocyanate (FITC), rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeton Red, Green fluorescent protein (GFP) and analogues thereof, and conjugates of R-phycoerythrin or allophycoerythrin and e.g. Cy5 or Texas Red, and inorganic fluorescent labels based on semiconductor nanocrystals (like quantum dot and Qdot™ nanocrystals), and time-resolved fluorescent labels based on lanthanides like Eu3+ and Sm3+,
from haptens such as DNP, biotin, and digoxiginin, or
is selected from enzymatic labels such as horse radish peroxidase (HRP), alkaline phosphatase (AP), beta-galactosidase (GAL), glucose-6-phosphate dehydrogenase, beta-N-acetyl-glucosaminidase, β-glucuronidase, invertase, Xanthine Oxidase, firefly luciferase and glucose oxidase (GO), or
is selected from luminiscence labels such as luminol, isoluminol, acridinium esters, 1,2-dioxetanes and pyridopyridazines, or
is selected from radioactivity labels such as incorporated isotopes of iodide, cobalt, selenium, tritium, and phosphor.

207. The use according to any one of items 203-206, wherein the labelling compound is attached to the MHC molecule and/or the binding entity.

208. A method for detecting the presence of MHC recognising cells in a sample comprising the steps of
(a) providing a sample suspected of comprising MHC recognising cells mounted on a support,
(b) contacting the sample with a MHC molecule as defined in items 187-207, and
(c) determining any binding of the MHC molecule, which binding indicates the presence of MHC recognising cells.

209. A method for monitoring MHC recognising cells comprising the steps of
(a) providing a sample suspected comprising MHC recognising cells mounted on a support,
(b) contacting the sample with a MHC molecule as defined in items 187-207, and
(c) determining any binding of the MHC molecule, thereby monitoring MHC recognising cells.

210. A method for the prognosis of a disease involving MHC recognising cells comprising the steps of
(a) providing a sample suspected comprising MHC recognising cells mounted on a support,
(b) contacting the sample with a MHC molecule as defined in items 187-207, and
(c) determining any binding of the MHC molecule, thereby establishing a prognosis of a disease involving MHC recognising cells.

211. A method for determining the status of a disease involving MHC recognising cells comprising the steps of
(a) providing a sample suspected comprising MHC recognising cells mounted on a support,
(b) contacting the sample with a MHC molecule as defined in items 187-207, and
(c) determining any binding of the MHC molecule, thereby determining the status of a disease involving MHC recognising cells.

212. A method for the diagnosis of a disease involving MHC recognising cells comprising the steps of
(a) providing a sample suspected comprising MHC recognising cells mounted on a support,
(b) contacting the sample with a MHC molecule as defined in items 187-207, and
(c) determining any binding of the MHC molecule, thereby diagnosing a disease involving MHC recognising cells.

213. A method for the effectiveness of a medicament against a disease involving MHC recognising cells comprising the steps of
(a) providing a sample from a subject receiving treatment with a medicament mounted on a support,
(b) contacting the sample with a MHC molecule as defined in items 187-207, and
(c) determining any binding of the MHC molecule, thereby determining the effectiveness of the medicament.

214. The method according to any one of items 208-213, wherein the MHC recognising cells are involved in a disease of inflammatory, auto-immune, allergic, viral, cancerous, infectious, allo- or xenogene (graft-versus-host and host-versus-graft) origin.

215. The method according to item 214, wherein the disease is a chronic inflammatory bowel disease such as Crohn's disease or ulcerative colitis, sclerosis, type I diabetes, rheumatoid arthritis, psoriasis, atopic dermatitis, asthma, malignant melanoma, renal carcinoma, breast cancer, lung cancer, cancer of the uterus, cervical cancer, prostatic cancer, brain cancer, head and neck cancer, leukaemia, cutaneous lymphoma, hepatic carcinoma, colorectal cancer, bladder cancer, rejection-related disease, Graft-versus-host-related disease, or a viral disease associated with hepatitis, AIDS, measles, pox, chicken pox, rubella or herpes.

216. The method according to any one of items 208-214, wherein the MHC recognising cells are selected from sub-populations of CD3+ T-cells, gamma,delta T-cells, alpha, beta T-cells, CD4+ T-cells, T helper cells, CD8+ T-cells, Suppressor T-cells, CD8+ cytotoxic T-cells, CTLs, NK cells, NKT cells, LAK cells, and MAK.

217. The method or use according to any one of items 201-216, wherein the sample is selected from histological material, cytological material, primary tumours, secondary organ metastasis, fine needle aspirates, spleen tissue, bone marrow specimens, cell smears, exfoliative cytological specimens, touch preparations, oral swabs, laryngeal swabs, vaginal swabs, bronchial lavage, gastric lavage, from the umbilical cord, and from body fluids such as blood (e.g. from a peripheral blood mononuclear cell (PBMC) population isolated from blood or from other blood-derived preparations such as R

SEQUENCE LISTING (61730 sequences)

SEQ ID NO: 1 - protein, 74 aa, BK virus
MFCEPKNLVVLRQLSRQASVKVGKTWTGTKKRAQRIFIFILELLLEFCRGEDSVDGKNKSTTALPAVKDSVKDS

SEQ ID NO: 2 - protein, 172 aa, BK virus
MDKVLNREESMELMDLLGLERAAWGNLPLMRKAYLKKCKEFHPDKGGDEDKMKRMNTLYKKMEQDVKVAHQPDFGTWNSSEVCADFPLCPDTLYCKEWPICSKKPSVHCPCMLCQLRLRHLNRKFLRKEPLVWIDCYCIDCFTQWFGLDLTEETLQWWVQIIGETPFRDLKL

SEQ ID NO: 3 - protein, 691 aa, BK virus
MDKVLNREESMELMDLLGLERAAWGNLPLMRKAYLKKCKEFHPDKGGDEDKMKRMNTLYKKMEQDVKVAHQPDFGTWNSSEVPTYGTEEWESWWSSFNEKWDEDLFCHEDMFASDEEATADSQHSTPPKKKRKVEDPKDFPSDLHQFLSQAVFSNRTLACFAVYTTKEKAQILYKKLMEKYSVTFISRHMCAGHNIIFFLTPHRHRVSAINNFCQKLCTFSFLICKGVNKEYLLYSALTRDPYHIIEESIQGGLKEHDFNPEEPEETKQVSWKLITEYAVETKCEDVFLLLGMYLEFQYNVEECKKCQKKDQPYHFKYHEKHFANAIIFAESKNQKSICQQAVDTVLAKKRVDTLHMTREEMLTERFNHILDKMDLIFGAHGNAVLEQYMAGVAWLHCLLPKMDSVIFDFLHCVVFNVPKRRYWLFKGPIDSGKTTLAAGLLDLCGGKALNVNLPMERLTFELGVAIDQYMVVFEDVKGTGAESKDLPSGHGINNLDSLRDYLDGSVKVNLEKKHLNKRTQIFPPGLVTMNEYPVPKTLQARFVRQIDFRPKIYLRKSLQNSEFLLEKRILQSGMTLLLLLIWFRPVADFSKDIQSRIVEWKERLDSEISMYTFSRMKYNICMGKCILDITREEDSETEDSGHGSSTESQSQCSSQVSDTSAPDSENPHSQELHLCKGFQCFKRPKTPPPK

SEQ ID NO: 4 - protein, 362 aa, BK virus
MAPTKRKGECPGAAPKKPKEPVQVPKLLIKGGVEVLEVKTGVDAITEVECFLNPEMGDPDDNLRGYSQHLSAENAFESDSPDRKMLPCYSTARIPLPNLNEDLTCGNLLMWEAVTVKTEVIGITSMLNLHAGSQKVHENGGGKPVQGSNFHFFAVGGDPLEMQGVLMNYRTKYPQGTITPKNPTAQSQVMNTDHKAYLDKNNAYPVECWIPDPSRNENTRYFGTYTGGENVPPVLHVTNTATTVLLDEQGVGPLCKADSLYVSAADICGLFTNSSGTQQWRGLARYFKIRLRKRSVKNPYPISFLLSDLINRRTQKVDGQPMYGMESQVEEVRVFDGTEQLPGDPDMIRYIDRQGQLQTKMV

SEQ ID NO: 5 - protein, 351 aa, BK virus
MGAALALLGDLVASVSEAAAATGFSVAEIAAGEAAAAIEVQIASLATVEGITTTSEAIAAIGLTPQTYAVIAGAPGAIAGFAALIQTVTGISSLAQVGYRFFSDWDHKVSTVGLYQQSGMALELFNPDEYYDILFPGVNTFVNNIQYLDPRHWGPSLFATISQALWHVIRDDIPAITSQELQRRTERFFRDSLARFLEETTWTIVNAPINFYNYIQDYYSNLSPIRPSMVRQVAEREGTHVNFGHTYSIDNADSIEEVTQRMDLRNKESVHSGEFIEKTIAPGGANQRTAPQWMLPLLLGLYGTVTPALEAYEDGPNQKKRRVSRGSSQKAKGTRASAKTTNKRRSRSSRS

SEQ ID NO: 6 - protein, 239 aa, BK virus
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 7 - protein, 8 aa, BK virus
FCKNCKRI

SEQ ID NO: 8 - protein, 8 aa, BK virus
CKNCKRIG

SEQ ID NO: 9 - protein, 8 aa, BK virus
KNCKRIGI

SEQ ID NO: 10 - protein, 8 aa, BK virus
NCKRIGIS

SEQ ID NO: 11 - protein, 8 aa, BK virus
CKRIGISP

SEQ ID NO: 12 - protein, 8 aa, BK virus
KRIGISPN

SEQ ID NO: 13 - protein, 8 aa, BK virus
RIGISPNS

SEQ ID NO: 14 - protein, 8 aa, BK virus
IGISPNSF

SEQ ID NO: 15 - protein, 8 aa, BK virus
GISPNSFA

SEQ ID NO: 16 - protein, 8 aa, BK virus
ISPNSFAR

SEQ ID NO: 17 - protein, 8 aa, BK virus
SPNSFARP

SEQ ID NO: 18 - protein, 8 aa, BK virus
PNSFARPQ

SEQ ID NO: 19 - protein, 8 aa, BK virus
NSFARPQK

SEQ ID NO: 20 - protein, 8 aa, BK virus
SFARPQKK

SEQ ID NO: 21 - protein, 8 aa, BK virus
FARPQKKP

SEQ ID NO: 22 - protein, 8 aa, BK virus
ARPQKKPP

SEQ ID NO: 23 - protein, 8 aa, BK virus
RPQKKPPH

SEQ ID NO: 24 - protein, 8 aa, BK virus
PQKKPPHP

SEQ ID NO: 25 - protein, 8 aa, BK virus
QKKPPHPY

SEQ ID NO: 26 - protein, 8 aa, BK virus
KKPPHPYY

SEQ ID NO: 27 - protein, 8 aa, BK virus
KPPHPYYL

SEQ ID NO: 28 - protein, 8 aa, BK virus
PPHPYYLR

SEQ ID NO: 29 - protein, 8 aa, BK virus
PHPYYLRE

SEQ ID NO: 30 - protein, 8 aa, BK virus
HPYYLRER

SEQ ID NO: 31 - protein, 8 aa, BK virus
PYYLRERV

SEQ ID NO: 32 - protein, 8 aa, BK virus
YYLRERVE

SEQ ID NO: 33 - protein, 8 aa, BK virus
YLRERVEA

SEQ ID NO: 34 - protein, 8 aa, BK virus
LRERVEAE

SEQ ID NO: 35 - protein, 8 aa, BK virus
RERVEAEA

SEQ ID NO: 36 - protein, 8 aa, BK virus
ERVEAEAA

SEQ ID NO: 37 - protein, 8 aa, BK virus
RVEAEAAS

SEQ ID NO: 38 - protein, 8 aa, BK virus
VEAEAASA

SEQ ID NO: 39 - protein, 8 aa, BK virus
EAEAASAS

SEQ ID NO: 40 - protein, 8 aa, BK virus
AEAASASY

SEQ ID NO: 41 - protein, 8 aa, BK virus
EAASASYI

SEQ ID NO: 42 - protein, 8 aa, BK virus
AASASYIL

SEQ ID NO: 43 - protein, 8 aa, BK virus
KKRPQGGA

SEQ ID NO: 44 - protein, 8 aa, BK virus
KRPQGGAA

SEQ ID NO: 45 - protein, 8 aa, BK virus
RPQGGAAY

SEQ ID NO: 46 - protein, 8 aa, BK virus
PQGGAAYP

SEQ ID NO: 47 - protein, 8 aa, BK virus
QGGAAYPW

SEQ ID NO: 48 - protein, 8 aa, BK virus
GGAAYPWN

SEQ ID NO: 49 - protein, 8 aa, BK virus
GAAYPWNA

SEQ ID NO: 50 - protein, 8 aa, BK virus
AAYPWNAA

SEQ ID NO: 51 - protein, 8 aa, BK virus
AYPWNAAK

SEQ ID NO: 52 - protein, 8 aa, BK virus
YPWNAAKP

SEQ ID NO: 53 - protein, 8 aa, BK virus
PQEGKCMT

SEQ ID NO: 54 - protein, 8 aa, BK virus
QEGKCMTH

SEQ ID NO: 55 - protein, 8 aa, BK virus
EGKCMTHR

SEQ ID NO: 56 - protein, 8 aa, BK virus
GKCMTHRG

SEQ ID NO: 57 - protein, 8 aa, BK virus
KCMTHRGM

SEQ ID NO: 58 - protein, 8 aa, BK virus
CMTHRGMQ

SEQ ID NO: 59 - protein, 8 aa, BK virus
MTHRGMQP

SEQ ID NO: 60 - protein, 8 aa, BK virus
THRGMQPN

SEQ ID NO: 61 - protein, 8 aa, BK virus
HRGMQPNH

SEQ ID NO: 62 - protein, 8 aa, BK virus
RGMQPNHD

SEQ ID NO: 63 - protein, 8 aa, BK virus
GMQPNHDL

SEQ ID NO: 64 - protein, 8 aa, BK virus
MQPNHDLR

SEQ ID NO: 65 - protein, 8 aa, BK virus
QPNHDLRK

SEQ ID NO: 66 - protein, 8 aa, BK virus
PNHDLRKE

SEQ ID NO: 67 - protein, 8 aa, BK virus
NHDLRKES

SEQ ID NO: 68 - protein, 8 aa, BK virus
HDLRKESA

SEQ ID NO: 69 - protein, 8 aa, BK virus
LTGRSCLP

SEQ ID NO: 70 - protein, 8 aa, BK virus
TGRSCLPM

SEQ ID NO: 71 - protein, 8 aa, BK virus
GRSCLPME

SEQ ID NO: 72 - protein, 8 aa, BK virus
RSCLPMEC

SEQ ID NO: 73 - protein, 8 aa, BK virus
SCLPMECS

SEQ ID NO: 74 - protein, 8 aa, BK virus
CLPMECSQ

SEQ ID NO: 75 - protein, 8 aa, BK virus
LPMECSQT

SEQ ID NO: 76 - protein, 8 aa, BK virus
PMECSQTM

SEQ ID NO: 77 - protein, 8 aa, BK virus
MECSQTMT

SEQ ID NO: 78 - protein, 8 aa, BK virus
ECSQTMTS

SEQ ID NO: 79 - protein, 8 aa, BK virus
CSQTMTSG

SEQ ID NO: 80 - protein, 8 aa, BK virus
SQTMTSGR

SEQ ID NO: 81 - protein, 8 aa, BK virus
QTMTSGRK

SEQ ID NO: 82 - protein, 8 aa, BK virus
TMTSGRKV

SEQ ID NO: 83 - protein, 8 aa, BK virus
MTSGRKVH

SEQ ID NO: 84 - protein, 8 aa, BK virus
TSGRKVHD

SEQ ID NO: 85 - protein, 8 aa, BK virus
SGRKVHDR

SEQ ID NO: 86 - protein, 8 aa, BK virus
GRKVHDRH

SEQ ID NO: 87 - protein, 8 aa, BK virus
RKVHDRHV

SEQ ID NO: 88 - protein, 8 aa, BK virus
KVHDRHVL

SEQ ID NO: 89 - protein, 8 aa, BK virus
VHDRHVLR

SEQ ID NO: 90 - protein, 8 aa, BK virus
HDRHVLRA

SEQ ID NO: 91 - protein, 8 aa, BK virus
ESWPCPQL

SEQ ID NO: 92 - protein, 8 aa, BK virus
SWPCPQLN

SEQ ID NO: 93 - protein, 8 aa, BK virus
WPCPQLNW

SEQ ID NO: 94 - protein, 8 aa, BK virus
PCPQLNWT

SEQ ID NO: 95 - protein, 8 aa, BK virus
CPQLNWTK

SEQ ID NO: 96 - protein, 8 aa, BK virus
PQLNWTKA

SEQ ID NO: 97 - protein, 8 aa, BK virus
QLNWTKAM

SEQ ID NO: 98 - protein, 8 aa, BK virus
LNWTKAMV

SEQ ID NO: 99 - protein, 8 aa, BK virus
NWTKAMVL

SEQ ID NO: 100 - protein, 8 aa, BK virus
WTKAMVLR

SEQ ID NO: 101 - protein, 8 aa, BK virus
TKAMVLRQ

SEQ ID NO: 102 - protein, 8 aa, BK virus
KAMVLRQL

SEQ ID NO: 103 - protein, 8 aa, BK virus
AMVLRQLS

SEQ ID NO: 104 - protein, 8 aa, BK virus
MVLRQLSR

SEQ ID NO: 105 - protein, 8 aa, BK virus
VLRQLSRQ

SEQ ID NO: 106 - protein, 8 aa, BK virus
LRQLSRQA

SEQ ID NO: 107 - protein, 8 aa, BK virus
RQLSRQAS

SEQ ID NO: 108 - protein, 8 aa, BK virus
QLSRQASV

SEQ ID NO: 109 - protein, 8 aa, BK virus
LSRQASVK

SEQ ID NO: 110 - protein, 8 aa, BK virus
SRQASVKV

SEQ ID NO: 111 - protein, 8 aa, BK virus
RQASVKVG

SEQ ID NO: 112 - protein, 8 aa, BK virus
QASVKVGK

SEQ ID NO: 113 - protein, 8 aa, BK virus
ASVKVGKT

SEQ ID NO: 114 - protein, 8 aa, BK virus
SVKVGKTW

SEQ ID NO: 115 - protein, 8 aa, BK virus
VKVGKTWT

SEQ ID NO: 116 - protein, 8 aa, BK virus
KVGKTWTG

SEQ ID NO: 117 - protein, 8 aa, BK virus
VGKTWTGT

SEQ ID NO: 118 - protein, 8 aa, BK virus
GKTWTGTK

SEQ ID NO: 119 - protein, 8 aa, BK virus
KTWTGTKK

SEQ ID NO: 120 - protein, 8 aa, BK virus
TWTGTKKR

SEQ ID NO: 121 - protein, 8 aa, BK virus
WTGTKKRA

SEQ ID NO: 122 - protein, 8 aa, BK virus
TGTKKRAQ

SEQ ID NO: 123 - protein, 8 aa, BK virus
GTKKRAQR

SEQ ID NO: 124 - protein, 8 aa, BK virus
TKKRAQRI

SEQ ID NO: 125 - protein, 8 aa, BK virus
KKRAQRIF

SEQ ID NO: 126 - protein, 8 aa, BK virus
KRAQRIFI

SEQ ID NO: 127 - protein, 8 aa, BK virus
RAQRIFIF

SEQ ID NO: 128 - protein, 8 aa, BK virus
AQRIFIFI

SEQ ID NO: 129 - protein, 8 aa, BK virus
QRIFIFIL

SEQ ID NO: 130 - protein, 8 aa, BK virus
RIFIFILE

SEQ ID NO: 131 - protein, 8 aa, BK virus
IFIFILEL

SEQ ID NO: 132 - protein, 8 aa, BK virus
FIFILELL

SEQ ID NO: 133 - protein, 8 aa, BK virus
IFILELLL

SEQ ID NO: 134 - protein, 8 aa, BK virus
FILELLLE

SEQ ID NO: 135 - protein, 8 aa, BK virus
ILELLLEF

SEQ ID NO: 136 - protein, 8 aa, BK virus
LELLLEFC

SEQ ID NO: 137 - protein, 8 aa, BK virus
ELLLEFCR

SEQ ID NO: 138 - protein, 8 aa, BK virus
LLLEFCRG

SEQ ID NO: 139 - protein, 8 aa, BK virus
LLEFCRGE

SEQ ID NO: 140 - protein, 8 aa, BK virus
LEFCRGED

SEQ ID NO: 141 - protein, 8 aa, BK virus
EFCRGEDS

SEQ ID NO: 142 - protein, 8 aa, BK virus
FCRGEDSV

SEQ ID NO: 143 - protein, 8 aa, BK virus
CRGEDSVD

SEQ ID NO: 144 - protein, 8 aa, BK virus
RGEDSVDG

SEQ ID NO: 145 - protein, 8 aa, BK virus
GEDSVDGK

SEQ ID NO: 146 - protein, 8 aa, BK virus
EDSVDGKN

SEQ ID NO: 147 - protein, 8 aa, BK virus
DSVDGKNK

SEQ ID NO: 148 - protein, 8 aa, BK virus
SVDGKNKS

SEQ ID NO: 149 - protein, 8 aa, BK virus
VDGKNKST

SEQ ID NO: 150 - protein, 8 aa, BK virus
DGKNKSTT

SEQ ID NO: 151 - protein, 8 aa, BK virus
GKNKSTTA

SEQ ID NO: 152 - protein, 8 aa, BK virus
KNKSTTAL

SEQ ID NO: 153 - protein, 8 aa, BK virus
NKSTTALP

SEQ ID NO: 154 - protein, 8 aa, BK virus
KSTTALPA

SEQ ID NO: 155 - protein, 8 aa, BK virus
STTALPAV

SEQ ID NO: 156 - protein, 8 aa, BK virus
TTALPAVK

SEQ ID NO: 157 - protein, 8 aa, BK virus
TALPAVKD

SEQ ID NO: 158 - protein, 8 aa, BK virus
ALPAVKDS

SEQ ID NO: 159 - protein, 8 aa, BK virus
LPAVKDSV

SEQ ID NO: 160 - protein, 8 aa, BK virus
PAVKDSVK

SEQ ID NO: 161 - protein, 8 aa, BK virus
AVKDSVKD

SEQ ID NO: 162 - protein, 8 aa, BK virus
VKDSVKDS

SEQ ID NO: 163 - protein, 8 aa, BK virus
VSNPFFFV

SEQ ID NO: 164 - protein, 8 aa, BK virus
SNPFFFVF

SEQ ID NO: 165 - protein, 8 aa, BK virus
NPFFFVFP

SEQ ID NO: 166 - protein, 8 aa, BK virus
PFFFVFPG

SEQ ID NO: 167 - protein, 8 aa, BK virus
FFFVFPGS

SEQ ID NO: 168 - protein, 8 aa, BK virus
FFVFPGSW

SEQ ID NO: 169 - protein, 8 aa, BK virus
FVFPGSWV

SEQ ID NO: 170 - protein, 8 aa, BK virus
VFPGSWVL

SEQ ID NO: 171 - protein, 8 aa, BK virus
FPGSWVLL

SEQ ID NO: 172 - protein, 8 aa, BK virus
LPVYLRLL

SEQ ID NO: 173 - protein, 8 aa, BK virus
PVYLRLLL

SEQ ID NO: 174 - protein, 8 aa, BK virus
VYLRLLLP

SEQ ID NO: 175 - protein, 8 aa, BK virus
YLRLLLPQ

SEQ ID NO: 176 - protein, 8 aa, BK virus
LRLLLPQD

SEQ ID NO: 177 - protein, 8 aa, BK virus
RLLLPQDF

SEQ ID NO: 178 - protein, 8 aa, BK virus
LLLPQDFQ

SEQ ID NO: 179 - protein, 8 aa, BK virus
LLPQDFQW

SEQ ID NO: 180 - protein, 8 aa, BK virus
LPQDFQWL

SEQ ID NO: 181 - protein, 8 aa, BK virus
PQDFQWLK

SEQ ID NO: 182 - protein, 8 aa, BK virus
QDFQWLKL

SEQ ID NO: 183 - protein, 8 aa, BK virus
DFQWLKLL

SEQ ID NO: 184 - protein, 8 aa, BK virus
FQWLKLLL

SEQ ID NO: 185 - protein, 8 aa, BK virus
QWLKLLLG

SEQ ID NO: 186 - protein, 8 aa, BK virus
WLKLLLGR

SEQ ID NO: 187 - protein, 8 aa, BK virus
LKLLLGRL

SEQ ID NO: 188 - protein, 8 aa, BK virus
KLLLGRLL

SEQ ID NO: 189 - protein, 8 aa, BK virus
LLLGRLLL

SEQ ID NO: 190 - protein, 8 aa, BK virus
LLGRLLLL

SEQ ID NO: 191 - protein, 8 aa, BK virus
KFKLHPLL

SEQ ID NO: 192 - protein, 8 aa, BK virus
FKLHPLLL

SEQ ID NO: 193 - protein, 8 aa, BK virus
LLVLLGLL

SEQ ID NO: 194 - protein, 8 aa, BK virus
LVLLGLLL

SEQ ID NO: 195 - protein, 8 aa, BK virus
VLLGLLLG

SEQ ID NO: 196 - protein, 8 aa, BK virus
LLGLLLGL

SEQ ID NO: 197 - protein, 8 aa, BK virus
LGLLLGLL

SEQ ID NO: 198 - protein, 8 aa, BK virus
GLLLGLLL

SEQ ID NO: 199 - protein, 8 aa, BK virus
FKLLVVLV

SEQ ID NO: 200 - protein, 8 aa, BK virus
KLLVVLVP

SEQ ID NO: 201 - protein, 8 aa, BK virus
GISSLMIG

SEQ ID NO: 202 - protein, 8 aa, BK virus
ISSLMIGI

SEQ ID NO: 203 - protein, 8 aa, BK virus
SSLMIGIT

SEQ ID NO: 204 - protein, 8 aa, BK virus
SLMIGITK

SEQ ID NO: 205 - protein, 8 aa, BK virus
LMIGITKF

SEQ ID NO: 206 - protein, 8 aa, BK virus
MIGITKFP

SEQ ID NO: 207 - protein, 8 aa, BK virus
IGITKFPL

SEQ ID NO: 208 - protein, 8 aa, BK virus
ASISNQAW

SEQ ID NO: 209 - protein, 8 aa, BK virus
SISNQAWL

SEQ ID NO: 210 - protein, 8 aa, BK virus
ISNQAWLW

SEQ ID NO: 211 - protein, 8 aa, BK virus
SNQAWLWN

SEQ ID NO: 212 - protein, 8 aa, BK virus
NQAWLWNC

SEQ ID NO: 213 - protein, 8 aa, BK virus
QAWLWNCL

SEQ ID NO: 214 - protein, 8 aa, BK virus
AWLWNCLT

SEQ ID NO: 215 - protein, 8 aa, BK virus
WLWNCLTQ

SEQ ID NO: 216 - protein, 8 aa, BK virus
LWNCLTQM

SEQ ID NO: 217 - protein, 8 aa, BK virus
WNCLTQMS

SEQ ID NO: 218 - protein, 8 aa, BK virus
NCLTQMST

SEQ ID NO: 219 - protein, 8 aa, BK virus
CLTQMSTM

SEQ ID NO: 220 - protein, 8 aa, BK virus
LTQMSTMI

SEQ ID NO: 221 - protein, 8 aa, BK virus
TQMSTMIF

SEQ ID NO: 222 - protein, 8 aa, BK virus
QMSTMIFC

SEQ ID NO: 223 - protein, 8 aa, BK virus
MSTMIFCF

SEQ ID NO: 224 - protein, 8 aa, BK virus
STMIFCFL

SEQ ID NO: 225 - protein, 8 aa, BK virus
TMIFCFLV

SEQ ID NO: 226 - protein, 8 aa, BK virus
ILLLIIFN

SEQ ID NO: 227 - protein, 8 aa, BK virus
LLLIIFNT

SEQ ID NO: 228 - protein, 8 aa, BK virus
LLIIFNTL

SEQ ID NO: 229 - protein, 8 aa, BK virus
LIIFNTLI

SEQ ID NO: 230 - protein, 8 aa, BK virus
IIFNTLIL

SEQ ID NO: 231 - protein, 8 aa, BK virus
IFNTLILG

SEQ ID NO: 232 - protein, 8 aa, BK virus
FNTLILGI

SEQ ID NO: 233 - protein, 8 aa, BK virus
NTLILGIG

SEQ ID NO: 234 - protein, 8 aa, BK virus
TLILGIGV

SEQ ID NO: 235 - protein, 8 aa, BK virus
LILGIGVL

SEQ ID NO: 236 - protein, 8 aa, BK virus
ILGIGVLL

SEQ ID NO: 237 - protein, 8 aa, BK virus
LGIGVLLC

SEQ ID NO: 238 - protein, 8 aa, BK virus
GIGVLLCL

SEQ ID NO: 239 - protein, 8 aa, BK virus
IGVLLCLL

SEQ ID NO: 240 - protein, 8 aa, BK virus
GVLLCLLL

SEQ ID NO: 241 - protein, 8 aa, BK virus
VLLCLLLF

SEQ ID NO: 242 - protein, 8 aa, BK virus
LLCLLLFP

SEQ ID NO: 243 - protein, 8 aa, BK virus
LCLLLFPR

SEQ ID NO: 244 - protein, 8 aa, BK virus
CLLLFPRL

SEQ ID NO: 245 - protein, 8 aa, BK virus
LLLFPRLC

SEQ ID NO: 246 - protein, 8 aa, BK virus
LLFPRLCG

SEQ ID NO: 247 - protein, 8 aa, BK virus
LFPRLCGM

SEQ ID NO: 248 - protein, 8 aa, BK virus
FPRLCGML

SEQ ID NO: 249 - protein, 8 aa, BK virus
PRLCGMLL

SEQ ID NO: 250 - protein, 8 aa, BK virus
RLCGMLLG

SEQ ID NO: 251 - protein, 8 aa, BK virus
LCGMLLGM

SEQ ID NO: 252 - protein, 8 aa, BK virus
CGMLLGMI

SEQ ID NO: 253 - protein, 8 aa, BK virus
GMLLGMIY

SEQ ID NO: 254 - protein, 8 aa, BK virus
MLLGMIYL

SEQ ID NO: 255 - protein, 8 aa, BK virus
LLGMIYLL

SEQ ID NO: 256 - protein, 8 aa, BK virus
PHRNCREE

SEQ ID NO: 257 - protein, 8 aa, BK virus
HRNCREEQ

SEQ ID NO: 258 - protein, 8 aa, BK virus
RNCREEQK

SEQ ID NO: 259 - protein, 8 aa, BK virus
NCREEQKD

SEQ ID NO: 260 - protein, 8 aa, BK virus
CREEQKDF

SEQ ID NO: 261 - protein, 8 aa, BK virus
REEQKDFL

SEQ ID NO: 262 - protein, 8 aa, BK virus
EEQKDFLE

SEQ ID NO: 263 - protein, 8 aa, BK virus
EQKDFLET

SEQ ID NO: 264 - protein, 8 aa, BK virus
QKDFLETP

SEQ ID NO: 265 - protein, 8 aa, BK virus
KDFLETPW

SEQ ID NO: 266 - protein, 8 aa, BK virus
DFLETPWL

SEQ ID NO: 267 - protein, 8 aa, BK virus
FLETPWLD

SEQ ID NO: 268 - protein, 8 aa, BK virus
LETPWLDF

SEQ ID NO: 269 - protein, 8 aa, BK virus
ETPWLDFW

SEQ ID NO: 270 - protein, 8 aa, BK virus
TPWLDFWR

SEQ ID NO: 271 - protein, 8 aa, BK virus
PWLDFWRK

SEQ ID NO: 272 - protein, 8 aa, BK virus
WLDFWRKL

SEQ ID NO: 273 - protein, 8 aa, BK virus
LDFWRKLP

SEQ ID NO: 274 - protein, 8 aa, BK virus
DFWRKLPG

SEQ ID NO: 275 - protein, 8 aa, BK virus
FWRKLPGQ

SEQ ID NO: 276 - protein, 8 aa, BK virus
WRKLPGQL

SEQ ID NO: 277 - protein, 8 aa, BK virus
TFIIIFNN

SEQ ID NO: 278 - protein, 8 aa, BK virus
FIIIFNNI

SEQ ID NO: 279 - protein, 8 aa, BK virus
IIIFNNII

SEQ ID NO: 280 - protein, 8 aa, BK virus
IIFNNIIL

SEQ ID NO: 281 - protein, 8 aa, BK virus
IFNNIILI

SEQ ID NO: 282 - protein, 8 aa, BK virus
FNNIILIF

SEQ ID NO: 283 - protein, 8 aa, BK virus
NNIILIFP

SEQ ID NO: 284 - protein, 8 aa, BK virus
NIILIFPL

SEQ ID NO: 285 - protein, 8 aa, BK virus
IILIFPLL

SEQ ID NO: 286 - protein, 8 aa, BK virus
ILIFPLLG

SEQ ID NO: 287 - protein, 8 aa, BK virus
LIFPLLGP

SEQ ID NO: 288 - protein, 8 aa, BK virus
IFPLLGPQ

SEQ ID NO: 289 - protein, 8 aa, BK virus
FPLLGPQW

SEQ ID NO: 290 - protein, 8 aa, BK virus
PLLGPQWL

SEQ ID NO: 291 - protein, 8 aa, BK virus
LLGPQWLD

SEQ ID NO: 292 - protein, 8 aa, BK virus
LGPQWLDK

SEQ ID NO: 293 - protein, 8 aa, BK virus
LKGKVPVY

SEQ ID NO: 294 - protein, 8 aa, BK virus
KGKVPVYI

SEQ ID NO: 295 - protein, 8 aa, BK virus
GKVPVYIL

SEQ ID NO: 296 - protein, 8 aa, BK virus
KVPVYILA

SEQ ID NO: 297 - protein, 8 aa, BK virus
VPVYILAI

SEQ ID NO: 298 - protein, 8 aa, BK virus
PVYILAIL

SEQ ID NO: 299 - protein, 8 aa, BK virus
VYILAILI

SEQ ID NO: 300 - protein, 8 aa, BK virus
YILAILIV

SEQ ID NO: 301 - protein, 8 aa, BK virus
KKLHKEWT

SEQ ID NO: 302 - protein, 8 aa, BK virus
EINKVYIQ

SEQ ID NO: 303 - protein, 8 aa, BK virus
INKVYIQE

SEQ ID NO: 304 - protein, 8 aa, BK virus
NKVYIQES

SEQ ID NO: 305 - protein, 8 aa, BK virus
KVYIQESL

SEQ ID NO: 306 - protein, 8 aa, BK virus
KKLLPQEV

SEQ ID NO: 307 - protein, 8 aa, BK virus
KLLPQEVL

SEQ ID NO: 308 - protein, 8 aa, BK virus
LLPQEVLI

SEQ ID NO: 309 - protein, 8 aa, BK virus
LPQEVLIK

SEQ ID NO: 310 - protein, 8 aa, BK virus
PQEVLIKE

SEQ ID NO: 311 - protein, 8 aa, BK virus
QEVLIKEL

SEQ ID NO: 312 - protein, 8 aa, BK virus
EVLIKELL

SEQ ID NO: 313 - protein, 8 aa, BK virus
VLIKELLL

SEQ ID NO: 314 - protein, 8 aa, BK virus
LIKELLLN

SEQ ID NO: 315 - protein, 8 aa, BK virus
IKELLLNG

SEQ ID NO: 316 - protein, 8 aa, BK virus
KELLLNGC

SEQ ID NO: 317 - protein, 8 aa, BK virus
ELLLNGCC

SEQ ID NO: 318 - protein, 8 aa, BK virus
LLLNGCCL

SEQ ID NO: 319 - protein, 8 aa, BK virus
LLNGCCLY

SEQ ID NO: 320 - protein, 8 aa, BK virus
LNGCCLYF

SEQ ID NO: 321 - protein, 8 aa, BK virus
HLLLKHMK

SEQ ID NO: 322 - protein, 8 aa, BK virus
LLLKHMKM

SEQ ID NO: 323 - protein, 8 aa, BK virus
LLKHMKMA

SEQ ID NO: 324 - protein, 8 aa, BK virus
LKHMKMAP

SEQ ID NO: 325 - protein, 8 aa, BK virus
KHMKMAPT

SEQ ID NO: 326 - protein, 8 aa, BK virus
HMKMAPTK

SEQ ID NO: 327 - protein, 8 aa, BK virus
MKMAPTKR

SEQ ID NO: 328 - protein, 8 aa, BK virus
KMAPTKRK

SEQ ID NO: 329 - protein, 8 aa, BK virus
MAPTKRKG

SEQ ID NO: 330 - protein, 8 aa, BK virus
APTKRKGE

SEQ ID NO: 331 - protein, 8 aa, BK virus
PTKRKGEC

SEQ ID NO: 332 - protein, 8 aa, BK virus
TKRKGECP

SEQ ID NO: 333 - protein, 8 aa, BK virus
KRKGECPG

SEQ ID NO: 334 - protein, 8 aa, BK virus
RKGECPGA

SEQ ID NO: 335 - protein, 8 aa, BK virus
KGECPGAA

SEQ ID NO: 336 - protein, 8 aa, BK virus
GECPGAAP

SEQ ID NO: 337 - protein, 8 aa, BK virus
ECPGAAPK

SEQ ID NO: 338 - protein, 8 aa, BK virus
CPGAAPKK

SEQ ID NO: 339 - protein, 8 aa, BK virus
PGAAPKKP

SEQ ID NO: 340 - protein, 8 aa, BK virus
GAAPKKPK

SEQ ID NO: 341 - protein, 8 aa, BK virus
AAPKKPKE

SEQ ID NO: 342 - protein, 8 aa, BK virus
APKKPKEP

SEQ ID NO: 343 - protein, 8 aa, BK virus
PKKPKEPV

SEQ ID NO: 344 - protein, 8 aa, BK virus
KKPKEPVQ

SEQ ID NO: 345 - protein, 8 aa, BK virus
KPKEPVQV

SEQ ID NO: 346 - protein, 8 aa, BK virus
PKEPVQVP

SEQ ID NO: 347 - protein, 8 aa, BK virus
KEPVQVPK

SEQ ID NO: 348 - protein, 8 aa, BK virus
EPVQVPKL

SEQ ID NO: 349 - protein, 8 aa, BK virus
PVQVPKLL

SEQ ID NO: 350 - protein, 8 aa, BK virus
VQVPKLLI

SEQ ID NO: 351 - protein, 8 aa, BK virus
QVPKLLIK

SEQ ID NO: 352 - protein, 8 aa, BK virus
VPKLLIKG

SEQ ID NO: 353 - protein, 8 aa, BK virus
PKLLIKGG

SEQ ID NO: 354 - protein, 8 aa, BK virus
KLLIKGGV

SEQ ID NO: 355 - protein, 8 aa, BK virus
LLIKGGVE

SEQ ID NO: 356 - protein, 8 aa, BK virus
LIKGGVEV

SEQ ID NO: 357 - protein, 8 aa, BK virus
IKGGVEVL

SEQ ID NO: 358 - protein, 8 aa, BK virus
KGGVEVLE

SEQ ID NO: 359 - protein, 8 aa, BK virus
GGVEVLEV

SEQ ID NO: 360 - protein, 8 aa, BK virus
GVEVLEVK

SEQ ID NO: 361 - protein, 8 aa, BK virus
VEVLEVKT

SEQ ID NO: 362 - protein, 8 aa, BK virus
EVLEVKTG

SEQ ID NO: 363 - protein, 8 aa, BK virus
VLEVKTGV

SEQ ID NO: 364 - protein, 8 aa, BK virus
LEVKTGVD

SEQ ID NO: 365 - protein, 8 aa, BK virus
EVKTGVDA

SEQ ID NO: 366 - protein, 8 aa, BK virus
VKTGVDAI

SEQ ID NO: 367 - protein, 8 aa, BK virus
KTGVDAIT

SEQ ID NO: 368 - protein, 8 aa, BK virus
TGVDAITE

SEQ ID NO: 369 - protein, 8 aa, BK virus
GVDAITEV

SEQ ID NO: 370 - protein, 8 aa, BK virus
VDAITEVE

SEQ ID NO: 371 - protein, 8 aa, BK virus
DAITEVEC

SEQ ID NO: 372 - protein, 8 aa, BK virus
AITEVECF

SEQ ID NO: 373 - protein, 8 aa, BK virus
ITEVECFL

SEQ ID NO: 374 - protein, 8 aa, BK virus
TEVECFLN

SEQ ID NO: 375 - protein, 8 aa, BK virus
EVECFLNP

SEQ ID NO: 376 - protein, 8 aa, BK virus
VECFLNPE

SEQ ID NO: 377 - protein, 8 aa, BK virus
ECFLNPEM

SEQ ID NO: 378 - protein, 8 aa, BK virus
CFLNPEMG

SEQ ID NO: 379 - protein, 8 aa, BK virus
FLNPEMGD

SEQ ID NO: 380 - protein, 8 aa, BK virus
LNPEMGDP

SEQ ID NO: 381 - protein, 8 aa, BK virus
NPEMGDPD

SEQ ID NO: 382 - protein, 8 aa, BK virus
PEMGDPDE

SEQ ID NO: 383 - protein, 8 aa, BK virus
EMGDPDEN

SEQ ID NO: 384 - protein, 8 aa, BK virus
MGDPDENL

SEQ ID NO: 385 - protein, 8 aa, BK virus
GDPDENLR

SEQ ID NO: 386 - protein, 8 aa, BK virus
DPDENLRG

SEQ ID NO: 387 - protein, 8 aa, BK virus
PDENLRGF

SEQ ID NO: 388 - protein, 8 aa, BK virus
DENLRGFS

SEQ ID NO: 389 - protein, 8 aa, BK virus
ENLRGFSL

SEQ ID NO: 390 - protein, 8 aa, BK virus
NLRGFSLK

SEQ ID NO: 391 - protein, 8 aa, BK virus
LRGFSLKL

SEQ ID NO: 392 - protein, 8 aa, BK virus
RGFSLKLS

SEQ ID NO: 393 - protein, 8 aa, BK virus
GFSLKLSA

SEQ ID NO: 394 - protein, 8 aa, BK virus
FSLKLSAE

SEQ ID NO: 395 - protein, 8 aa, BK virus
SLKLSAEN

SEQ ID NO: 396 - protein, 8 aa, BK virus
LKLSAEND

SEQ ID NO: 397 - protein, 8 aa, BK virus
KLSAENDF

SEQ ID NO: 398 - protein, 8 aa, BK virus
LSAENDFS

SEQ ID NO: 399 - protein, 8 aa, BK virus
SAENDFSS

SEQ ID NO: 400 - protein, 8 aa, BK virus
AENDFSSD

SEQ ID NO: 401 - protein, 8 aa, BK virus
ENDFSSDS

SEQ ID NO: 402 - protein, 8 aa, BK virus
NDFSSDSP

SEQ ID NO: 403 - protein, 8 aa, BK virus
DFSSDSPE

SEQ ID NO: 404 - protein, 8 aa, BK virus
FSSDSPER

SEQ ID NO: 405 - protein, 8 aa, BK virus
SSDSPERK

SEQ ID NO: 406 - protein, 8 aa, BK virus
SDSPERKM

SEQ ID NO: 407 - protein, 8 aa, BK virus
DSPERKML

SEQ ID NO: 408 - protein, 8 aa, BK virus
SPERKMLP

SEQ ID NO: 409 - protein, 8 aa, BK virus
PERKMLPC

SEQ ID NO: 410 - protein, 8 aa, BK virus
ERKMLPCY

SEQ ID NO: 411 - protein, 8 aa, BK virus
RKMLPCYS

SEQ ID NO: 412 - protein, 8 aa, BK virus
KMLPCYST

SEQ ID NO: 413 - protein, 8 aa, BK virus
MLPCYSTA

SEQ ID NO: 414 - protein, 8 aa, BK virus
LPCYSTAR

SEQ ID NO: 415 - protein, 8 aa, BK virus
PCYSTARI

SEQ ID NO: 416 - protein, 8 aa, BK virus
CYSTARIP

SEQ ID NO: 417 - protein, 8 aa, BK virus
YSTARIPL

SEQ ID NO: 418 - protein, 8 aa, BK virus
STARIPLP

SEQ ID NO: 419 - protein, 8 aa, BK virus
TARIPLPN

SEQ ID NO: 420 - protein, 8 aa, BK virus
ARIPLPNL

SEQ ID NO: 421 - protein, 8 aa, BK virus
RIPLPNLN

SEQ ID NO: 422 - protein, 8 aa, BK virus
IPLPNLNE

SEQ ID NO: 423 - protein, 8 aa, BK virus
PLPNLNED

SEQ ID NO: 424 - protein, 8 aa, BK virus
LPNLNEDL

SEQ ID NO: 425 - protein, 8 aa, BK virus
PNLNEDLT

SEQ ID NO: 426 - protein, 8 aa, BK virus
NLNEDLTC

SEQ ID NO: 427 - protein, 8 aa, BK virus
LNEDLTCG

SEQ ID NO: 428 - protein, 8 aa, BK virus
NEDLTCGN

SEQ ID NO: 429 - protein, 8 aa, BK virus
EDLTCGNL

SEQ ID NO: 430 - protein, 8 aa, BK virus
DLTCGNLL

SEQ ID NO: 431 - protein, 8 aa, BK virus
LTCGNLLM

SEQ ID NO: 432 - protein, 8 aa, BK virus
TCGNLLMW

SEQ ID NO: 433 - protein, 8 aa, BK virus
CGNLLMWE

SEQ ID NO: 434 - protein, 8 aa, BK virus
GNLLMWEA

SEQ ID NO: 435 - protein, 8 aa, BK virus
NLLMWEAV

SEQ ID NO: 436 - protein, 8 aa, BK virus
LLMWEAVT

SEQ ID NO: 437 - protein, 8 aa, BK virus
LMWEAVTV

SEQ ID NO: 438 - protein, 8 aa, BK virus
MWEAVTVQ

SEQ ID NO: 439 - protein, 8 aa, BK virus
WEAVTVQT

SEQ ID NO: 440 - protein, 8 aa, BK virus
EAVTVQTE

SEQ ID NO: 441 - protein, 8 aa, BK virus
AVTVQTEV

SEQ ID NO: 442 - protein, 8 aa, BK virus
VTVQTEVI

SEQ ID NO: 443 - protein, 8 aa, BK virus
TVQTEVIG

SEQ ID NO: 444 - protein, 8 aa, BK virus
VQTEVIGI

SEQ ID NO: 445 - protein, 8 aa, BK virus
QTEVIGIT

SEQ ID NO: 446 - protein, 8 aa, BK virus
TEVIGITS

SEQ ID NO: 447 - protein, 8 aa, BK virus
EVIGITSM

SEQ ID NO: 448 - protein, 8 aa, BK virus
VIGITSML

SEQ ID NO: 449 - protein, 8 aa, BK virus
IGITSMLN

SEQ ID NO: 450 - protein, 8 aa, BK virus
GITSMLNL

SEQ ID NO: 451 - protein, 8 aa, BK virus
ITSMLNLH

SEQ ID NO: 452 - protein, 8 aa, BK virus
TSMLNLHA

SEQ ID NO: 453 - protein, 8 aa, BK virus
SMLNLHAG

SEQ ID NO: 454 - protein, 8 aa, BK virus
MLNLHAGS

SEQ ID NO: 455 - protein, 8 aa, BK virus
LNLHAGSQ

SEQ ID NO: 456 - protein, 8 aa, BK virus
NLHAGSQK

SEQ ID NO: 457 - protein, 8 aa, BK virus
LHAGSQKV

SEQ ID NO: 458 - protein, 8 aa, BK virus
HAGSQKVH

SEQ ID NO: 459 - protein, 8 aa, BK virus
AGSQKVHE

SEQ ID NO: 460 - protein, 8 aa, BK virus
GSQKVHEH

SEQ ID NO: 461 - protein, 8 aa, BK virus
SQKVHEHG

SEQ ID NO: 462 - protein, 8 aa, BK virus
QKVHEHGG

SEQ ID NO: 463 - protein, 8 aa, BK virus
KVHEHGGG

SEQ ID NO: 464 - protein, 8 aa, BK virus
VHEHGGGK

SEQ ID NO: 465 - protein, 8 aa, BK virus
HEHGGGKP

SEQ ID NO: 466 - protein, 8 aa, BK virus
EHGGGKPI

SEQ ID NO: 467 - protein, 8 aa, BK virus
HGGGKPIQ

SEQ ID NO: 468 - protein, 8 aa, BK virus
GGGKPIQG

SEQ ID NO: 469 - protein, 8 aa, BK virus
GGKPIQGS

SEQ ID NO: 470 - protein, 8 aa, BK virus
GKPIQGSN

SEQ ID NO: 471 - protein, 8 aa, BK virus
KPIQGSNF

SEQ ID NO: 472 - protein, 8 aa, BK virus
PIQGSNFH

SEQ ID NO: 473 - protein, 8 aa, BK virus
IQGSNFHF

SEQ ID NO: 474 - protein, 8 aa, BK virus
QGSNFHFF

SEQ ID NO: 475 - protein, 8 aa, BK virus
GSNFHFFA

SEQ ID NO: 476 - protein, 8 aa, BK virus
SNFHFFAV

SEQ ID NO: 477 - protein, 8 aa, BK virus
NFHFFAVG

SEQ ID NO: 478 - protein, 8 aa, BK virus
FHFFAVGG

SEQ ID NO: 479 - protein, 8 aa, BK virus
HFFAVGGE

SEQ ID NO: 480 - protein, 8 aa, BK virus
FFAVGGEP

SEQ ID NO: 481 - protein, 8 aa, BK virus
FAVGGEPL

SEQ ID NO: 482 - protein, 8 aa, BK virus
AVGGEPLE

SEQ ID NO: 483 - protein, 8 aa, BK virus
VGGEPLEM

SEQ ID NO: 484 - protein, 8 aa, BK virus
GGEPLEMQ

SEQ ID NO: 485 - protein, 8 aa, BK virus
GEPLEMQG

SEQ ID NO: 486 - protein, 8 aa, BK virus
EPLEMQGV

SEQ ID NO: 487 - protein, 8 aa, BK virus
PLEMQGVL

SEQ ID NO: 488 - protein, 8 aa, BK virus
LEMQGVLM

SEQ ID NO: 489 - protein, 8 aa, BK virus
EMQGVLMN

SEQ ID NO: 490 - protein, 8 aa, BK virus
MQGVLMNY

SEQ ID NO: 491 - protein, 8 aa, BK virus
QGVLMNYR

SEQ ID NO: 492 - protein, 8 aa, BK virus
GVLMNYRS

SEQ ID NO: 493 - protein, 8 aa, BK virus
VLMNYRSK

SEQ ID NO: 494 - protein, 8 aa, BK virus
LMNYRSKY

SEQ ID NO: 495 - protein, 8 aa, BK virus
MNYRSKYP

SEQ ID NO: 496 - protein, 8 aa, BK virus
NYRSKYPD

SEQ ID NO: 497 - protein, 8 aa, BK virus
YRSKYPDG

SEQ ID NO: 498 - protein, 8 aa, BK virus
RSKYPDGT

SEQ ID NO: 499 - protein, 8 aa, BK virus
SKYPDGTI

SEQ ID NO: 500 - protein, 8 aa, BK virus
KYPDGTIT

SEQ ID NO: 501 - protein, 8 aa, BK virus
YPDGTITP

SEQ ID NO: 502 - protein, 8 aa, BK virus
PDGTITPK

SEQ ID NO: 503 - protein, 8 aa, BK virus
DGTITPKN

SEQ ID NO: 504 - protein, 8 aa, BK virus
GTITPKNP

SEQ ID NO: 505 - protein, 8 aa, BK virus
TITPKNPT

SEQ ID NO: 506 - protein, 8 aa, BK virus
ITPKNPTA

SEQ ID NO: 507 - protein, 8 aa, BK virus
TPKNPTAQ

SEQ ID NO: 508 - protein, 8 aa, BK virus
PKNPTAQS

SEQ ID NO: 509 - protein, 8 aa, BK virus
KNPTAQSQ

SEQ ID NO: 510 - protein, 8 aa, BK virus
NPTAQSQV

SEQ ID NO: 511 - protein, 8 aa, BK virus
PTAQSQVM

SEQ ID NO: 512 - protein, 8 aa, BK virus
TAQSQVMN

SEQ ID NO: 513 - protein, 8 aa, BK virus
AQSQVMNT

SEQ ID NO: 514 - protein, 8 aa, BK virus
QSQVMNTD

SEQ ID NO: 515 - protein, 8 aa, BK virus
SQVMNTDH

SEQ ID NO: 516 - protein, 8 aa, BK virus
QVMNTDHK

SEQ ID NO: 517 - protein, 8 aa, BK virus
VMNTDHKA

SEQ ID NO: 518 - protein, 8 aa, BK virus
MNTDHKAY

SEQ ID NO: 519 - protein, 8 aa, BK virus
NTDHKAYL

SEQ ID NO: 520 - protein, 8 aa, BK virus
TDHKAYLD

SEQ ID NO: 521 - protein, 8 aa, BK virus
DHKAYLDK

SEQ ID NO: 522 - protein, 8 aa, BK virus
HKAYLDKN

SEQ ID NO: 523 - protein, 8 aa, BK virus
KAYLDKNN

SEQ ID NO: 524 - protein, 8 aa, BK virus
AYLDKNNA

SEQ ID NO: 525 - protein, 8 aa, BK virus
YLDKNNAY

SEQ ID NO: 526 - protein, 8 aa, BK virus
LDKNNAYP

SEQ ID NO: 527 - protein, 8 aa, BK virus
DKNNAYPV

SEQ ID NO: 528 - protein, 8 aa, BK virus
KNNAYPVE

SEQ ID NO: 529 - protein, 8 aa, BK virus
NNAYPVEC

SEQ ID NO: 530 - protein, 8 aa, BK virus
NAYPVECW

SEQ ID NO: 531 - protein, 8 aa, BK virus
AYPVECWV

SEQ ID NO: 532 - protein, 8 aa, BK virus
YPVECWVP

SEQ ID NO: 533 - protein, 8 aa, BK virus
PVECWVPD

SEQ ID NO: 534 - protein, 8 aa, BK virus
VECWVPDP

SEQ ID NO: 535 - protein, 8 aa, BK virus
ECWVPDPS

SEQ ID NO: 536 - protein, 8 aa, BK virus
CWVPDPSR

SEQ ID NO: 537 - protein, 8 aa, BK virus
WVPDPSRN

SEQ ID NO: 538 - protein, 8 aa, BK virus
VPDPSRNE

SEQ ID NO: 539 - protein, 8 aa, BK virus
PDPSRNEN

SEQ ID NO: 540 - protein, 8 aa, BK virus
DPSRNENA

SEQ ID NO: 541 - protein, 8 aa, BK virus
PSRNENAR

SEQ ID NO: 542 - protein, 8 aa, BK virus
SRNENARY

SEQ ID NO: 543 - protein, 8 aa, BK virus
RNENARYF

SEQ ID NO: 544 - protein, 8 aa, BK virus
NENARYFG

SEQ ID NO: 545 - protein, 8 aa, BK virus
ENARYFGT

SEQ ID NO: 546 - protein, 8 aa, BK virus
NARYFGTF

SEQ ID NO: 547 - protein, 8 aa, BK virus
ARYFGTFT

SEQ ID NO: 548 - protein, 8 aa, BK virus
RYFGTFTG

SEQ ID NO: 549 - protein, 8 aa, BK virus
YFGTFTGG

SEQ ID NO: 550 - protein, 8 aa, BK virus
FGTFTGGE

SEQ ID NO: 551 - protein, 8 aa, BK virus
GTFTGGEN

SEQ ID NO: 552 - protein, 8 aa, BK virus
TFTGGENV

SEQ ID NO: 553 - protein, 8 aa, BK virus
FTGGENVP

SEQ ID NO: 554 - protein, 8 aa, BK virus
TGGENVPP

SEQ ID NO: 555 - protein, 8 aa, BK virus
GGENVPPV

SEQ ID NO: 556 - protein, 8 aa, BK virus
GENVPPVL

SEQ ID NO: 557 - protein, 8 aa, BK virus
ENVPPVLH

SEQ ID NO: 558 - protein, 8 aa, BK virus
NVPPVLHV

SEQ ID NO: 559 - protein, 8 aa, BK virus
VPPVLHVT

SEQ ID NO: 560 - protein, 8 aa, BK virus
PPVLHVTN

SEQ ID NO: 561 - protein, 8 aa, BK virus
PVLHVTNT

SEQ ID NO: 562 - protein, 8 aa, BK virus
VLHVTNTA

SEQ ID NO: 563 - protein, 8 aa, BK virus
LHVTNTAT

SEQ ID NO: 564 - protein, 8 aa, BK virus
HVTNTATT

SEQ ID NO: 565 - protein, 8 aa, BK virus
VTNTATTV

SEQ ID NO: 566 - protein, 8 aa, BK virus
TNTATTVL

SEQ ID NO: 567 - protein, 8 aa, BK virus
NTATTVLL

SEQ ID NO: 568 - protein, 8 aa, BK virus
TATTVLLD

SEQ ID NO: 569 - protein, 8 aa, BK virus
ATTVLLDE

SEQ ID NO: 570 - protein, 8 aa, BK virus
TTVLLDEQ

SEQ ID NO: 571 - protein, 8 aa, BK virus
TVLLDEQG

SEQ ID NO: 572 - protein, 8 aa, BK virus
VLLDEQGV

SEQ ID NO: 573 - protein, 8 aa, BK virus
LLDEQGVG

SEQ ID NO: 574 - protein, 8 aa, BK virus
LDEQGVGP

SEQ ID NO: 575 - protein, 8 aa, BK virus
DEQGVGPL

SEQ ID NO: 576 - protein, 8 aa, BK virus
EQGVGPLC

SEQ ID NO: 577 - protein, 8 aa, BK virus
QGVGPLCK

SEQ ID NO: 578 - protein, 8 aa, BK virus
GVGPLCKA

SEQ ID NO: 579 - protein, 8 aa, BK virus
VGPLCKAD

SEQ ID NO: 580 - protein, 8 aa, BK virus
GPLCKADS

SEQ ID NO: 581 - protein, 8 aa, BK virus
PLCKADSL

SEQ ID NO: 582 - protein, 8 aa, BK virus
LCKADSLY

SEQ ID NO: 583 - protein, 8 aa, BK virus
CKADSLYV

SEQ ID NO: 584 - protein, 8 aa, BK virus
KADSLYVS

SEQ ID NO: 585 - protein, 8 aa, BK virus
ADSLYVSA

SEQ ID NO: 586 - protein, 8 aa, BK virus
DSLYVSAA

SEQ ID NO: 587 - protein, 8 aa, BK virus
SLYVSAAD

SEQ ID NO: 588 - protein, 8 aa, BK virus
LYVSAADI

SEQ ID NO: 589 - protein, 8 aa, BK virus
YVSAADIC

SEQ ID NO: 590 - protein, 8 aa, BK virus
VSAADICG

SEQ ID NO: 591 - protein, 8 aa, BK virus
SAADICGL

SEQ ID NO: 592 - protein, 8 aa, BK virus
AADICGLF

SEQ ID NO: 593 - protein, 8 aa, BK virus
ADICGLFT

SEQ ID NO: 594 - protein, 8 aa, BK virus
DICGLFTN

SEQ ID NO: 595 - protein, 8 aa, BK virus
ICGLFTNS

SEQ ID NO: 596 - protein, 8 aa, BK virus
CGLFTNSS

SEQ ID NO: 597 - protein, 8 aa, BK virus
GLFTNSSG

SEQ ID NO: 598 - protein, 8 aa, BK virus
LFTNSSGT

SEQ ID NO: 599 - protein, 8 aa, BK virus
FTNSSGTQ

SEQ ID NO: 600 - protein, 8 aa, BK virus
TNSSGTQQ

SEQ ID NO: 601 - protein, 8 aa, BK virus
NSSGTQQW

SEQ ID NO: 602 - protein, 8 aa, BK virus
SSGTQQWR

SEQ ID NO: 603 - protein, 8 aa, BK virus
SGTQQWRG

SEQ ID NO: 604 - protein, 8 aa, BK virus
GTQQWRGL

SEQ ID NO: 605 - protein, 8 aa, BK virus
TQQWRGLA

SEQ ID NO: 606 - protein, 8 aa, BK virus
QQWRGLAR

SEQ ID NO: 607 - protein, 8 aa, BK virus
QWRGLARY

SEQ ID NO: 608 - protein, 8 aa, BK virus
WRGLARYF

SEQ ID NO: 609 - protein, 8 aa, BK virus
RGLARYFK

SEQ ID NO: 610 - protein, 8 aa, BK virus
GLARYFKI

SEQ ID NO: 611 - protein, 8 aa, BK virus
LARYFKIR

SEQ ID NO: 612 - protein, 8 aa, BK virus
ARYFKIRL

SEQ ID NO: 613 - protein, 8 aa, BK virus
RYFKIRLR

SEQ ID NO: 614 - protein, 8 aa, BK virus
YFKIRLRK

SEQ ID NO: 615 - protein, 8 aa, BK virus
FKIRLRKR

SEQ ID NO: 616 - protein, 8 aa, BK virus
KIRLRKRS

SEQ ID NO: 617 - protein, 8 aa, BK virus
IRLRKRSV

SEQ ID NO: 618 - protein, 8 aa, BK virus
RLRKRSVK

SEQ ID NO: 619 - protein, 8 aa, BK virus
LRKRSVKN

SEQ ID NO: 620 - protein, 8 aa, BK virus
RKRSVKNP

SEQ ID NO: 621 - protein, 8 aa, BK virus
KRSVKNPY

SEQ ID NO: 622 - protein, 8 aa, BK virus
RSVKNPYP

SEQ ID NO: 623 - protein, 8 aa, BK virus
SVKNPYPI

SEQ ID NO: 624 - protein, 8 aa, BK virus
VKNPYPIS

SEQ ID NO: 625 - protein, 8 aa, BK virus
KNPYPISF

SEQ ID NO: 626 - protein, 8 aa, BK virus
NPYPISFL

SEQ ID NO: 627 - protein, 8 aa, BK virus
PYPISFLL

SEQ ID NO: 628 - protein, 8 aa, BK virus
YPISFLLS

SEQ ID NO: 629 - protein, 8 aa, BK virus
PISFLLSD

SEQ ID NO: 630 - protein, 8 aa, BK virus
ISFLLSDL

SEQ ID NO: 631 - protein, 8 aa, BK virus
SFLLSDLI

SEQ ID NO: 632 - protein, 8 aa, BK virus
FLLSDLIN

SEQ ID NO: 633 - protein, 8 aa, BK virus
LLSDLINR

SEQ ID NO: 634 - protein, 8 aa, BK virus
LSDLINRR

SEQ ID NO: 635 - protein, 8 aa, BK virus
SDLINRRT

SEQ ID NO: 636 - protein, 8 aa, BK virus
DLINRRTQ

SEQ ID NO: 637 - protein, 8 aa, BK virus
LINRRTQR

SEQ ID NO: 638 - protein, 8 aa, BK virus
INRRTQRV

SEQ ID NO: 639 - protein, 8 aa, BK virus
NRRTQRVD

SEQ ID NO: 640 - protein, 8 aa, BK virus
RRTQRVDG

SEQ ID NO: 641 - protein, 8 aa, BK virus
RTQRVDGQ

SEQ ID NO: 642 - protein, 8 aa, BK virus
TQRVDGQP

SEQ ID NO: 643 - protein, 8 aa, BK virus
QRVDGQPM

SEQ ID NO: 644 - protein, 8 aa, BK virus
RVDGQPMY

SEQ ID NO: 645 - protein, 8 aa, BK virus
VDGQPMYG

SEQ ID NO: 646 - protein, 8 aa, BK virus
DGQPMYGM

SEQ ID NO: 647 - protein, 8 aa, BK virus
GQPMYGME

SEQ ID NO: 648 - protein, 8 aa, BK virus
QPMYGMES

SEQ ID NO: 649 - protein, 8 aa, BK virus
PMYGMESQ

SEQ ID NO: 650 - protein, 8 aa, BK virus
MYGMESQV

SEQ ID NO: 651 - protein, 8 aa, BK virus
YGMESQVE

SEQ ID NO: 652 - protein, 8 aa, BK virus
GMESQVEE

SEQ ID NO: 653 - protein, 8 aa, BK virus
MESQVEEV

SEQ ID NO: 654 - protein, 8 aa, BK virus
ESQVEEVR

SEQ ID NO: 655 - protein, 8 aa, BK virus
SQVEEVRV

SEQ ID NO: 656 - protein, 8 aa, BK virus
QVEEVRVF

SEQ ID NO: 657 - protein, 8 aa, BK virus
VEEVRVFD

SEQ ID NO: 658 - protein, 8 aa, BK virus
EEVRVFDG

SEQ ID NO: 659 - protein, 8 aa, BK virus
EVRVFDGT

SEQ ID NO: 660 - protein, 8 aa, BK virus
VRVFDGTE

SEQ ID NO: 661 - protein, 8 aa, BK virus
RVFDGTER

SEQ ID NO: 662 - protein, 8 aa, BK virus
VFDGTERL

SEQ ID NO: 663 - protein, 8 aa, BK virus
FDGTERLP

SEQ ID NO: 664 - protein, 8 aa, BK virus
DGTERLPG

SEQ ID NO: 665 - protein, 8 aa, BK virus
GTERLPGD

SEQ ID NO: 666 - protein, 8 aa, BK virus
TERLPGDP

SEQ ID NO: 667 - protein, 8 aa, BK virus
ERLPGDPD

SEQ ID NO: 668 - protein, 8 aa, BK virus
RLPGDPDM

SEQ ID NO: 669 - protein, 8 aa, BK virus
LPGDPDMI

SEQ ID NO: 670 - protein, 8 aa, BK virus
PGDPDMIR

SEQ ID NO: 671 - protein, 8 aa, BK virus
GDPDMIRY

SEQ ID NO: 672 - protein, 8 aa, BK virus
DPDMIRYI

SEQ ID NO: 673 - protein, 8 aa, BK virus
PDMIRYID

SEQ ID NO: 674 - protein, 8 aa, BK virus
DMIRYIDK

SEQ ID NO: 675 - protein, 8 aa, BK virus
MIRYIDKQ

SEQ ID NO: 676 - protein, 8 aa, BK virus
IRYIDKQG

SEQ ID NO: 677 - protein, 8 aa, BK virus
RYIDKQGQ

SEQ ID NO: 678 - protein, 8 aa, BK virus
YIDKQGQL

SEQ ID NO: 679 - protein, 8 aa, BK virus
IDKQGQLQ

SEQ ID NO: 680 - protein, 8 aa, BK virus
DKQGQLQT

SEQ ID NO: 681 - protein, 8 aa, BK virus
KQGQLQTK

SEQ ID NO: 682 - protein, 8 aa, BK virus
QGQLQTKM

SEQ ID NO: 683 - protein, 8 aa, BK virus
GQLQTKML

SEQ ID NO: 684 - protein, 8 aa, BK virus
TGAFIVHI

SEQ ID NO: 685 - protein, 8 aa, BK virus
GAFIVHIH

SEQ ID NO: 686 - protein, 8 aa, BK virus
AFIVHIHL

SEQ ID NO: 687 - protein, 8 aa, BK virus
FIVHIHLI

SEQ ID NO: 688 - protein, 8 aa, BK virus
IVHIHLIN

SEQ ID NO: 689 - protein, 8 aa, BK virus
VHIHLINA

SEQ ID NO: 690 - protein, 8 aa, BK virus
HIHLINAA

SEQ ID NO: 691 - protein, 8 aa, BK virus
IHLINAAF

SEQ ID NO: 692 - protein, 8 aa, BK virus
HLINAAFV

SEQ ID NO: 693 - protein, 8 aa, BK virus
ATFKLVLF

SEQ ID NO: 694 - protein, 8 aa, BK virus
TFKLVLFW

SEQ ID NO: 695 - protein, 8 aa, BK virus
FKLVLFWG

SEQ ID NO: 696 - protein, 8 aa, BK virus
KLVLFWGW

SEQ ID NO: 697 - protein, 8 aa, BK virus
LVLFWGWC

SEQ ID NO: 698 - protein, 8 aa, BK virus
VLFWGWCF

SEQ ID NO: 699 - protein, 8 aa, BK virus
LFWGWCFR

SEQ ID NO: 700 - protein, 8 aa, BK virus
FWGWCFRP

SEQ ID NO: 701 - protein, 8 aa, BK virus
WGWCFRPF

SEQ ID NO: 702 - protein, 8 aa, BK virus
GWCFRPFK

SEQ ID NO: 703 - protein, 8 aa, BK virus
WCFRPFKT

SEQ ID NO: 704 - protein, 8 aa, BK virus
CFRPFKTL

SEQ ID NO: 705 - protein, 8 aa, BK virus
FRPFKTLK

SEQ ID NO: 706 - protein, 8 aa, BK virus
RPFKTLKA

SEQ ID NO: 707 - protein, 8 aa, BK virus
PFKTLKAF

SEQ ID NO: 708 - protein, 8 aa, BK virus
FKTLKAFT

SEQ ID NO: 709 - protein, 8 aa, BK virus
KTLKAFTQ

SEQ ID NO: 710 - protein, 8 aa, BK virus
TLKAFTQM

SEQ ID NO: 711 - protein, 8 aa, BK virus
LKAFTQMQ

SEQ ID NO: 712 - protein, 8 aa, BK virus
KAFTQMQL

SEQ ID NO: 713 - protein, 8 aa, BK virus
AFTQMQLL

SEQ ID NO: 714 - protein, 8 aa, BK virus
FTQMQLLT

SEQ ID NO: 715 - protein, 8 aa, BK virus
TQMQLLTM

SEQ ID NO: 716 - protein, 8 aa, BK virus
QMQLLTMG

SEQ ID NO: 717 - protein, 8 aa, BK virus
MQLLTMGV

SEQ ID NO: 718 - protein, 8 aa, BK virus
PLGIFSRG

SEQ ID NO: 719 - protein, 8 aa, BK virus
SMSRVFSF

SEQ ID NO: 720 - protein, 8 aa, BK virus
ILFSCNIK

SEQ ID NO: 721 - protein, 8 aa, BK virus
LFSCNIKN

SEQ ID NO: 722 - protein, 8 aa, BK virus
FSCNIKNT

SEQ ID NO: 723 - protein, 8 aa, BK virus
SCNIKNTF

SEQ ID NO: 724 - protein, 8 aa, BK virus
CNIKNTFP

SEQ ID NO: 725 - protein, 8 aa, BK virus
NIKNTFPH

SEQ ID NO: 726 - protein, 8 aa, BK virus
IKNTFPHA

SEQ ID NO: 727 - protein, 8 aa, BK virus
KNTFPHAY

SEQ ID NO: 728 - protein, 8 aa, BK virus
NTFPHAYI

SEQ ID NO: 729 - protein, 8 aa, BK virus
TFPHAYII

SEQ ID NO: 730 - protein, 8 aa, BK virus
FPHAYIIF

SEQ ID NO: 731 - protein, 8 aa, BK virus
PHAYIIFH

SEQ ID NO: 732 - protein, 8 aa, BK virus
HAYIIFHP

SEQ ID NO: 733 - protein, 8 aa, BK virus
KSIHTYLR

SEQ ID NO: 734 - protein, 8 aa, BK virus
SIHTYLRI

SEQ ID NO: 735 - protein, 8 aa, BK virus
IHTYLRIQ

SEQ ID NO: 736 - protein, 8 aa, BK virus
HTYLRIQP

SEQ ID NO: 737 - protein, 8 aa, BK virus
TYLRIQPF

SEQ ID NO: 738 - protein, 8 aa, BK virus
YLRIQPFL

SEQ ID NO: 739 - protein, 8 aa, BK virus
LRIQPFLP

SEQ ID NO: 740 - protein, 8 aa, BK virus
RIQPFLPF

SEQ ID NO: 741 - protein, 8 aa, BK virus
IQPFLPFN

SEQ ID NO: 742 - protein, 8 aa, BK virus
QPFLPFNN

SEQ ID NO: 743 - protein, 8 aa, BK virus
PFLPFNNS

SEQ ID NO: 744 - protein, 8 aa, BK virus
FLPFNNSR

SEQ ID NO: 745 - protein, 8 aa, BK virus
LPFNNSRL

SEQ ID NO: 746 - protein, 8 aa, BK virus
PFNNSRLY

SEQ ID NO: 747 - protein, 8 aa, BK virus
FNNSRLYI

SEQ ID NO: 748 - protein, 8 aa, BK virus
NNSRLYIS

SEQ ID NO: 749 - protein, 8 aa, BK virus
NSRLYISC

SEQ ID NO: 750 - protein, 8 aa, BK virus
SRLYISCK

SEQ ID NO: 751 - protein, 8 aa, BK virus
RLYISCKI

SEQ ID NO: 752 - protein, 8 aa, BK virus
LYISCKIS

SEQ ID NO: 753 - protein, 8 aa, BK virus
YISCKISY

SEQ ID NO: 754 - protein, 8 aa, BK virus
ISCKISYR

SEQ ID NO: 755 - protein, 8 aa, BK virus
SCKISYRP

SEQ ID NO: 756 - protein, 8 aa, BK virus
CKISYRPK

SEQ ID NO: 757 - protein, 8 aa, BK virus
KISYRPKP

SEQ ID NO: 758 - protein, 8 aa, BK virus
ISYRPKPN

SEQ ID NO: 759 - protein, 8 aa, BK virus
IYFGPKIY

SEQ ID NO: 760 - protein, 8 aa, BK virus
YFGPKIYL

SEQ ID NO: 761 - protein, 8 aa, BK virus
FGPKIYLS

SEQ ID NO: 762 - protein, 8 aa, BK virus
GPKIYLSY

SEQ ID NO: 763 - protein, 8 aa, BK virus
PKIYLSYK

SEQ ID NO: 764 - protein, 8 aa, BK virus
KIYLSYKS

SEQ ID NO: 765 - protein, 8 aa, BK virus
IYLSYKSS

SEQ ID NO: 766 - protein, 8 aa, BK virus
YLSYKSSL

SEQ ID NO: 767 - protein, 8 aa, BK virus
LSYKSSLQ

SEQ ID NO: 768 - protein, 8 aa, BK virus
SYKSSLQG

SEQ ID NO: 769 - protein, 8 aa, BK virus
YKSSLQGF

SEQ ID NO: 770 - protein, 8 aa, BK virus
KSSLQGFR

SEQ ID NO: 771 - protein, 8 aa, BK virus
SSLQGFRD

SEQ ID NO: 772 - protein, 8 aa, BK virus
SLQGFRDR

SEQ ID NO: 773 - protein, 8 aa, BK virus
LQGFRDRI

SEQ ID NO: 774 - protein, 8 aa, BK virus
QGFRDRIL

SEQ ID NO: 775 - protein, 8 aa, BK virus
GFRDRILI

SEQ ID NO: 776 - protein, 8 aa, BK virus
FRDRILIH

SEQ ID NO: 777 - protein, 8 aa, BK virus
RDRILIHC

SEQ ID NO: 778 - protein, 8 aa, BK virus
DRILIHCN

SEQ ID NO: 779 - protein, 8 aa, BK virus
RILIHCNQ

SEQ ID NO: 780 - protein, 8 aa, BK virus
ILIHCNQA

SEQ ID NO: 781 - protein, 8 aa, BK virus
LIHCNQAW

SEQ ID NO: 782 - protein, 8 aa, BK virus
IHCNQAWW

SEQ ID NO: 783 - protein, 8 aa, BK virus
HCNQAWWK

SEQ ID NO: 784 - protein, 8 aa, BK virus
CNQAWWKY

SEQ ID NO: 785 - protein, 8 aa, BK virus
NQAWWKYL

SEQ ID NO: 786 - protein, 8 aa, BK virus
QAWWKYLG

SEQ ID NO: 787 - protein, 8 aa, BK virus
AWWKYLGS

SEQ ID NO: 788 - protein, 8 aa, BK virus
WWKYLGSF

SEQ ID NO: 789 - protein, 8 aa, BK virus
WKYLGSFV

SEQ ID NO: 790 - protein, 8 aa, BK virus
FSSCPFYI

SEQ ID NO: 791 - protein, 8 aa, BK virus
SSCPFYIF

SEQ ID NO: 792 - protein, 8 aa, BK virus
SCPFYIFK

SEQ ID NO: 793 - protein, 8 aa, BK virus
CPFYIFKN

SEQ ID NO: 794 - protein, 8 aa, BK virus
PFYIFKNN

SEQ ID NO: 795 - protein, 8 aa, BK virus
FYIFKNNH

SEQ ID NO: 796 - protein, 8 aa, BK virus
YIFKNNHV

SEQ ID NO: 797 - protein, 8 aa, BK virus
IFKNNHVL

SEQ ID NO: 798 - protein, 8 aa, BK virus
FKNNHVLI

SEQ ID NO: 799 - protein, 8 aa, BK virus
KNNHVLIY

SEQ ID NO: 800 - protein, 8 aa, BK virus
NNHVLIYS

SEQ ID NO: 801 - protein, 8 aa, BK virus
NHVLIYSY

SEQ ID NO: 802 - protein, 8 aa, BK virus
HVLIYSYT

SEQ ID NO: 803 - protein, 8 aa, BK virus
CCFSTING

SEQ ID NO: 804 - protein, 8 aa, BK virus
CFSTINGT

SEQ ID NO: 805 - protein, 8 aa, BK virus
FSTINGTF

SEQ ID NO: 806 - protein, 8 aa, BK virus
STINGTFK

SEQ ID NO: 807 - protein, 8 aa, BK virus
PVSSFRYI

SEQ ID NO: 808 - protein, 8 aa, BK virus
VSSFRYIE

SEQ ID NO: 809 - protein, 8 aa, BK virus
SSFRYIEN

SEQ ID NO: 810 - protein, 8 aa, BK virus
SFRYIENN

SEQ ID NO: 811 - protein, 8 aa, BK virus
FRYIENNT

SEQ ID NO: 812 - protein, 8 aa, BK virus
RYIENNTV

SEQ ID NO: 813 - protein, 8 aa, BK virus
YIENNTVQ

SEQ ID NO: 814 - protein, 8 aa, BK virus
IENNTVQK

SEQ ID NO: 815 - protein, 8 aa, BK virus
ENNTVQKI

SEQ ID NO: 816 - protein, 8 aa, BK virus
NNTVQKIK

SEQ ID NO: 817 - protein, 8 aa, BK virus
NTVQKIKY

SEQ ID NO: 818 - protein, 8 aa, BK virus
TVQKIKYY

SEQ ID NO: 819 - protein, 8 aa, BK virus
VQKIKYYR

SEQ ID NO: 820 - protein, 8 aa, BK virus
QKIKYYRI

SEQ ID NO: 821 - protein, 8 aa, BK virus
KIKYYRIH

SEQ ID NO: 822 - protein, 8 aa, BK virus
IKYYRIHF

SEQ ID NO: 823 - protein, 8 aa, BK virus
KYYRIHFR

SEQ ID NO: 824 - protein, 8 aa, BK virus
QTVQPSNT

SEQ ID NO: 825 - protein, 8 aa, BK virus
TVQPSNTC

SEQ ID NO: 826 - protein, 8 aa, BK virus
VQPSNTCH

SEQ ID NO: 827 - protein, 8 aa, BK virus
QPSNTCHI

SEQ ID NO: 828 - protein, 8 aa, BK virus
PSNTCHIL

SEQ ID NO: 829 - protein, 8 aa, BK virus
SNTCHILF

SEQ ID NO: 830 - protein, 8 aa, BK virus
YSISMSSK

SEQ ID NO: 831 - protein, 8 aa, BK virus
SISMSSKY

SEQ ID NO: 832 - protein, 8 aa, BK virus
HFFPGHMK

SEQ ID NO: 833 - protein, 8 aa, BK virus
FFPGHMKG

SEQ ID NO: 834 - protein, 8 aa, BK virus
FPGHMKGI

SEQ ID NO: 835 - protein, 8 aa, BK virus
PGHMKGIY

SEQ ID NO: 836 - protein, 8 aa, BK virus
GHMKGIYS

SEQ ID NO: 837 - protein, 8 aa, BK virus
HMKGIYSF

SEQ ID NO: 838 - protein, 8 aa, BK virus
MKGIYSFF

SEQ ID NO: 839 - protein, 8 aa, BK virus
KGIYSFFS

SEQ ID NO: 840 - protein, 8 aa, BK virus
NCIYCLLT

SEQ ID NO: 841 - protein, 8 aa, BK virus
CIYCLLTN

SEQ ID NO: 842 - protein, 8 aa, BK virus
IYCLLTNT

SEQ ID NO: 843 - protein, 8 aa, BK virus
YCLLTNTF

SEQ ID NO: 844 - protein, 8 aa, BK virus
CLLTNTFL

SEQ ID NO: 845 - protein, 8 aa, BK virus
LLTNTFLI

SEQ ID NO: 846 - protein, 8 aa, BK virus
LTNTFLIF

SEQ ID NO: 847 - protein, 8 aa, BK virus
TNTFLIFT

SEQ ID NO: 848 - protein, 8 aa, BK virus
NTFLIFTF

SEQ ID NO: 849 - protein, 8 aa, BK virus
TFLIFTFC

SEQ ID NO: 850 - protein, 8 aa, BK virus
FLIFTFCK

SEQ ID NO: 851 - protein, 8 aa, BK virus
LIFTFCKN

SEQ ID NO: 852 - protein, 8 aa, BK virus
IFTFCKNN

SEQ ID NO: 853 - protein, 8 aa, BK virus
FTFCKNNS

SEQ ID NO: 854 - protein, 8 aa, BK virus
TFCKNNSI

SEQ ID NO: 855 - protein, 8 aa, BK virus
FCKNNSIC

SEQ ID NO: 856 - protein, 8 aa, BK virus
CKNNSICK

SEQ ID NO: 857 - protein, 8 aa, BK virus
KNNSICKV

SEQ ID NO: 858 - protein, 8 aa, BK virus
NNSICKVL

SEQ ID NO: 859 - protein, 8 aa, BK virus
NSICKVLF

SEQ ID NO: 860 - protein, 8 aa, BK virus
SICKVLFM

SEQ ID NO: 861 - protein, 8 aa, BK virus
ICKVLFMI

SEQ ID NO: 862 - protein, 8 aa, BK virus
CKVLFMIL

SEQ ID NO: 863 - protein, 8 aa, BK virus
KVLFMILK

SEQ ID NO: 864 - protein, 8 aa, BK virus
VLFMILKV

SEQ ID NO: 865 - protein, 8 aa, BK virus
LFMILKVI

SEQ ID NO: 866 - protein, 8 aa, BK virus
FMILKVIR

SEQ ID NO: 867 - protein, 8 aa, BK virus
MILKVIRL

SEQ ID NO: 868 - protein, 8 aa, BK virus
ILKVIRLV

SEQ ID NO: 869 - protein, 8 aa, BK virus
LKVIRLVF

SEQ ID NO: 870 - protein, 8 aa, BK virus
KVIRLVFF

SEQ ID NO: 871 - protein, 8 aa, BK virus
VIRLVFFL

SEQ ID NO: 872 - protein, 8 aa, BK virus
IRLVFFLT

SEQ ID NO: 873 - protein, 8 aa, BK virus
RLVFFLTL

SEQ ID NO: 874 - protein, 8 aa, BK virus
LVFFLTLF

SEQ ID NO: 875 - protein, 8 aa, BK virus
VFFLTLFT

SEQ ID NO: 876 - protein, 8 aa, BK virus
FFLTLFTL

SEQ ID NO: 877 - protein, 8 aa, BK virus
FLTLFTLL

SEQ ID NO: 878 - protein, 8 aa, BK virus
LTLFTLLY

SEQ ID NO: 879 - protein, 8 aa, BK virus
TLFTLLYI

SEQ ID NO: 880 - protein, 8 aa, BK virus
LFTLLYIV

SEQ ID NO: 881 - protein, 8 aa, BK virus
FTLLYIVL

SEQ ID NO: 882 - protein, 8 aa, BK virus
TLLYIVLK

SEQ ID NO: 883 - protein, 8 aa, BK virus
LLYIVLKF

SEQ ID NO: 884 - protein, 8 aa, BK virus
KHILTLCL

SEQ ID NO: 885 - protein, 8 aa, BK virus
HILTLCLY

SEQ ID NO: 886 - protein, 8 aa, BK virus
ILTLCLYC

SEQ ID NO: 887 - protein, 8 aa, BK virus
LTLCLYCI

SEQ ID NO: 888 - protein, 8 aa, BK virus
TLCLYCIL

SEQ ID NO: 889 - protein, 8 aa, BK virus
LCLYCILS

SEQ ID NO: 890 - protein, 8 aa, BK virus
CLYCILSN

SEQ ID NO: 891 - protein, 8 aa, BK virus
FPRHLLCF

SEQ ID NO: 892 - protein, 8 aa, BK virus
PRHLLCFF

SEQ ID NO: 893 - protein, 8 aa, BK virus
RHLLCFFR

SEQ ID NO: 894 - protein, 8 aa, BK virus
HLLCFFRL

SEQ ID NO: 895 - protein, 8 aa, BK virus
LLCFFRLF

SEQ ID NO: 896 - protein, 8 aa, BK virus
LCFFRLFW

SEQ ID NO: 897 - protein, 8 aa, BK virus
CFFRLFWA

SEQ ID NO: 898 - protein, 8 aa, BK virus
FFRLFWAK

SEQ ID NO: 899 - protein, 8 aa, BK virus
FRLFWAKI

SEQ ID NO: 900 - protein, 8 aa, BK virus
RLFWAKIM

SEQ ID NO: 901 - protein, 8 aa, BK virus
LFWAKIML

SEQ ID NO: 902 - protein, 8 aa, BK virus
FWAKIMLL

SEQ ID NO: 903 - protein, 8 aa, BK virus
APLNAFFY

SEQ ID NO: 904 - protein, 8 aa, BK virus
PLNAFFYS

SEQ ID NO: 905 - protein, 8 aa, BK virus
LNAFFYSM

SEQ ID NO: 906 - protein, 8 aa, BK virus
NAFFYSMV

SEQ ID NO: 907 - protein, 8 aa, BK virus
AFFYSMVW

SEQ ID NO: 908 - protein, 8 aa, BK virus
FFYSMVWI

SEQ ID NO: 909 - protein, 8 aa, BK virus
FYSMVWIS

SEQ ID NO: 910 - protein, 8 aa, BK virus
YSMVWISS

SEQ ID NO: 911 - protein, 8 aa, BK virus
VFLINTLT

SEQ ID NO: 912 - protein, 8 aa, BK virus
FLINTLTN

SEQ ID NO: 913 - protein, 8 aa, BK virus
KTKGTQLL

SEQ ID NO: 914 - protein, 8 aa, BK virus
TKGTQLLT

SEQ ID NO: 915 - protein, 8 aa, BK virus
KGTQLLTE

SEQ ID NO: 916 - protein, 8 aa, BK virus
GTQLLTEI

SEQ ID NO: 917 - protein, 8 aa, BK virus
TQLLTEII

SEQ ID NO: 918 - protein, 8 aa, BK virus
QLLTEIIN

SEQ ID NO: 919 - protein, 8 aa, BK virus
LLTEIINC

SEQ ID NO: 920 - protein, 8 aa, BK virus
LTEIINCR

SEQ ID NO: 921 - protein, 8 aa, BK virus
TEIINCRN

SEQ ID NO: 922 - protein, 8 aa, BK virus
EIINCRNS

SEQ ID NO: 923 - protein, 8 aa, BK virus
IINCRNSM

SEQ ID NO: 924 - protein, 8 aa, BK virus
INCRNSMS

SEQ ID NO: 925 - protein, 8 aa, BK virus
NCRNSMSM

SEQ ID NO: 926 - protein, 8 aa, BK virus
CRNSMSMW

SEQ ID NO: 927 - protein, 8 aa, BK virus
RNSMSMWS

SEQ ID NO: 928 - protein, 8 aa, BK virus
KEYNIMPS

SEQ ID NO: 929 - protein, 8 aa, BK virus
EYNIMPST

SEQ ID NO: 930 - protein, 8 aa, BK virus
YNIMPSTH

SEQ ID NO: 931 - protein, 8 aa, BK virus
NIMPSTHV

SEQ ID NO: 932 - protein, 8 aa, BK virus
IMPSTHVS

SEQ ID NO: 933 - protein, 8 aa, BK virus
MPSTHVST

SEQ ID NO: 934 - protein, 8 aa, BK virus
PSTHVSTN

SEQ ID NO: 935 - protein, 8 aa, BK virus
STHVSTNK

SEQ ID NO: 936 - protein, 8 aa, BK virus
THVSTNKS

SEQ ID NO: 937 - protein, 8 aa, BK virus
HVSTNKSY

SEQ ID NO: 938 - protein, 8 aa, BK virus
VSTNKSYR

SEQ ID NO: 939 - protein, 8 aa, BK virus
STNKSYRI

SEQ ID NO: 940 - protein, 8 aa, BK virus
TNKSYRIF

SEQ ID NO: 941 - protein, 8 aa, BK virus
NKSYRIFF

SEQ ID NO: 942 - protein, 8 aa, BK virus
KSYRIFFH

SEQ ID NO: 943 - protein, 8 aa, BK virus
SYRIFFHK

SEQ ID NO: 944 - protein, 8 aa, BK virus
YRIFFHKF

SEQ ID NO: 945 - protein, 8 aa, BK virus
RIFFHKFF

SEQ ID NO: 946 - protein, 8 aa, BK virus
IFFHKFFI

SEQ ID NO: 947 - protein, 8 aa, BK virus
FFHKFFIQ

SEQ ID NO: 948 - protein, 8 aa, BK virus
FHKFFIQN

SEQ ID NO: 949 - protein, 8 aa, BK virus
HKFFIQNL

SEQ ID NO: 950 - protein, 8 aa, BK virus
KFFIQNLS

SEQ ID NO: 951 - protein, 8 aa, BK virus
FFIQNLSF

SEQ ID NO: 952 - protein, 8 aa, BK virus
FIQNLSFF

SEQ ID NO: 953 - protein, 8 aa, BK virus
IQNLSFFF

SEQ ID NO: 954 - protein, 8 aa, BK virus
QNLSFFFS

SEQ ID NO: 955 - protein, 8 aa, BK virus
NLSFFFSS

SEQ ID NO: 956 - protein, 8 aa, BK virus
LSFFFSSI

SEQ ID NO: 957 - protein, 8 aa, BK virus
SFFFSSIH

SEQ ID NO: 958 - protein, 8 aa, BK virus
FFFSSIHS

SEQ ID NO: 959 - protein, 8 aa, BK virus
FFSSIHSK

SEQ ID NO: 960 - protein, 8 aa, BK virus
FSSIHSKA

SEQ ID NO: 961 - protein, 8 aa, BK virus
SSIHSKAG

SEQ ID NO: 962 - protein, 8 aa, BK virus
SIHSKAGK

SEQ ID NO: 963 - protein, 8 aa, BK virus
IHSKAGKG

SEQ ID NO: 964 - protein, 8 aa, BK virus
HSKAGKGS

SEQ ID NO: 965 - protein, 8 aa, BK virus
SKAGKGSI

SEQ ID NO: 966 - protein, 8 aa, BK virus
KAGKGSIT

SEQ ID NO: 967 - protein, 8 aa, BK virus
AGKGSITK

SEQ ID NO: 968 - protein, 8 aa, BK virus
GKGSITKY

SEQ ID NO: 969 - protein, 8 aa, BK virus
KGSITKYS

SEQ ID NO: 970 - protein, 8 aa, BK virus
GSITKYSL

SEQ ID NO: 971 - protein, 8 aa, BK virus
SITKYSLT

SEQ ID NO: 972 - protein, 8 aa, BK virus
ITKYSLTK

SEQ ID NO: 973 - protein, 8 aa, BK virus
TKYSLTKK

SEQ ID NO: 974 - protein, 8 aa, BK virus
KYSLTKKL

SEQ ID NO: 975 - protein, 8 aa, BK virus
YSLTKKLV

SEQ ID NO: 976 - protein, 8 aa, BK virus
IRGKVFRV

SEQ ID NO: 977 - protein, 8 aa, BK virus
RGKVFRVF

SEQ ID NO: 978 - protein, 8 aa, BK virus
GKVFRVFY

SEQ ID NO: 979 - protein, 8 aa, BK virus
KVFRVFYL

SEQ ID NO: 980 - protein, 8 aa, BK virus
VFRVFYLS

SEQ ID NO: 981 - protein, 8 aa, BK virus
FRVFYLSF

SEQ ID NO: 982 - protein, 8 aa, BK virus
RVFYLSFF

SEQ ID NO: 983 - protein, 8 aa, BK virus
VFYLSFFF

SEQ ID NO: 984 - protein, 8 aa, BK virus
FYLSFFFG

SEQ ID NO: 985 - protein, 8 aa, BK virus
YLSFFFGW

SEQ ID NO: 986 - protein, 8 aa, BK virus
LSFFFGWC

SEQ ID NO: 987 - protein, 8 aa, BK virus
VLRICCCF

SEQ ID NO: 988 - protein, 8 aa, BK virus
LRICCCFF

SEQ ID NO: 989 - protein, 8 aa, BK virus
RICCCFFI

SEQ ID NO: 990 - protein, 8 aa, BK virus
ICCCFFIT

SEQ ID NO: 991 - protein, 8 aa, BK virus
CCCFFITG

SEQ ID NO: 992 - protein, 8 aa, BK virus
CCFFITGK

SEQ ID NO: 993 - protein, 8 aa, BK virus
CFFITGKH

SEQ ID NO: 994 - protein, 8 aa, BK virus
FFITGKHI

SEQ ID NO: 995 - protein, 8 aa, BK virus
FITGKHIF

SEQ ID NO: 996 - protein, 8 aa, BK virus
ITGKHIFM

SEQ ID NO: 997 - protein, 8 aa, BK virus
TGKHIFMA

SEQ ID NO: 998 - protein, 8 aa, BK virus
GKHIFMAK

SEQ ID NO: 999 - protein, 8 aa, BK virus
IFIPFFIK

SEQ ID NO: 1000 - protein, 8 aa, BK virus
FIPFFIKG

SEQ ID NO: 1001 - protein, 8 aa, BK virus
IPFFIKGT

SEQ ID NO: 1002 - protein, 8 aa, BK virus
PFFIKGTP

SEQ ID NO: 1003 - protein, 8 aa, BK virus
FFIKGTPP

SEQ ID NO: 1004 - protein, 8 aa, BK virus
FIKGTPPG

SEQ ID NO: 1005 - protein, 8 aa, BK virus
IKGTPPGL

SEQ ID NO: 1006 - protein, 8 aa, BK virus
KGTPPGLP

SEQ ID NO: 1007 - protein, 8 aa, BK virus
GTPPGLPL

SEQ ID NO: 1008 - protein, 8 aa, BK virus
TPPGLPLF

SEQ ID NO: 1009 - protein, 8 aa, BK virus
PPGLPLFC

SEQ ID NO: 1010 - protein, 8 aa, BK virus
PGLPLFCS

SEQ ID NO: 1011 - protein, 8 aa, BK virus
GLPLFCSI

SEQ ID NO: 1012 - protein, 8 aa, BK virus
LPLFCSIG

SEQ ID NO: 1013 - protein, 8 aa, BK virus
PLFCSIGW

SEQ ID NO: 1014 - protein, 8 aa, BK virus
LFCSIGWH

SEQ ID NO: 1015 - protein, 8 aa, BK virus
FCSIGWHL

SEQ ID NO: 1016 - protein, 8 aa, BK virus
YFIIYLNI

SEQ ID NO: 1017 - protein, 8 aa, BK virus
FIIYLNIS

SEQ ID NO: 1018 - protein, 8 aa, BK virus
SFRSLKGV

SEQ ID NO: 1019 - protein, 8 aa, BK virus
FRSLKGVS

SEQ ID NO: 1020 - protein, 8 aa, BK virus
RSLKGVSP

SEQ ID NO: 1021 - protein, 8 aa, BK virus
SLKGVSPI

SEQ ID NO: 1022 - protein, 8 aa, BK virus
LKGVSPII

SEQ ID NO: 1023 - protein, 8 aa, BK virus
KGVSPIIW

SEQ ID NO: 1024 - protein, 8 aa, BK virus
GVSPIIWT

SEQ ID NO: 1025 - protein, 8 aa, BK virus
VSPIIWTH

SEQ ID NO: 1026 - protein, 8 aa, BK virus
SPIIWTHH

SEQ ID NO: 1027 - protein, 8 aa, BK virus
PIIWTHHC

SEQ ID NO: 1028 - protein, 8 aa, BK virus
IIWTHHCR

SEQ ID NO: 1029 - protein, 8 aa, BK virus
IWTHHCRV

SEQ ID NO: 1030 - protein, 8 aa, BK virus
WTHHCRVS

SEQ ID NO: 1031 - protein, 8 aa, BK virus
THHCRVSS

SEQ ID NO: 1032 - protein, 8 aa, BK virus
HHCRVSSV

SEQ ID NO: 1033 - protein, 8 aa, BK virus
HCRVSSVR

SEQ ID NO: 1034 - protein, 8 aa, BK virus
CRVSSVRS

SEQ ID NO: 1035 - protein, 8 aa, BK virus
RVSSVRSK

SEQ ID NO: 1036 - protein, 8 aa, BK virus
VSSVRSKP

SEQ ID NO: 1037 - protein, 8 aa, BK virus
SSVRSKPN

SEQ ID NO: 1038 - protein, 8 aa, BK virus
SVRSKPNH

SEQ ID NO: 1039 - protein, 8 aa, BK virus
VRSKPNHC

SEQ ID NO: 1040 - protein, 8 aa, BK virus
RSKPNHCV

SEQ ID NO: 1041 - protein, 8 aa, BK virus
SKPNHCVK

SEQ ID NO: 1042 - protein, 8 aa, BK virus
KPNHCVKQ

SEQ ID NO: 1043 - protein, 8 aa, BK virus
PNHCVKQS

SEQ ID NO: 1044 - protein, 8 aa, BK virus
NHCVKQSM

SEQ ID NO: 1045 - protein, 8 aa, BK virus
HCVKQSMQ

SEQ ID NO: 1046 - protein, 8 aa, BK virus
QSIQTKGS

SEQ ID NO: 1047 - protein, 8 aa, BK virus
SIQTKGSF

SEQ ID NO: 1048 - protein, 8 aa, BK virus
IQTKGSFL

SEQ ID NO: 1049 - protein, 8 aa, BK virus
QTKGSFLK

SEQ ID NO: 1050 - protein, 8 aa, BK virus
TKGSFLKN

SEQ ID NO: 1051 - protein, 8 aa, BK virus
KGSFLKNF

SEQ ID NO: 1052 - protein, 8 aa, BK virus
GSFLKNFL

SEQ ID NO: 1053 - protein, 8 aa, BK virus
SFLKNFLF

SEQ ID NO: 1054 - protein, 8 aa, BK virus
FLKNFLFK

SEQ ID NO: 1055 - protein, 8 aa, BK virus
LKNFLFKC

SEQ ID NO: 1056 - protein, 8 aa, BK virus
KNFLFKCL

SEQ ID NO: 1057 - protein, 8 aa, BK virus
NFLFKCLN

SEQ ID NO: 1058 - protein, 8 aa, BK virus
FLFKCLNL

SEQ ID NO: 1059 - protein, 8 aa, BK virus
LFKCLNLS

SEQ ID NO: 1060 - protein, 8 aa, BK virus
HSMQGQCT

SEQ ID NO: 1061 - protein, 8 aa, BK virus
SMQGQCTE

SEQ ID NO: 1062 - protein, 8 aa, BK virus
MQGQCTEG

SEQ ID NO: 1063 - protein, 8 aa, BK virus
QGQCTEGF

SEQ ID NO: 1064 - protein, 8 aa, BK virus
GQCTEGFL

SEQ ID NO: 1065 - protein, 8 aa, BK virus
QCTEGFLE

SEQ ID NO: 1066 - protein, 8 aa, BK virus
CTEGFLEQ

SEQ ID NO: 1067 - protein, 8 aa, BK virus
TEGFLEQI

SEQ ID NO: 1068 - protein, 8 aa, BK virus
EGFLEQIG

SEQ ID NO: 1069 - protein, 8 aa, BK virus
GFLEQIGH

SEQ ID NO: 1070 - protein, 8 aa, BK virus
FLEQIGHS

SEQ ID NO: 1071 - protein, 8 aa, BK virus
LEQIGHSL

SEQ ID NO: 1072 - protein, 8 aa, BK virus
EQIGHSLQ

SEQ ID NO: 1073 - protein, 8 aa, BK virus
QIGHSLQY

SEQ ID NO: 1074 - protein, 8 aa, BK virus
IGHSLQYR

SEQ ID NO: 1075 - protein, 8 aa, BK virus
GHSLQYRV

SEQ ID NO: 1076 - protein, 8 aa, BK virus
HSLQYRVS

SEQ ID NO: 1077 - protein, 8 aa, BK virus
SLQYRVSG

SEQ ID NO: 1078 - protein, 8 aa, BK virus
LQYRVSGQ

SEQ ID NO: 1079 - protein, 8 aa, BK virus
QYRVSGQR

SEQ ID NO: 1080 - protein, 8 aa, BK virus
YRVSGQRG

SEQ ID NO: 1081 - protein, 8 aa, BK virus
RVSGQRGK

SEQ ID NO: 1082 - protein, 8 aa, BK virus
VSGQRGKS

SEQ ID NO: 1083 - protein, 8 aa, BK virus
SGQRGKSA

SEQ ID NO: 1084 - protein, 8 aa, BK virus
GQRGKSAQ

SEQ ID NO: 1085 - protein, 8 aa, BK virus
QRGKSAQT

SEQ ID NO: 1086 - protein, 8 aa, BK virus
RGKSAQTS

SEQ ID NO: 1087 - protein, 8 aa, BK virus
GKSAQTSE

SEQ ID NO: 1088 - protein, 8 aa, BK virus
KSAQTSEL

SEQ ID NO: 1089 - protein, 8 aa, BK virus
SAQTSELL

SEQ ID NO: 1090 - protein, 8 aa, BK virus
AQTSELLQ

SEQ ID NO: 1091 - protein, 8 aa, BK virus
QTSELLQV

SEQ ID NO: 1092 - protein, 8 aa, BK virus
TSELLQVP

SEQ ID NO: 1093 - protein, 8 aa, BK virus
SELLQVPK

SEQ ID NO: 1094 - protein, 8 aa, BK virus
ELLQVPKS

SEQ ID NO: 1095 - protein, 8 aa, BK virus
LLQVPKSG

SEQ ID NO: 1096 - protein, 8 aa, BK virus
ATFTSCSI

SEQ ID NO: 1097 - protein, 8 aa, BK virus
TFTSCSIF

SEQ ID NO: 1098 - protein, 8 aa, BK virus
FTSCSIFL

SEQ ID NO: 1099 - protein, 8 aa, BK virus
TSCSIFLY

SEQ ID NO: 1100 - protein, 8 aa, BK virus
SCSIFLYK

SEQ ID NO: 1101 - protein, 8 aa, BK virus
CSIFLYKV

SEQ ID NO: 1102 - protein, 8 aa, BK virus
SIFLYKVF

SEQ ID NO: 1103 - protein, 8 aa, BK virus
IFLYKVFI

SEQ ID NO: 1104 - protein, 8 aa, BK virus
FLYKVFIL

SEQ ID NO: 1105 - protein, 8 aa, BK virus
LYKVFILF

SEQ ID NO: 1106 - protein, 8 aa, BK virus
YKVFILFI

SEQ ID NO: 1107 - protein, 8 aa, BK virus
KVFILFIL

SEQ ID NO: 1108 - protein, 8 aa, BK virus
VFILFILS

SEQ ID NO: 1109 - protein, 8 aa, BK virus
FILFILSS

SEQ ID NO: 1110 - protein, 8 aa, BK virus
ILFILSSS

SEQ ID NO: 1111 - protein, 8 aa, BK virus
LFILSSSP

SEQ ID NO: 1112 - protein, 8 aa, BK virus
FILSSSPP

SEQ ID NO: 1113 - protein, 8 aa, BK virus
ILSSSPPL

SEQ ID NO: 1114 - protein, 8 aa, BK virus
LSSSPPLS

SEQ ID NO: 1115 - protein, 8 aa, BK virus
SSSPPLSG

SEQ ID NO: 1116 - protein, 8 aa, BK virus
AFLIKGRF

SEQ ID NO: 1117 - protein, 8 aa, BK virus
FLIKGRFP

SEQ ID NO: 1118 - protein, 8 aa, BK virus
LIKGRFPQ

SEQ ID NO: 1119 - protein, 8 aa, BK virus
IKGRFPQA

SEQ ID NO: 1120 - protein, 8 aa, BK virus
KGRFPQAA

SEQ ID NO: 1121 - protein, 8 aa, BK virus
GRFPQAAL

SEQ ID NO: 1122 - protein, 8 aa, BK virus
RFPQAALS

SEQ ID NO: 1123 - protein, 8 aa, BK virus
FPQAALSR

SEQ ID NO: 1124 - protein, 8 aa, BK virus
PQAALSRP

SEQ ID NO: 1125 - protein, 8 aa, BK virus
QAALSRPK

SEQ ID NO: 1126 - protein, 8 aa, BK virus
AALSRPKR

SEQ ID NO: 1127 - protein, 8 aa, BK virus
ALSRPKRS

SEQ ID NO: 1128 - protein, 8 aa, BK virus
LSRPKRSM

SEQ ID NO: 1129 - protein, 8 aa, BK virus
SRPKRSMS

SEQ ID NO: 1130 - protein, 8 aa, BK virus
RPKRSMSS

SEQ ID NO: 1131 - protein, 8 aa, BK virus
PKRSMSSM

SEQ ID NO: 1132 - protein, 8 aa, BK virus
KRSMSSMD

SEQ ID NO: 1133 - protein, 8 aa, BK virus
RSMSSMDS

SEQ ID NO: 1134 - protein, 8 aa, BK virus
SMSSMDSS

SEQ ID NO: 1135 - protein, 8 aa, BK virus
MSSMDSSL

SEQ ID NO: 1136 - protein, 8 aa, BK virus
SSMDSSLL

SEQ ID NO: 1137 - protein, 8 aa, BK virus
SMDSSLLR

SEQ ID NO: 1138 - protein, 8 aa, BK virus
MDSSLLRT

SEQ ID NO: 1139 - protein, 8 aa, BK virus
DSSLLRTL

SEQ ID NO: 1140 - protein, 8 aa, BK virus
SSLLRTLS

SEQ ID NO: 1141 - protein, 9 aa, BK virus
FCKNCKRIG

SEQ ID NO: 1142 - protein, 9 aa, BK virus
CKNCKRIGI

SEQ ID NO: 1143 - protein, 9 aa, BK virus
KNCKRIGIS

SEQ ID NO: 1144 - protein, 9 aa, BK virus
NCKRIGISP

SEQ ID NO: 1145 - protein, 9 aa, BK virus
CKRIGISPN

SEQ ID NO: 1146 - protein, 9 aa, BK virus
KRIGISPNS

SEQ ID NO: 1147 - protein, 9 aa, BK virus
RIGISPNSF

SEQ ID NO: 1148 - protein, 9 aa, BK virus
IGISPNSFA

SEQ ID NO: 1149 - protein, 9 aa, BK virus
GISPNSFAR

SEQ ID NO: 1150 - protein, 9 aa, BK virus
ISPNSFARP

SEQ ID NO: 1151 - protein, 9 aa, BK virus
SPNSFARPQ

SEQ ID NO: 1152 - protein, 9 aa, BK virus
PNSFARPQK

SEQ ID NO: 1153 - protein, 9 aa, BK virus
NSFARPQKK

SEQ ID NO: 1154 - protein, 9 aa, BK virus
SFARPQKKP

SEQ ID NO: 1155 - protein, 9 aa, BK virus
FARPQKKPP

SEQ ID NO: 1156 - protein, 9 aa, BK virus
ARPQKKPPH

SEQ ID NO: 1157 - protein, 9 aa, BK virus
RPQKKPPHP

SEQ ID NO: 1158 - protein, 9 aa, BK virus
PQKKPPHPY

SEQ ID NO: 1159 - protein, 9 aa, BK virus
QKKPPHPYY

SEQ ID NO: 1160 - protein, 9 aa, BK virus
KKPPHPYYL

SEQ ID NO: 1161 - protein, 9 aa, BK virus
KPPHPYYLR

SEQ ID NO: 1162 - protein, 9 aa, BK virus
PPHPYYLRE

SEQ ID NO: 1163 - protein, 9 aa, BK virus
PHPYYLRER

SEQ ID NO: 1164 - protein, 9 aa, BK virus
HPYYLRERV

SEQ ID NO: 1165 - protein, 9 aa, BK virus
PYYLRERVE

SEQ ID NO: 1166 - protein, 9 aa, BK virus
YYLRERVEA

SEQ ID NO: 1167 - protein, 9 aa, BK virus
YLRERVEAE

SEQ ID NO: 1168 - protein, 9 aa, BK virus
LRERVEAEA

SEQ ID NO: 1169 - protein, 9 aa, BK virus
RERVEAEAA

SEQ ID NO: 1170 - protein, 9 aa, BK virus
ERVEAEAAS

SEQ ID NO: 1171 - protein, 9 aa, BK virus
RVEAEAASA

SEQ ID NO: 1172 - protein, 9 aa, BK virus
VEAEAASAS

SEQ ID NO: 1173 - protein, 9 aa, BK virus
EAEAASASY

SEQ ID NO: 1174 - protein, 9 aa, BK virus
AEAASASYI

SEQ ID NO: 1175 - protein, 9 aa, BK virus
EAASASYIL

SEQ ID NO: 1176 - protein, 9 aa, BK virus
KKRPQGGAA

SEQ ID NO: 1177 - protein, 9 aa, BK virus
KRPQGGAAY

SEQ ID NO: 1178 - protein, 9 aa, BK virus
RPQGGAAYP

SEQ ID NO: 1179 - protein, 9 aa, BK virus
PQGGAAYPW

SEQ ID NO: 1180 - protein, 9 aa, BK virus
QGGAAYPWN

SEQ ID NO: 1181 - protein, 9 aa, BK virus
GGAAYPWNA

SEQ ID NO: 1182 - protein, 9 aa, BK virus
GAAYPWNAA

SEQ ID NO: 1183 - protein, 9 aa, BK virus
AAYPWNAAK

SEQ ID NO: 1184 - protein, 9 aa, BK virus
AYPWNAAKP

SEQ ID NO: 1185 - protein, 9 aa, BK virus
PQEGKCMTH

SEQ ID NO: 1186 - protein, 9 aa, BK virus
QEGKCMTHR

SEQ ID NO: 1187 - protein, 9 aa, BK virus
EGKCMTHRG

SEQ ID NO: 1188 - protein, 9 aa, BK virus
GKCMTHRGM

SEQ ID NO: 1189 - protein, 9 aa, BK virus
KCMTHRGMQ

SEQ ID NO: 1190 - protein, 9 aa, BK virus
CMTHRGMQP

SEQ ID NO: 1191 - protein, 9 aa, BK virus
MTHRGMQPN

SEQ ID NO: 1192 - protein, 9 aa, BK virus
THRGMQPNH

SEQ ID NO: 1193 - protein, 9 aa, BK virus
HRGMQPNHD

SEQ ID NO: 1194 - protein, 9 aa, BK virus
RGMQPNHDL

SEQ ID NO: 1195 - protein, 9 aa, BK virus
GMQPNHDLR

SEQ ID NO: 1196 - protein, 9 aa, BK virus
MQPNHDLRK

SEQ ID NO: 1197 - protein, 9 aa, BK virus
QPNHDLRKE

SEQ ID NO: 1198 - protein, 9 aa, BK virus
PNHDLRKES

SEQ ID NO: 1199 - protein, 9 aa, BK virus
NHDLRKESA

SEQ ID NO: 1200 - protein, 9 aa, BK virus
LTGRSCLPM

SEQ ID NO: 1201 - protein, 9 aa, BK virus
TGRSCLPME

SEQ ID NO: 1202 - protein, 9 aa, BK virus
GRSCLPMEC

SEQ ID NO: 1203 - protein, 9 aa, BK virus
RSCLPMECS

SEQ ID NO: 1204 - protein, 9 aa, BK virus
SCLPMECSQ

SEQ ID NO: 1205 - protein, 9 aa, BK virus
CLPMECSQT

SEQ ID NO: 1206 - protein, 9 aa, BK virus
LPMECSQTM

SEQ ID NO: 1207 - protein, 9 aa, BK virus
PMECSQTMT

SEQ ID NO: 1208 - protein, 9 aa, BK virus
MECSQTMTS

SEQ ID NO: 1209 - protein, 9 aa, BK virus
ECSQTMTSG

SEQ ID NO: 1210 - protein, 9 aa, BK virus
CSQTMTSGR

SEQ ID NO: 1211 - protein, 9 aa, BK virus
SQTMTSGRK

SEQ ID NO: 1212 - protein, 9 aa, BK virus
QTMTSGRKV

SEQ ID NO: 1213 - protein, 9 aa, BK virus
TMTSGRKVH

SEQ ID NO: 1214 - protein, 9 aa, BK virus
MTSGRKVHD

SEQ ID NO: 1215 - protein, 9 aa, BK virus
TSGRKVHDR

SEQ ID NO: 1216 - protein, 9 aa, BK virus
SGRKVHDRH

SEQ ID NO: 1217 - protein, 9 aa, BK virus
GRKVHDRHV

SEQ ID NO: 1218 - protein, 9 aa, BK virus
RKVHDRHVL

SEQ ID NO: 1219 - protein, 9 aa, BK virus
KVHDRHVLR

SEQ ID NO: 1220 - protein, 9 aa, BK virus
VHDRHVLRA

SEQ ID NO: 1221 - protein, 9 aa, BK virus
ESWPCPQLN

SEQ ID NO: 1222 - protein, 9 aa, BK virus
SWPCPQLNW

SEQ ID NO: 1223 - protein, 9 aa, BK virus
WPCPQLNWT

SEQ ID NO: 1224 - protein, 9 aa, BK virus
PCPQLNWTK

SEQ ID NO: 1225 - protein, 9 aa, BK virus
CPQLNWTKA

SEQ ID NO: 1226 - protein, 9 aa, BK virus
PQLNWTKAM

SEQ ID NO: 1227 - protein, 9 aa, BK virus
QLNWTKAMV

SEQ ID NO: 1228 - protein, 9 aa, BK virus
LNWTKAMVL

SEQ ID NO: 1229 - protein, 9 aa, BK virus
NWTKAMVLR

SEQ ID NO: 1230 - protein, 9 aa, BK virus
WTKAMVLRQ

SEQ ID NO: 1231 - protein, 9 aa, BK virus
TKAMVLRQL

SEQ ID NO: 1232 - protein, 9 aa, BK virus
KAMVLRQLS

SEQ ID NO: 1233 - protein, 9 aa, BK virus
AMVLRQLSR

SEQ ID NO: 1234 - protein, 9 aa, BK virus
MVLRQLSRQ

SEQ ID NO: 1235 - protein, 9 aa, BK virus
VLRQLSRQA

SEQ ID NO: 1236 - protein, 9 aa, BK virus
LRQLSRQAS

SEQ ID NO: 1237 - protein, 9 aa, BK virus
RQLSRQASV

SEQ ID NO: 1238 - protein, 9 aa, BK virus
QLSRQASVK

SEQ ID NO: 1239 - protein, 9 aa, BK virus
LSRQASVKV

SEQ ID NO: 1240 - protein, 9 aa, BK virus
SRQASVKVG

SEQ ID NO: 1241 - protein, 9 aa, BK virus
RQASVKVGK

SEQ ID NO: 1242 - protein, 9 aa, BK virus
QASVKVGKT

SEQ ID NO: 1243 - protein, 9 aa, BK virus
ASVKVGKTW

SEQ ID NO: 1244 - protein, 9 aa, BK virus
SVKVGKTWT

SEQ ID NO: 1245 - protein, 9 aa, BK virus
VKVGKTWTG

SEQ ID NO: 1246 - protein, 9 aa, BK virus
KVGKTWTGT

SEQ ID NO: 1247 - protein, 9 aa, BK virus
VGKTWTGTK

SEQ ID NO: 1248 - protein, 9 aa, BK virus
GKTWTGTKK

SEQ ID NO: 1249 - protein, 9 aa, BK virus
KTWTGTKKR

SEQ ID NO: 1250 - protein, 9 aa, BK virus
TWTGTKKRA

SEQ ID NO: 1251 - protein, 9 aa, BK virus
WTGTKKRAQ

SEQ ID NO: 1252 - protein, 9 aa, BK virus
TGTKKRAQR

SEQ ID NO: 1253 - protein, 9 aa, BK virus
GTKKRAQRI

SEQ ID NO: 1254 - protein, 9 aa, BK virus
TKKRAQRIF

SEQ ID NO: 1255 - protein, 9 aa, BK virus
KKRAQRIFI

SEQ ID NO: 1256 - protein, 9 aa, BK virus
KRAQRIFIF

SEQ ID NO: 1257 - protein, 9 aa, BK virus
RAQRIFIFI

SEQ ID NO: 1258 - protein, 9 aa, BK virus
AQRIFIFIL

SEQ ID NO: 1259 - protein, 9 aa, BK virus
QRIFIFILE

SEQ ID NO: 1260 - protein, 9 aa, BK virus
RIFIFILEL

SEQ ID NO: 1261 - protein, 9 aa, BK virus
IFIFILELL

SEQ ID NO: 1262 - protein, 9 aa, BK virus
FIFILELLL

SEQ ID NO: 1263 - protein, 9 aa, BK virus
IFILELLLE

SEQ ID NO: 1264 - protein, 9 aa, BK virus
FILELLLEF

SEQ ID NO: 1265 - protein, 9 aa, BK virus
ILELLLEFC

SEQ ID NO: 1266 - protein, 9 aa, BK virus
LELLLEFCR

SEQ ID NO: 1267 - protein, 9 aa, BK virus
ELLLEFCRG

SEQ ID NO: 1268 - protein, 9 aa, BK virus
LLLEFCRGE

SEQ ID NO: 1269 - protein, 9 aa, BK virus
LLEFCRGED

SEQ ID NO: 1270 - protein, 9 aa, BK virus
LEFCRGEDS

SEQ ID NO: 1271 - protein, 9 aa, BK virus
EFCRGEDSV

SEQ ID NO: 1272 - protein, 9 aa, BK virus
FCRGEDSVD

SEQ ID NO: 1273 - protein, 9 aa, BK virus
CRGEDSVDG

SEQ ID NO: 1274 - protein, 9 aa, BK virus
RGEDSVDGK

SEQ ID NO: 1275 - protein, 9 aa, BK virus
GEDSVDGKN

SEQ ID NO: 1276 - protein, 9 aa, BK virus
EDSVDGKNK

SEQ ID NO: 1277 - protein, 9 aa, BK virus
DSVDGKNKS

SEQ ID NO: 1278 - protein, 9 aa, BK virus
SVDGKNKST

SEQ ID NO: 1279 - protein, 9 aa, BK virus
VDGKNKSTT

SEQ ID NO: 1280 - protein, 9 aa, BK virus
DGKNKSTTA

SEQ ID NO: 1281 - protein, 9 aa, BK virus
GKNKSTTAL

SEQ ID NO: 1282 - protein, 9 aa, BK virus
KNKSTTALP

SEQ ID NO: 1283 - protein, 9 aa, BK virus
NKSTTALPA

SEQ ID NO: 1284 - protein, 9 aa, BK virus
KSTTALPAV

SEQ ID NO: 1285 - protein, 9 aa, BK virus
STTALPAVK

SEQ ID NO: 1286 - protein, 9 aa, BK virus
TTALPAVKD

SEQ ID NO: 1287 - protein, 9 aa, BK virus
TALPAVKDS

SEQ ID NO: 1288 - protein, 9 aa, BK virus
ALPAVKDSV

SEQ ID NO: 1289 - protein, 9 aa, BK virus
LPAVKDSVK

SEQ ID NO: 1290 - protein, 9 aa, BK virus
PAVKDSVKD

SEQ ID NO: 1291 - protein, 9 aa, BK virus
AVKDSVKDS

SEQ ID NO: 1292 - protein, 9 aa, BK virus
VSNPFFFVF

SEQ ID NO: 1293 - protein, 9 aa, BK virus
SNPFFFVFP

SEQ ID NO: 1294 - protein, 9 aa, BK virus
NPFFFVFPG

SEQ ID NO: 1295 - protein, 9 aa, BK virus
PFFFVFPGS

SEQ ID NO: 1296 - protein, 9 aa, BK virus
FFFVFPGSW

SEQ ID NO: 1297 - protein, 9 aa, BK virus
FFVFPGSWV

SEQ ID NO: 1298 - protein, 9 aa, BK virus
FVFPGSWVL

SEQ ID NO: 1299 - protein, 9 aa, BK virus
VFPGSWVLL

SEQ ID NO: 1300 - protein, 9 aa, BK virus
LPVYLRLLL

SEQ ID NO: 1301 - protein, 9 aa, BK virus
PVYLRLLLP

SEQ ID NO: 1302 - protein, 9 aa, BK virus
VYLRLLLPQ

SEQ ID NO: 1303 - protein, 9 aa, BK virus
YLRLLLPQD

SEQ ID NO: 1304 - protein, 9 aa, BK virus
LRLLLPQDF

SEQ ID NO: 1305 - protein, 9 aa, BK virus
RLLLPQDFQ

SEQ ID NO: 1306 - protein, 9 aa, BK virus
LLLPQDFQW

SEQ ID NO: 1307 - protein, 9 aa, BK virus
LLPQDFQWL

SEQ ID NO: 1308 - protein, 9 aa, BK virus
LPQDFQWLK

SEQ ID NO: 1309 - protein, 9 aa, BK virus
PQDFQWLKL

SEQ ID NO: 1310 - protein, 9 aa, BK virus
QDFQWLKLL

SEQ ID NO: 1311 - protein, 9 aa, BK virus
DFQWLKLLL

SEQ ID NO: 1312 - protein, 9 aa, BK virus
FQWLKLLLG

SEQ ID NO: 1313 - protein, 9 aa, BK virus
QWLKLLLGR

SEQ ID NO: 1314 - protein, 9 aa, BK virus
WLKLLLGRL

SEQ ID NO: 1315 - protein, 9 aa, BK virus
LKLLLGRLL

SEQ ID NO: 1316 - protein, 9 aa, BK virus
KLLLGRLLL

SEQ ID NO: 1317 - protein, 9 aa, BK virus
LLLGRLLLL

SEQ ID NO: 1318 - protein, 9 aa, BK virus
KFKLHPLLL

SEQ ID NO: 1319 - protein, 9 aa, BK virus
LLVLLGLLL

SEQ ID NO: 1320 - protein, 9 aa, BK virus
LVLLGLLLG

SEQ ID NO: 1321 - protein, 9 aa, BK virus
VLLGLLLGL

SEQ ID NO: 1322 - protein, 9 aa, BK virus
LLGLLLGLL

SEQ ID NO: 1323 - protein, 9 aa, BK virus
LGLLLGLLL

SEQ ID NO: 1324 - protein, 9 aa, BK virus
FKLLVVLVP

SEQ ID NO: 1325 - protein, 9 aa, BK virus
GISSLMIGI

SEQ ID NO: 1326 - protein, 9 aa, BK virus
ISSLMIGIT

SEQ ID NO: 1327 - protein, 9 aa, BK virus
SSLMIGITK

SEQ ID NO: 1328 - protein, 9 aa, BK virus
SLMIGITKF

SEQ ID NO: 1329 - protein, 9 aa, BK virus
LMIGITKFP

SEQ ID NO: 1330 - protein, 9 aa, BK virus
MIGITKFPL

SEQ ID NO: 1331 - protein, 9 aa, BK virus
ASISNQAWL

SEQ ID NO: 1332 - protein, 9 aa, BK virus
SISNQAWLW

SEQ ID NO: 1333 - protein, 9 aa, BK virus
ISNQAWLWN

SEQ ID NO: 1334 - protein, 9 aa, BK virus
SNQAWLWNC

SEQ ID NO: 1335 - protein, 9 aa, BK virus
NQAWLWNCL

SEQ ID NO: 1336 - protein, 9 aa, BK virus
QAWLWNCLT

SEQ ID NO: 1337 - protein, 9 aa, BK virus
AWLWNCLTQ

SEQ ID NO: 1338 - protein, 9 aa, BK virus
WLWNCLTQM

SEQ ID NO: 1339 - protein, 9 aa, BK virus
LWNCLTQMS

SEQ ID NO: 1340 - protein, 9 aa, BK virus
WNCLTQMST

SEQ ID NO: 1341 - protein, 9 aa, BK virus
NCLTQMSTM

SEQ ID NO: 1342 - protein, 9 aa, BK virus
CLTQMSTMI

SEQ ID NO: 1343 - protein, 9 aa, BK virus
LTQMSTMIF

SEQ ID NO: 1344 - protein, 9 aa, BK virus
TQMSTMIFC

SEQ ID NO: 1345 - protein, 9 aa, BK virus
QMSTMIFCF

SEQ ID NO: 1346 - protein, 9 aa, BK virus
MSTMIFCFL

SEQ ID NO: 1347 - protein, 9 aa, BK virus
STMIFCFLV

SEQ ID NO: 1348 - protein, 9 aa, BK virus
ILLLIIFNT

SEQ ID NO: 1349 - protein, 9 aa, BK virus
LLLIIFNTL

SEQ ID NO: 1350 - protein, 9 aa, BK virus
LLIIFNTLI

SEQ ID NO: 1351 - protein, 9 aa, BK virus
LIIFNTLIL

SEQ ID NO: 1352 - protein, 9 aa, BK virus
IIFNTLILG

SEQ ID NO: 1353 - protein, 9 aa, BK virus
IFNTLILGI

SEQ ID NO: 1354 - protein, 9 aa, BK virus
FNTLILGIG

SEQ ID NO: 1355 - protein, 9 aa, BK virus
NTLILGIGV

SEQ ID NO: 1356 - protein, 9 aa, BK virus
TLILGIGVL

SEQ ID NO: 1357 - protein, 9 aa, BK virus
LILGIGVLL

SEQ ID NO: 1358 - protein, 9 aa, BK virus
ILGIGVLLC

SEQ ID NO: 1359 - protein, 9 aa, BK virus
LGIGVLLCL

SEQ ID NO: 1360 - protein, 9 aa, BK virus
GIGVLLCLL

SEQ ID NO: 1361 - protein, 9 aa, BK virus
IGVLLCLLL

SEQ ID NO: 1362 - protein, 9 aa, BK virus
GVLLCLLLF

SEQ ID NO: 1363 - protein, 9 aa, BK virus
VLLCLLLFP

SEQ ID NO: 1364 - protein, 9 aa, BK virus
LLCLLLFPR

SEQ ID NO: 1365 - protein, 9 aa, BK virus
LCLLLFPRL

SEQ ID NO: 1366 - protein, 9 aa, BK virus
CLLLFPRLC

SEQ ID NO: 1367 - protein, 9 aa, BK virus
LLLFPRLCG

SEQ ID NO: 1368 - protein, 9 aa, BK virus
LLFPRLCGM

SEQ ID NO: 1369 - protein, 9 aa, BK virus
LFPRLCGML

SEQ ID NO: 1370 - protein, 9 aa, BK virus
FPRLCGMLL

SEQ ID NO: 1371 - protein, 9 aa, BK virus
PRLCGMLLG

SEQ ID NO: 1372 - protein, 9 aa, BK virus
RLCGMLLGM

SEQ ID NO: 1373 - protein, 9 aa, BK virus
LCGMLLGMI

SEQ ID NO: 1374 - protein, 9 aa, BK virus
CGMLLGMIY

SEQ ID NO: 1375 - protein, 9 aa, BK virus
GMLLGMIYL

SEQ ID NO: 1376 - protein, 9 aa, BK virus
MLLGMIYLL

SEQ ID NO: 1377 - protein, 9 aa, BK virus
PHRNCREEQ

SEQ ID NO: 1378 - protein, 9 aa, BK virus
HRNCREEQK

SEQ ID NO: 1379 - protein, 9 aa, BK virus
RNCREEQKD

SEQ ID NO: 1380 - protein, 9 aa, BK virus
NCREEQKDF

SEQ ID NO: 1381 - protein, 9 aa, BK virus
CREEQKDFL

SEQ ID NO: 1382 - protein, 9 aa, BK virus
REEQKDFLE

SEQ ID NO: 1383 - protein, 9 aa, BK virus
EEQKDFLET

SEQ ID NO: 1384 - protein, 9 aa, BK virus
EQKDFLETP

SEQ ID NO: 1385 - protein, 9 aa, BK virus
QKDFLETPW

SEQ ID NO: 1386 - protein, 9 aa, BK virus
KDFLETPWL

SEQ ID NO: 1387 - protein, 9 aa, BK virus
DFLETPWLD

SEQ ID NO: 1388 - protein, 9 aa, BK virus
FLETPWLDF

SEQ ID NO: 1389 - protein, 9 aa, BK virus
LETPWLDFW

SEQ ID NO: 1390 - protein, 9 aa, BK virus
ETPWLDFWR

SEQ ID NO: 1391 - protein, 9 aa, BK virus
TPWLDFWRK

SEQ ID NO: 1392 - protein, 9 aa, BK virus
PWLDFWRKL

SEQ ID NO: 1393 - protein, 9 aa, BK virus
WLDFWRKLP

SEQ ID NO: 1394 - protein, 9 aa, BK virus
LDFWRKLPG

SEQ ID NO: 1395 - protein, 9 aa, BK virus
DFWRKLPGQ

SEQ ID NO: 1396 - protein, 9 aa, BK virus
FWRKLPGQL

SEQ ID NO: 1397 - protein, 9 aa, BK virus
TFIIIFNNI

SEQ ID NO: 1398 - protein, 9 aa, BK virus
FIIIFNNII

SEQ ID NO: 1399 - protein, 9 aa, BK virus
IIIFNNIIL

SEQ ID NO: 1400 - protein, 9 aa, BK virus
IIFNNIILI

SEQ ID NO: 1401 - protein, 9 aa, BK virus
IFNNIILIF

SEQ ID NO: 1402 - protein, 9 aa, BK virus
FNNIILIFP

SEQ ID NO: 1403 - protein, 9 aa, BK virus
NNIILIFPL

SEQ ID NO: 1404 - protein, 9 aa, BK virus
NIILIFPLL

SEQ ID NO: 1405 - protein, 9 aa, BK virus
IILIFPLLG

SEQ ID NO: 1406 - protein, 9 aa, BK virus
ILIFPLLGP

SEQ ID NO: 1407 - protein, 9 aa, BK virus
LIFPLLGPQ

SEQ ID NO: 1408 - protein, 9 aa, BK virus
IFPLLGPQW

SEQ ID NO: 1409 - protein, 9 aa, BK virus
FPLLGPQWL

SEQ ID NO: 1410 - protein, 9 aa, BK virus
PLLGPQWLD

SEQ ID NO: 1411 - protein, 9 aa, BK virus
LLGPQWLDK

SEQ ID NO: 1412 - protein, 9 aa, BK virus
LKGKVPVYI

SEQ ID NO: 1413 - protein, 9 aa, BK virus
KGKVPVYIL

SEQ ID NO: 1414 - protein, 9 aa, BK virus
GKVPVYILA

SEQ ID NO: 1415 - protein, 9 aa, BK virus
KVPVYILAI

SEQ ID NO: 1416 - protein, 9 aa, BK virus
VPVYILAIL

SEQ ID NO: 1417 - protein, 9 aa, BK virus
PVYILAILI

SEQ ID NO: 1418 - protein, 9 aa, BK virus
VYILAILIV

SEQ ID NO: 1419 - protein, 9 aa, BK virus
EINKVYIQE

SEQ ID NO: 1420 - protein, 9 aa, BK virus
INKVYIQES

SEQ ID NO: 1421 - protein, 9 aa, BK virus
NKVYIQESL

SEQ ID NO: 1422 - protein, 9 aa, BK virus
KKLLPQEVL

SEQ ID NO: 1423 - protein, 9 aa, BK virus
KLLPQEVLI

SEQ ID NO: 1424 - protein, 9 aa, BK virus
LLPQEVLIK

SEQ ID NO: 1425 - protein, 9 aa, BK virus
LPQEVLIKE

SEQ ID NO: 1426 - protein, 9 aa, BK virus
PQEVLIKEL

SEQ ID NO: 1427 - protein, 9 aa, BK virus
QEVLIKELL

SEQ ID NO: 1428 - protein, 9 aa, BK virus
EVLIKELLL

SEQ ID NO: 1429 - protein, 9 aa, BK virus
VLIKELLLN

SEQ ID NO: 1430 - protein, 9 aa, BK virus
LIKELLLNG

SEQ ID NO: 1431 - protein, 9 aa, BK virus
IKELLLNGC

SEQ ID NO: 1432 - protein, 9 aa, BK virus
KELLLNGCC

SEQ ID NO: 1433 - protein, 9 aa, BK virus
ELLLNGCCL

SEQ ID NO: 1434 - protein, 9 aa, BK virus
LLLNGCCLY

SEQ ID NO: 1435 - protein, 9 aa, BK virus
LLNGCCLYF

SEQ ID NO: 1436 - protein, 9 aa, BK virus
HLLLKHMKM

SEQ ID NO: 1437 - protein, 9 aa, BK virus
LLLKHMKMA

SEQ ID NO: 1438 - protein, 9 aa, BK virus
LLKHMKMAP

SEQ ID NO: 1439 - protein, 9 aa, BK virus
LKHMKMAPT

SEQ ID NO: 1440 - protein, 9 aa, BK virus
KHMKMAPTK

SEQ ID NO: 1441 - protein, 9 aa, BK virus
HMKMAPTKR

SEQ ID NO: 1442 - protein, 9 aa, BK virus
MKMAPTKRK

SEQ ID NO: 1443 - protein, 9 aa, BK virus
KMAPTKRKG

SEQ ID NO: 1444 - protein, 9 aa, BK virus
MAPTKRKGE

SEQ ID NO: 1445 - protein, 9 aa, BK virus
APTKRKGEC

SEQ ID NO: 1446 - protein, 9 aa, BK virus
PTKRKGECP

SEQ ID NO: 1447 - protein, 9 aa, BK virus
TKRKGECPG

SEQ ID NO: 1448 - protein, 9 aa, BK virus
KRKGECPGA

SEQ ID NO: 1449 - protein, 9 aa, BK virus
RKGECPGAA

SEQ ID NO: 1450 - protein, 9 aa, BK virus
KGECPGAAP

SEQ ID NO: 1451 - protein, 9 aa, BK virus
GECPGAAPK

SEQ ID NO: 1452 - protein, 9 aa, BK virus
ECPGAAPKK

SEQ ID NO: 1453 - protein, 9 aa, BK virus
CPGAAPKKP

SEQ ID NO: 1454 - protein, 9 aa, BK virus
PGAAPKKPK

SEQ ID NO: 1455 - protein, 9 aa, BK virus
GAAPKKPKE

SEQ ID NO: 1456 - protein, 9 aa, BK virus
AAPKKPKEP

SEQ ID NO: 1457 - protein, 9 aa, BK virus
APKKPKEPV

SEQ ID NO: 1458 - protein, 9 aa, BK virus
PKKPKEPVQ

SEQ ID NO: 1459 - protein, 9 aa, BK virus
KKPKEPVQV

SEQ ID NO: 1460 - protein, 9 aa, BK virus
KPKEPVQVP

SEQ ID NO: 1461 - protein, 9 aa, BK virus
PKEPVQVPK

SEQ ID NO: 1462 - protein, 9 aa, BK virus
KEPVQVPKL

SEQ ID NO: 1463 - protein, 9 aa, BK virus
EPVQVPKLL

SEQ ID NO: 1464 - protein, 9 aa, BK virus
PVQVPKLLI

SEQ ID NO: 1465 - protein, 9 aa, BK virus
VQVPKLLIK

SEQ ID NO: 1466 - protein, 9 aa, BK virus
QVPKLLIKG

SEQ ID NO: 1467 - protein, 9 aa, BK virus
VPKLLIKGG

SEQ ID NO: 1468 - protein, 9 aa, BK virus
PKLLIKGGV

SEQ ID NO: 1469 - protein, 9 aa, BK virus
KLLIKGGVE

SEQ ID NO: 1470 - protein, 9 aa, BK virus
LLIKGGVEV

SEQ ID NO: 1471 - protein, 9 aa, BK virus
LIKGGVEVL

SEQ ID NO: 1472 - protein, 9 aa, BK virus
IKGGVEVLE

SEQ ID NO: 1473 - protein, 9 aa, BK virus
KGGVEVLEV

SEQ ID NO: 1474 - protein, 9 aa, BK virus
GGVEVLEVK

SEQ ID NO: 1475 - protein, 9 aa, BK virus
GVEVLEVKT

SEQ ID NO: 1476 - protein, 9 aa, BK virus
VEVLEVKTG

SEQ ID NO: 1477 - protein, 9 aa, BK virus
EVLEVKTGV

SEQ ID NO: 1478 - protein, 9 aa, BK virus
VLEVKTGVD

SEQ ID NO: 1479 - protein, 9 aa, BK virus
LEVKTGVDA

SEQ ID NO: 1480 - protein, 9 aa, BK virus
EVKTGVDAI

SEQ ID NO: 1481 - protein, 9 aa, BK virus
VKTGVDAIT

SEQ ID NO: 1482 - protein, 9 aa, BK virus
KTGVDAITE

SEQ ID NO: 1483 - protein, 9 aa, BK virus
TGVDAITEV

SEQ ID NO: 1484 - protein, 9 aa, BK virus
GVDAITEVE

SEQ ID NO: 1485 - protein, 9 aa, BK virus
VDAITEVEC

SEQ ID NO: 1486 - protein, 9 aa, BK virus
DAITEVECF

SEQ ID NO: 1487 - protein, 9 aa, BK virus
AITEVECFL

SEQ ID NO: 1488 - protein, 9 aa, BK virus
ITEVECFLN

SEQ ID NO: 1489 - protein, 9 aa, BK virus
TEVECFLNP

SEQ ID NO: 1490 - protein, 9 aa, BK virus
EVECFLNPE

SEQ ID NO: 1491 - protein, 9 aa, BK virus
VECFLNPEM

SEQ ID NO: 1492 - protein, 9 aa, BK virus
ECFLNPEMG

SEQ ID NO: 1493 - protein, 9 aa, BK virus
CFLNPEMGD

SEQ ID NO: 1494 - protein, 9 aa, BK virus
FLNPEMGDP

SEQ ID NO: 1495 - protein, 9 aa, BK virus
LNPEMGDPD

SEQ ID NO: 1496 - protein, 9 aa, BK virus
NPEMGDPDE

SEQ ID NO: 1497 - protein, 9 aa, BK virus
PEMGDPDEN

SEQ ID NO: 1498 - protein, 9 aa, BK virus
EMGDPDENL

SEQ ID NO: 1499 - protein, 9 aa, BK virus
MGDPDENLR

SEQ ID NO: 1500 - protein, 9 aa, BK virus
GDPDENLRG

SEQ ID NO: 1501 - protein, 9 aa, BK virus
DPDENLRGF

SEQ ID NO: 1502 - protein, 9 aa, BK virus
PDENLRGFS

SEQ ID NO: 1503 - protein, 9 aa, BK virus
DENLRGFSL

SEQ ID NO: 1504 - protein, 9 aa, BK virus
ENLRGFSLK

SEQ ID NO: 1505 - protein, 9 aa, BK virus
NLRGFSLKL

SEQ ID NO: 1506 - protein, 9 aa, BK virus
LRGFSLKLS

SEQ ID NO: 1507 - protein, 9 aa, BK virus
RGFSLKLSA

SEQ ID NO: 1508 - protein, 9 aa, BK virus
GFSLKLSAE

SEQ ID NO: 1509 - protein, 9 aa, BK virus
FSLKLSAEN

SEQ ID NO: 1510 - protein, 9 aa, BK virus
SLKLSAEND

SEQ ID NO: 1511 - protein, 9 aa, BK virus
LKLSAENDF

SEQ ID NO: 1512 - protein, 9 aa, BK virus
KLSAENDFS

SEQ ID NO: 1513 - protein, 9 aa, BK virus
LSAENDFSS

SEQ ID NO: 1514 - protein, 9 aa, BK virus
SAENDFSSD

SEQ ID NO: 1515 - protein, 9 aa, BK virus
AENDFSSDS

SEQ ID NO: 1516 - protein, 9 aa, BK virus
ENDFSSDSP

SEQ ID NO: 1517 - protein, 9 aa, BK virus
NDFSSDSPE

SEQ ID NO: 1518 - protein, 9 aa, BK virus
DFSSDSPER

SEQ ID NO: 1519 - protein, 9 aa, BK virus
FSSDSPERK

SEQ ID NO: 1520 - protein, 9 aa, BK virus
SSDSPERKM

SEQ ID NO: 1521 - protein, 9 aa, BK virus
SDSPERKML

SEQ ID NO: 1522 - protein, 9 aa, BK virus
DSPERKMLP

SEQ ID NO: 1523 - protein, 9 aa, BK virus
SPERKMLPC

SEQ ID NO: 1524 - protein, 9 aa, BK virus
PERKMLPCY

SEQ ID NO: 1525 - protein, 9 aa, BK virus
ERKMLPCYS

SEQ ID NO: 1526 - protein, 9 aa, BK virus
RKMLPCYST

SEQ ID NO: 1527 - protein, 9 aa, BK virus
KMLPCYSTA

SEQ ID NO: 1528 - protein, 9 aa, BK virus
MLPCYSTAR

SEQ ID NO: 1529 - protein, 9 aa, BK virus
LPCYSTARI

SEQ ID NO: 1530 - protein, 9 aa, BK virus
PCYSTARIP

SEQ ID NO: 1531 - protein, 9 aa, BK virus
CYSTARIPL

SEQ ID NO: 1532 - protein, 9 aa, BK virus
YSTARIPLP

SEQ ID NO: 1533 - protein, 9 aa, BK virus
STARIPLPN

SEQ ID NO: 1534 - protein, 9 aa, BK virus
TARIPLPNL

SEQ ID NO: 1535 - protein, 9 aa, BK virus
ARIPLPNLN

SEQ ID NO: 1536 - protein, 9 aa, BK virus
RIPLPNLNE

SEQ ID NO: 1537 - protein, 9 aa, BK virus
IPLPNLNED

SEQ ID NO: 1538 - protein, 9 aa, BK virus
PLPNLNEDL

SEQ ID NO: 1539 - protein, 9 aa, BK virus
LPNLNEDLT

SEQ ID NO: 1540 - protein, 9 aa, BK virus
PNLNEDLTC

SEQ ID NO: 1541 - protein, 9 aa, BK virus
NLNEDLTCG

SEQ ID NO: 1542 - protein, 9 aa, BK virus
LNEDLTCGN

SEQ ID NO: 1543 - protein, 9 aa, BK virus
NEDLTCGNL

SEQ ID NO: 1544 - protein, 9 aa, BK virus
EDLTCGNLL

SEQ ID NO: 1545 - protein, 9 aa, BK virus
DLTCGNLLM

SEQ ID NO: 1546 - protein, 9 aa, BK virus
LTCGNLLMW

SEQ ID NO: 1547 - protein, 9 aa, BK virus
TCGNLLMWE

SEQ ID NO: 1548 - protein, 9 aa, BK virus
CGNLLMWEA

SEQ ID NO: 1549 - protein, 9 aa, BK virus
GNLLMWEAV

SEQ ID NO: 1550 - protein, 9 aa, BK virus
NLLMWEAVT

SEQ ID NO: 1551 - protein, 9 aa, BK virus
LLMWEAVTV

SEQ ID NO: 1552 - protein, 9 aa, BK virus
LMWEAVTVQ

SEQ ID NO: 1553 - protein, 9 aa, BK virus
MWEAVTVQT

SEQ ID NO: 1554 - protein, 9 aa, BK virus
WEAVTVQTE

SEQ ID NO: 1555 - protein, 9 aa, BK virus
EAVTVQTEV

SEQ ID NO: 1556 - protein, 9 aa, BK virus
AVTVQTEVI

SEQ ID NO: 1557 - protein, 9 aa, BK virus
VTVQTEVIG

SEQ ID NO: 1558 - protein, 9 aa, BK virus
TVQTEVIGI

SEQ ID NO: 1559 - protein, 9 aa, BK virus
VQTEVIGIT

SEQ ID NO: 1560 - protein, 9 aa, BK virus
QTEVIGITS

SEQ ID NO: 1561 - protein, 9 aa, BK virus
TEVIGITSM

SEQ ID NO: 1562 - protein, 9 aa, BK virus
EVIGITSML

SEQ ID NO: 1563 - protein, 9 aa, BK virus
VIGITSMLN

SEQ ID NO: 1564 - protein, 9 aa, BK virus
IGITSMLNL

SEQ ID NO: 1565 - protein, 9 aa, BK virus
GITSMLNLH

SEQ ID NO: 1566 - protein, 9 aa, BK virus
ITSMLNLHA

SEQ ID NO: 1567 - protein, 9 aa, BK virus
TSMLNLHAG

SEQ ID NO: 1568 - protein, 9 aa, BK virus
SMLNLHAGS

SEQ ID NO: 1569 - protein, 9 aa, BK virus
MLNLHAGSQ

SEQ ID NO: 1570 - protein, 9 aa, BK virus
LNLHAGSQK

SEQ ID NO: 1571 - protein, 9 aa, BK virus
NLHAGSQKV

SEQ ID NO: 1572 - protein, 9 aa, BK virus
LHAGSQKVH

SEQ ID NO: 1573 - protein, 9 aa, BK virus
HAGSQKVHE

SEQ ID NO: 1574 - protein, 9 aa, BK virus
AGSQKVHEH

SEQ ID NO: 1575 - protein, 9 aa, BK virus
GSQKVHEHG

SEQ ID NO: 1576 - protein, 9 aa, BK virus
SQKVHEHGG

SEQ ID NO: 1577 - protein, 9 aa, BK virus
QKVHEHGGG

SEQ ID NO: 1578 - protein, 9 aa, BK virus
KVHEHGGGK

SEQ ID NO: 1579 - protein, 9 aa, BK virus
VHEHGGGKP

SEQ ID NO: 1580 - protein, 9 aa, BK virus
HEHGGGKPI

SEQ ID NO: 1581 - protein, 9 aa, BK virus
EHGGGKPIQ

SEQ ID NO: 1582 - protein, 9 aa, BK virus
HGGGKPIQG

SEQ ID NO: 1583 - protein, 9 aa, BK virus
GGGKPIQGS

SEQ ID NO: 1584 - protein, 9 aa, BK virus
GGKPIQGSN

SEQ ID NO: 1585 - protein, 9 aa, BK virus
GKPIQGSNF

SEQ ID NO: 1586 - protein, 9 aa, BK virus
KPIQGSNFH

SEQ ID NO: 1587 - protein, 9 aa, BK virus
PIQGSNFHF

SEQ ID NO: 1588 - protein, 9 aa, BK virus
IQGSNFHFF

SEQ ID NO: 1589 - protein, 9 aa, BK virus
QGSNFHFFA

SEQ ID NO: 1590 - protein, 9 aa, BK virus
GSNFHFFAV

SEQ ID NO: 1591 - protein, 9 aa, BK virus
SNFHFFAVG

SEQ ID NO: 1592 - protein, 9 aa, BK virus
NFHFFAVGG

SEQ ID NO: 1593 - protein, 9 aa, BK virus
FHFFAVGGE

SEQ ID NO: 1594 - protein, 9 aa, BK virus
HFFAVGGEP

SEQ ID NO: 1595 - protein, 9 aa, BK virus
FFAVGGEPL

SEQ ID NO: 1596 - protein, 9 aa, BK virus
FAVGGEPLE

SEQ ID NO: 1597 - protein, 9 aa, BK virus
AVGGEPLEM

SEQ ID NO: 1598 - protein, 9 aa, BK virus
VGGEPLEMQ

SEQ ID NO: 1599 - protein, 9 aa, BK virus
GGEPLEMQG

SEQ ID NO: 1600 - protein, 9 aa, BK virus
GEPLEMQGV

SEQ ID NO: 1601 - protein, 9 aa, BK virus
EPLEMQGVL

SEQ ID NO: 1602 - protein, 9 aa, BK virus
PLEMQGVLM

SEQ ID NO: 1603 - protein, 9 aa, BK virus
LEMQGVLMN

SEQ ID NO: 1604 - protein, 9 aa, BK virus
EMQGVLMNY

SEQ ID NO: 1605 - protein, 9 aa, BK virus
MQGVLMNYR

SEQ ID NO: 1606 - protein, 9 aa, BK virus
QGVLMNYRS

SEQ ID NO: 1607 - protein, 9 aa, BK virus
GVLMNYRSK

SEQ ID NO: 1608 - protein, 9 aa, BK virus
VLMNYRSKY

SEQ ID NO: 1609 - protein, 9 aa, BK virus
LMNYRSKYP

SEQ ID NO: 1610 - protein, 9 aa, BK virus
MNYRSKYPD

SEQ ID NO: 1611 - protein, 9 aa, BK virus
NYRSKYPDG

SEQ ID NO: 1612 - protein, 9 aa, BK virus
YRSKYPDGT

SEQ ID NO: 1613 - protein, 9 aa, BK virus
RSKYPDGTI

SEQ ID NO: 1614 - protein, 9 aa, BK virus
SKYPDGTIT

SEQ ID NO: 1615 - protein, 9 aa, BK virus
KYPDGTITP

SEQ ID NO: 1616 - protein, 9 aa, BK virus
YPDGTITPK

SEQ ID NO: 1617 - protein, 9 aa, BK virus
PDGTITPKN

SEQ ID NO: 1618 - protein, 9 aa, BK virus
DGTITPKNP

SEQ ID NO: 1619 - protein, 9 aa, BK virus
GTITPKNPT

SEQ ID NO: 1620 - protein, 9 aa, BK virus
TITPKNPTA

SEQ ID NO: 1621 - protein, 9 aa, BK virus
ITPKNPTAQ

SEQ ID NO: 1622 - protein, 9 aa, BK virus
TPKNPTAQS

SEQ ID NO: 1623 - protein, 9 aa, BK virus
PKNPTAQSQ

SEQ ID NO: 1624 - protein, 9 aa, BK virus
KNPTAQSQV

SEQ ID NO: 1625 - protein, 9 aa, BK virus
NPTAQSQVM

SEQ ID NO: 1626 - protein, 9 aa, BK virus
PTAQSQVMN

SEQ ID NO: 1627 - protein, 9 aa, BK virus
TAQSQVMNT

SEQ ID NO: 1628 - protein, 9 aa, BK virus
AQSQVMNTD

SEQ ID NO: 1629 - protein, 9 aa, BK virus
QSQVMNTDH

SEQ ID NO: 1630 - protein, 9 aa, BK virus
SQVMNTDHK

SEQ ID NO: 1631 - protein, 9 aa, BK virus
QVMNTDHKA

SEQ ID NO: 1632 - protein, 9 aa, BK virus
VMNTDHKAY

SEQ ID NO: 1633 - protein, 9 aa, BK virus
MNTDHKAYL

SEQ ID NO: 1634 - protein, 9 aa, BK virus
NTDHKAYLD

SEQ ID NO: 1635 - protein, 9 aa, BK virus
TDHKAYLDK

SEQ ID NO: 1636 - protein, 9 aa, BK virus
DHKAYLDKN

SEQ ID NO: 1637 - protein, 9 aa, BK virus
HKAYLDKNN

SEQ ID NO: 1638 - protein, 9 aa, BK virus
KAYLDKNNA

SEQ ID NO: 1639 - protein, 9 aa, BK virus
AYLDKNNAY

SEQ ID NO: 1640 - protein, 9 aa, BK virus
YLDKNNAYP

SEQ ID NO: 1641 - protein, 9 aa, BK virus
LDKNNAYPV

SEQ ID NO: 1642 - protein, 9 aa, BK virus
DKNNAYPVE

SEQ ID NO: 1643 - protein, 9 aa, BK virus
KNNAYPVEC

SEQ ID NO: 1644 - protein, 9 aa, BK virus
NNAYPVECW

SEQ ID NO: 1645 - protein, 9 aa, BK virus
NAYPVECWV

SEQ ID NO: 1646 - protein, 9 aa, BK virus
AYPVECWVP

SEQ ID NO: 1647 - protein, 9 aa, BK virus
YPVECWVPD

SEQ ID NO: 1648 - protein, 9 aa, BK virus
PVECWVPDP

SEQ ID NO: 1649 - protein, 9 aa, BK virus
VECWVPDPS

SEQ ID NO: 1650 - protein, 9 aa, BK virus
ECWVPDPSR

SEQ ID NO: 1651 - protein, 9 aa, BK virus
CWVPDPSRN

SEQ ID NO: 1652 - protein, 9 aa, BK virus
WVPDPSRNE

SEQ ID NO: 1653 - protein, 9 aa, BK virus
VPDPSRNEN

SEQ ID NO: 1654 - protein, 9 aa, BK virus
PDPSRNENA

SEQ ID NO: 1655 - protein, 9 aa, BK virus
DPSRNENAR

SEQ ID NO: 1656 - protein, 9 aa, BK virus
PSRNENARY

SEQ ID NO: 1657 - protein, 9 aa, BK virus
SRNENARYF

SEQ ID NO: 1658 - protein, 9 aa, BK virus
RNENARYFG

SEQ ID NO: 1659 - protein, 9 aa, BK virus
NENARYFGT

SEQ ID NO: 1660 - protein, 9 aa, BK virus
ENARYFGTF

SEQ ID NO: 1661 - protein, 9 aa, BK virus
NARYFGTFT

SEQ ID NO: 1662 - protein, 9 aa, BK virus
ARYFGTFTG

SEQ ID NO: 1663 - protein, 9 aa, BK virus
RYFGTFTGG

SEQ ID NO: 1664 - protein, 9 aa, BK virus
YFGTFTGGE

SEQ ID NO: 1665 - protein, 9 aa, BK virus
FGTFTGGEN

SEQ ID NO: 1666 - protein, 9 aa, BK virus
GTFTGGENV

SEQ ID NO: 1667 - protein, 9 aa, BK virus
TFTGGENVP

SEQ ID NO: 1668 - protein, 9 aa, BK virus
FTGGENVPP

SEQ ID NO: 1669 - protein, 9 aa, BK virus
TGGENVPPV

SEQ ID NO: 1670 - protein, 9 aa, BK virus
GGENVPPVL

SEQ ID NO: 1671 - protein, 9 aa, BK virus
GENVPPVLH

SEQ ID NO: 1672 - protein, 9 aa, BK virus
ENVPPVLHV

SEQ ID NO: 1673 - protein, 9 aa, BK virus
NVPPVLHVT

SEQ ID NO: 1674 - protein, 9 aa, BK virus
VPPVLHVTN

SEQ ID NO: 1675 - protein, 9 aa, BK virus
PPVLHVTNT

SEQ ID NO: 1676 - protein, 9 aa, BK virus
PVLHVTNTA

SEQ ID NO: 1677 - protein, 9 aa, BK virus
VLHVTNTAT

SEQ ID NO: 1678 - protein, 9 aa, BK virus
LHVTNTATT

SEQ ID NO: 1679 - protein, 9 aa, BK virus
HVTNTATTV

SEQ ID NO: 1680 - protein, 9 aa, BK virus
VTNTATTVL

SEQ ID NO: 1681 - protein, 9 aa, BK virus
TNTATTVLL

SEQ ID NO: 1682 - protein, 9 aa, BK virus
NTATTVLLD

SEQ ID NO: 1683 - protein, 9 aa, BK virus
TATTVLLDE

SEQ ID NO: 1684 - protein, 9 aa, BK virus
ATTVLLDEQ

SEQ ID NO: 1685 - protein, 9 aa, BK virus
TTVLLDEQG

SEQ ID NO: 1686 - protein, 9 aa, BK virus
TVLLDEQGV

SEQ ID NO: 1687 - protein, 9 aa, BK virus
VLLDEQGVG

SEQ ID NO: 1688 - protein, 9 aa, BK virus
LLDEQGVGP

SEQ ID NO: 1689 - protein, 9 aa, BK virus
LDEQGVGPL

SEQ ID NO: 1690 - protein, 9 aa, BK virus
DEQGVGPLC

SEQ ID NO: 1691 - protein, 9 aa, BK virus
EQGVGPLCK

SEQ ID NO: 1692 - protein, 9 aa, BK virus
QGVGPLCKA

SEQ ID NO: 1693 - protein, 9 aa, BK virus
GVGPLCKAD

SEQ ID NO: 1694 - protein, 9 aa, BK virus
VGPLCKADS

SEQ ID NO: 1695 - protein, 9 aa, BK virus
GPLCKADSL

SEQ ID NO: 1696 - protein, 9 aa, BK virus
PLCKADSLY

SEQ ID NO: 1697 - protein, 9 aa, BK virus
LCKADSLYV

SEQ ID NO: 1698 - protein, 9 aa, BK virus
CKADSLYVS

SEQ ID NO: 1699 - protein, 9 aa, BK virus
KADSLYVSA

SEQ ID NO: 1700 - protein, 9 aa, BK virus
ADSLYVSAA

SEQ ID NO: 1701 - protein, 9 aa, BK virus
DSLYVSAAD

SEQ ID NO: 1702 - protein, 9 aa, BK virus
SLYVSAADI

SEQ ID NO: 1703 - protein, 9 aa, BK virus
LYVSAADIC

SEQ ID NO: 1704 - protein, 9 aa, BK virus
YVSAADICG

SEQ ID NO: 1705 - protein, 9 aa, BK virus
VSAADICGL

SEQ ID NO: 1706 - protein, 9 aa, BK virus
SAADICGLF

SEQ ID NO: 1707 - protein, 9 aa, BK virus
AADICGLFT

SEQ ID NO: 1708 - protein, 9 aa, BK virus
ADICGLFTN

SEQ ID NO: 1709 - protein, 9 aa, BK virus
DICGLFTNS

SEQ ID NO: 1710 - protein, 9 aa, BK virus
ICGLFTNSS

SEQ ID NO: 1711 - protein, 9 aa, BK virus
CGLFTNSSG

SEQ ID NO: 1712 - protein, 9 aa, BK virus
GLFTNSSGT

SEQ ID NO: 1713 - protein, 9 aa, BK virus
LFTNSSGTQ

SEQ ID NO: 1714 - protein, 9 aa, BK virus
FTNSSGTQQ

SEQ ID NO: 1715 - protein, 9 aa, BK virus
TNSSGTQQW

SEQ ID NO: 1716 - protein, 9 aa, BK virus
NSSGTQQWR

SEQ ID NO: 1717 - protein, 9 aa, BK virus
SSGTQQWRG

SEQ ID NO: 1718 - protein, 9 aa, BK virus
SGTQQWRGL

SEQ ID NO: 1719 - protein, 9 aa, BK virus
GTQQWRGLA

SEQ ID NO: 1720 - protein, 9 aa, BK virus
TQQWRGLAR

SEQ ID NO: 1721 - protein, 9 aa, BK virus
QQWRGLARY

SEQ ID NO: 1722 - protein, 9 aa, BK virus
QWRGLARYF

SEQ ID NO: 1723 - protein, 9 aa, BK virus
WRGLARYFK

SEQ ID NO: 1724 - protein, 9 aa, BK virus
RGLARYFKI

SEQ ID NO: 1725 - protein, 9 aa, BK virus
GLARYFKIR

SEQ ID NO: 1726 - protein, 9 aa, BK virus
LARYFKIRL

SEQ ID NO: 1727 - protein, 9 aa, BK virus
ARYFKIRLR

SEQ ID NO: 1728 - protein, 9 aa, BK virus
RYFKIRLRK

SEQ ID NO: 1729 - protein, 9 aa, BK virus
YFKIRLRKR

SEQ ID NO: 1730 - protein, 9 aa, BK virus
FKIRLRKRS

SEQ ID NO: 1731 - protein, 9 aa, BK virus
KIRLRKRSV

SEQ ID NO: 1732 - protein, 9 aa, BK virus
IRLRKRSVK

SEQ ID NO: 1733 - protein, 9 aa, BK virus
RLRKRSVKN

SEQ ID NO: 1734 - protein, 9 aa, BK virus
LRKRSVKNP

SEQ ID NO: 1735 - protein, 9 aa, BK virus
RKRSVKNPY

SEQ ID NO: 1736 - protein, 9 aa, BK virus
KRSVKNPYP

SEQ ID NO: 1737 - protein, 9 aa, BK virus
RSVKNPYPI

SEQ ID NO: 1738 - protein, 9 aa, BK virus
SVKNPYPIS

SEQ ID NO: 1739 - protein, 9 aa, BK virus
VKNPYPISF

SEQ ID NO: 1740 - protein, 9 aa, BK virus
KNPYPISFL

SEQ ID NO: 1741 - protein, 9 aa, BK virus
NPYPISFLL

SEQ ID NO: 1742 - protein, 9 aa, BK virus
PYPISFLLS

SEQ ID NO: 1743 - protein, 9 aa, BK virus
YPISFLLSD

SEQ ID NO: 1744 - protein, 9 aa, BK virus
PISFLLSDL

SEQ ID NO: 1745 - protein, 9 aa, BK virus
ISFLLSDLI

SEQ ID NO: 1746 - protein, 9 aa, BK virus
SFLLSDLIN

SEQ ID NO: 1747 - protein, 9 aa, BK virus
FLLSDLINR

SEQ ID NO: 1748 - protein, 9 aa, BK virus
LLSDLINRR

SEQ ID NO: 1749 - protein, 9 aa, BK virus
LSDLINRRT

SEQ ID NO: 1750 - protein, 9 aa, BK virus
SDLINRRTQ

SEQ ID NO: 1751 - protein, 9 aa, BK virus
DLINRRTQR

SEQ ID NO: 1752 - protein, 9 aa, BK virus
LINRRTQRV

SEQ ID NO: 1753 - protein, 9 aa, BK virus
INRRTQRVD

SEQ ID NO: 1754 - protein, 9 aa, BK virus
NRRTQRVDG

SEQ ID NO: 1755 - protein, 9 aa, BK virus
RRTQRVDGQ

SEQ ID NO: 1756 - protein, 9 aa, BK virus
RTQRVDGQP

SEQ ID NO: 1757 - protein, 9 aa, BK virus
TQRVDGQPM

SEQ ID NO: 1758 - protein, 9 aa, BK virus
QRVDGQPMY

SEQ ID NO: 1759 - protein, 9 aa, BK virus
RVDGQPMYG

SEQ ID NO: 1760 - protein, 9 aa, BK virus
VDGQPMYGM

SEQ ID NO: 1761 - protein, 9 aa, BK virus
DGQPMYGME

SEQ ID NO: 1762 - protein, 9 aa, BK virus
GQPMYGMES

SEQ ID NO: 1763 - protein, 9 aa, BK virus
QPMYGMESQ

SEQ ID NO: 1764 - protein, 9 aa, BK virus
PMYGMESQV

SEQ ID NO: 1765 - protein, 9 aa, BK virus
MYGMESQVE

SEQ ID NO: 1766 - protein, 9 aa, BK virus
YGMESQVEE

SEQ ID NO: 1767 - protein, 9 aa, BK virus
GMESQVEEV

SEQ ID NO: 1768 - protein, 9 aa, BK virus
MESQVEEVR

SEQ ID NO: 1769 - protein, 9 aa, BK virus
ESQVEEVRV

SEQ ID NO: 1770 - protein, 9 aa, BK virus
SQVEEVRVF

SEQ ID NO: 1771 - protein, 9 aa, BK virus
QVEEVRVFD

SEQ ID NO: 1772 - protein, 9 aa, BK virus
VEEVRVFDG

SEQ ID NO: 1773 - protein, 9 aa, BK virus
EEVRVFDGT

SEQ ID NO: 1774 - protein, 9 aa, BK virus
EVRVFDGTE

SEQ ID NO: 1775 - protein, 9 aa, BK virus
VRVFDGTER

SEQ ID NO: 1776 - protein, 9 aa, BK virus
RVFDGTERL

SEQ ID NO: 1777 - protein, 9 aa, BK virus
VFDGTERLP

SEQ ID NO: 1778 - protein, 9 aa, BK virus
FDGTERLPG

SEQ ID NO: 1779 - protein, 9 aa, BK virus
DGTERLPGD

SEQ ID NO: 1780 - protein, 9 aa, BK virus
GTERLPGDP

SEQ ID NO: 1781 - protein, 9 aa, BK virus
TERLPGDPD

SEQ ID NO: 1782 - protein, 9 aa, BK virus
ERLPGDPDM

SEQ ID NO: 1783 - protein, 9 aa, BK virus
RLPGDPDMI

SEQ ID NO: 1784 - protein, 9 aa, BK virus
LPGDPDMIR

SEQ ID NO: 1785 - protein, 9 aa, BK virus
PGDPDMIRY

SEQ ID NO: 1786 - protein, 9 aa, BK virus
GDPDMIRYI

SEQ ID NO: 1787 - protein, 9 aa, BK virus
DPDMIRYID

SEQ ID NO: 1788 - protein, 9 aa, BK virus
PDMIRYIDK

SEQ ID NO: 1789 - protein, 9 aa, BK virus
DMIRYIDKQ

SEQ ID NO: 1790 - protein, 9 aa, BK virus
MIRYIDKQG

SEQ ID NO: 1791 - protein, 9 aa, BK virus
IRYIDKQGQ

SEQ ID NO: 1792 - protein, 9 aa, BK virus
RYIDKQGQL

SEQ ID NO: 1793 - protein, 9 aa, BK virus
YIDKQGQLQ

SEQ ID NO: 1794 - protein, 9 aa, BK virus
IDKQGQLQT

SEQ ID NO: 1795 - protein, 9 aa, BK virus
DKQGQLQTK

SEQ ID NO: 1796 - protein, 9 aa, BK virus
KQGQLQTKM

SEQ ID NO: 1797 - protein, 9 aa, BK virus
QGQLQTKML

SEQ ID NO: 1798 - protein, 9 aa, BK virus
TGAFIVHIH

SEQ ID NO: 1799 - protein, 9 aa, BK virus
GAFIVHIHL

SEQ ID NO: 1800 - protein, 9 aa, BK virus
AFIVHIHLI

SEQ ID NO: 1801 - protein, 9 aa, BK virus
FIVHIHLIN

SEQ ID NO: 1802 - protein, 9 aa, BK virus
IVHIHLINA

SEQ ID NO: 1803 - protein, 9 aa, BK virus
VHIHLINAA

SEQ ID NO: 1804 - protein, 9 aa, BK virus
HIHLINAAF

SEQ ID NO: 1805 - protein, 9 aa, BK virus
IHLINAAFV

SEQ ID NO: 1806 - protein, 9 aa, BK virus
ATFKLVLFW

SEQ ID NO: 1807 - protein, 9 aa, BK virus
TFKLVLFWG

SEQ ID NO: 1808 - protein, 9 aa, BK virus
FKLVLFWGW

SEQ ID NO: 1809 - protein, 9 aa, BK virus
KLVLFWGWC

SEQ ID NO: 1810 - protein, 9 aa, BK virus
LVLFWGWCF

SEQ ID NO: 1811 - protein, 9 aa, BK virus
VLFWGWCFR

SEQ ID NO: 1812 - protein, 9 aa, BK virus
LFWGWCFRP

SEQ ID NO: 1813 - protein, 9 aa, BK virus
FWGWCFRPF

SEQ ID NO: 1814 - protein, 9 aa, BK virus
WGWCFRPFK

SEQ ID NO: 1815 - protein, 9 aa, BK virus
GWCFRPFKT

SEQ ID NO: 1816 - protein, 9 aa, BK virus
WCFRPFKTL

SEQ ID NO: 1817 - protein, 9 aa, BK virus
CFRPFKTLK

SEQ ID NO: 1818 - protein, 9 aa, BK virus
FRPFKTLKA

SEQ ID NO: 1819 - protein, 9 aa, BK virus
RPFKTLKAF

SEQ ID NO: 1820 - protein, 9 aa, BK virus
PFKTLKAFT

SEQ ID NO: 1821 - protein, 9 aa, BK virus
FKTLKAFTQ

SEQ ID NO: 1822 - protein, 9 aa, BK virus
KTLKAFTQM

SEQ ID NO: 1823 - protein, 9 aa, BK virus
TLKAFTQMQ

SEQ ID NO: 1824 - protein, 9 aa, BK virus
LKAFTQMQL

SEQ ID NO: 1825 - protein, 9 aa, BK virus
KAFTQMQLL

SEQ ID NO: 1826 - protein, 9 aa, BK virus
AFTQMQLLT

SEQ ID NO: 1827 - protein, 9 aa, BK virus
FTQMQLLTM

SEQ ID NO: 1828 - protein, 9 aa, BK virus
TQMQLLTMG

SEQ ID NO: 1829 - protein, 9 aa, BK virus
QMQLLTMGV

SEQ ID NO: 1830 - protein, 9 aa, BK virus
ILFSCNIKN

SEQ ID NO: 1831 - protein, 9 aa, BK virus
LFSCNIKNT

SEQ ID NO: 1832 - protein, 9 aa, BK virus
FSCNIKNTF

SEQ ID NO: 1833 - protein, 9 aa, BK virus
SCNIKNTFP

SEQ ID NO: 1834 - protein, 9 aa, BK virus
CNIKNTFPH

SEQ ID NO: 1835 - protein, 9 aa, BK virus
NIKNTFPHA

SEQ ID NO: 1836 - protein, 9 aa, BK virus
IKNTFPHAY

SEQ ID NO: 1837 - protein, 9 aa, BK virus
KNTFPHAYI

SEQ ID NO: 1838 - protein, 9 aa, BK virus
NTFPHAYII

SEQ ID NO: 1839 - protein, 9 aa, BK virus
TFPHAYIIF

SEQ ID NO: 1840 - protein, 9 aa, BK virus
FPHAYIIFH

SEQ ID NO: 1841 - protein, 9 aa, BK virus
PHAYIIFHP

SEQ ID NO: 1842 - protein, 9 aa, BK virus
KSIHTYLRI

SEQ ID NO: 1843 - protein, 9 aa, BK virus
SIHTYLRIQ

SEQ ID NO: 1844 - protein, 9 aa, BK virus
IHTYLRIQP

SEQ ID NO: 1845 - protein, 9 aa, BK virus
HTYLRIQPF

SEQ ID NO: 1846 - protein, 9 aa, BK virus
TYLRIQPFL

SEQ ID NO: 1847 - protein, 9 aa, BK virus
YLRIQPFLP

SEQ ID NO: 1848 - protein, 9 aa, BK virus
LRIQPFLPF

SEQ ID NO: 1849 - protein, 9 aa, BK virus
RIQPFLPFN

SEQ ID NO: 1850 - protein, 9 aa, BK virus
IQPFLPFNN

SEQ ID NO: 1851 - protein, 9 aa, BK virus
QPFLPFNNS

SEQ ID NO: 1852 - protein, 9 aa, BK virus
PFLPFNNSR

SEQ ID NO: 1853 - protein, 9 aa, BK virus
FLPFNNSRL

SEQ ID NO: 1854 - protein, 9 aa, BK virus
LPFNNSRLY

SEQ ID NO: 1855 - protein, 9 aa, BK virus
PFNNSRLYI

SEQ ID NO: 1856 - protein, 9 aa, BK virus
FNNSRLYIS

SEQ ID NO: 1857 - protein, 9 aa, BK virus
NNSRLYISC

SEQ ID NO: 1858 - protein, 9 aa, BK virus
NSRLYISCK

SEQ ID NO: 1859 - protein, 9 aa, BK virus
SRLYISCKI

SEQ ID NO: 1860 - protein, 9 aa, BK virus
RLYISCKIS

SEQ ID NO: 1861 - protein, 9 aa, BK virus
LYISCKISY

SEQ ID NO: 1862 - protein, 9 aa, BK virus
YISCKISYR

SEQ ID NO: 1863 - protein, 9 aa, BK virus
ISCKISYRP

SEQ ID NO: 1864 - protein, 9 aa, BK virus
SCKISYRPK

SEQ ID NO: 1865 - protein, 9 aa, BK virus
CKISYRPKP

SEQ ID NO: 1866 - protein, 9 aa, BK virus
KISYRPKPN

SEQ ID NO: 1867 - protein, 9 aa, BK virus
IYFGPKIYL

SEQ ID NO: 1868 - protein, 9 aa, BK virus
YFGPKIYLS

SEQ ID NO: 1869 - protein, 9 aa, BK virus
FGPKIYLSY

SEQ ID NO: 1870 - protein, 9 aa, BK virus
GPKIYLSYK

SEQ ID NO: 1871 - protein, 9 aa, BK virus
PKIYLSYKS

SEQ ID NO: 1872 - protein, 9 aa, BK virus
KIYLSYKSS

SEQ ID NO: 1873 - protein, 9 aa, BK virus
IYLSYKSSL

SEQ ID NO: 1874 - protein, 9 aa, BK virus
YLSYKSSLQ

SEQ ID NO: 1875 - protein, 9 aa, BK virus
LSYKSSLQG

SEQ ID NO: 1876 - protein, 9 aa, BK virus
SYKSSLQGF

SEQ ID NO: 1877 - protein, 9 aa, BK virus
YKSSLQGFR

SEQ ID NO: 1878 - protein, 9 aa, BK virus
KSSLQGFRD

SEQ ID NO: 1879 - protein, 9 aa, BK virus
SSLQGFRDR

SEQ ID NO: 1880 - protein, 9 aa, BK virus
SLQGFRDRI

SEQ ID NO: 1881 - protein, 9 aa, BK virus
LQGFRDRIL

SEQ ID NO: 1882 - protein, 9 aa, BK virus
QGFRDRILI

SEQ ID NO: 1883 - protein, 9 aa, BK virus
GFRDRILIH

SEQ ID NO: 1884 - protein, 9 aa, BK virus
FRDRILIHC

SEQ ID NO: 1885 - protein, 9 aa, BK virus
RDRILIHCN

SEQ ID NO: 1886 - protein, 9 aa, BK virus
DRILIHCNQ

SEQ ID NO: 1887 - protein, 9 aa, BK virus
RILIHCNQA

SEQ ID NO: 1888 - protein, 9 aa, BK virus
ILIHCNQAW

SEQ ID NO: 1889 - protein, 9 aa, BK virus
LIHCNQAWW

SEQ ID NO: 1890 - protein, 9 aa, BK virus
IHCNQAWWK

SEQ ID NO: 1891 - protein, 9 aa, BK virus
HCNQAWWKY

SEQ ID NO: 1892 - protein, 9 aa, BK virus
CNQAWWKYL

SEQ ID NO: 1893 - protein, 9 aa, BK virus
NQAWWKYLG

SEQ ID NO: 1894 - protein, 9 aa, BK virus
QAWWKYLGS

SEQ ID NO: 1895 - protein, 9 aa, BK virus
AWWKYLGSF

SEQ ID NO: 1896 - protein, 9 aa, BK virus
WWKYLGSFV

SEQ ID NO: 1897 - protein, 9 aa, BK virus
FSSCPFYIF

SEQ ID NO: 1898 - protein, 9 aa, BK virus
SSCPFYIFK

SEQ ID NO: 1899 - protein, 9 aa, BK virus
SCPFYIFKN

SEQ ID NO: 1900 - protein, 9 aa, BK virus
CPFYIFKNN

SEQ ID NO: 1901 - protein, 9 aa, BK virus
PFYIFKNNH

SEQ ID NO: 1902 - protein, 9 aa, BK virus
FYIFKNNHV

SEQ ID NO: 1903 - protein, 9 aa, BK virus
YIFKNNHVL

SEQ ID NO: 1904 - protein, 9 aa, BK virus
IFKNNHVLI

SEQ ID NO: 1905 - protein, 9 aa, BK virus
FKNNHVLIY

SEQ ID NO: 1906 - protein, 9 aa, BK virus
KNNHVLIYS

SEQ ID NO: 1907 - protein, 9 aa, BK virus
NNHVLIYSY

SEQ ID NO: 1908 - protein, 9 aa, BK virus
NHVLIYSYT

SEQ ID NO: 1909 - protein, 9 aa, BK virus
CCFSTINGT

SEQ ID NO: 1910 - protein, 9 aa, BK virus
CFSTINGTF

SEQ ID NO: 1911 - protein, 9 aa, BK virus
FSTINGTFK

SEQ ID NO: 1912 - protein, 9 aa, BK virus
PVSSFRYIE

SEQ ID NO: 1913 - protein, 9 aa, BK virus
VSSFRYIEN

SEQ ID NO: 1914 - protein, 9 aa, BK virus
SSFRYIENN

SEQ ID NO: 1915 - protein, 9 aa, BK virus
SFRYIENNT

SEQ ID NO: 1916 - protein, 9 aa, BK virus
FRYIENNTV

SEQ ID NO: 1917 - protein, 9 aa, BK virus
RYIENNTVQ

SEQ ID NO: 1918 - protein, 9 aa, BK virus
YIENNTVQK

SEQ ID NO: 1919 - protein, 9 aa, BK virus
IENNTVQKI

SEQ ID NO: 1920 - protein, 9 aa, BK virus
ENNTVQKIK

SEQ ID NO: 1921 - protein, 9 aa, BK virus
NNTVQKIKY

SEQ ID NO: 1922 - protein, 9 aa, BK virus
NTVQKIKYY

SEQ ID NO: 1923 - protein, 9 aa, BK virus
TVQKIKYYR

SEQ ID NO: 1924 - protein, 9 aa, BK virus
VQKIKYYRI

SEQ ID NO: 1925 - protein, 9 aa, BK virus
QKIKYYRIH

SEQ ID NO: 1926 - protein, 9 aa, BK virus
KIKYYRIHF

SEQ ID NO: 1927 - protein, 9 aa, BK virus
IKYYRIHFR

SEQ ID NO: 1928 - protein, 9 aa, BK virus
QTVQPSNTC

SEQ ID NO: 1929 - protein, 9 aa, BK virus
TVQPSNTCH

SEQ ID NO: 1930 - protein, 9 aa, BK virus
VQPSNTCHI

SEQ ID NO: 1931 - protein, 9 aa, BK virus
QPSNTCHIL

SEQ ID NO: 1932 - protein, 9 aa, BK virus
PSNTCHILF

SEQ ID NO: 1933 - protein, 9 aa, BK virus
YSISMSSKY

SEQ ID NO: 1934 - protein, 9 aa, BK virus
HFFPGHMKG

SEQ ID NO: 1935 - protein, 9 aa, BK virus
FFPGHMKGI

SEQ ID NO: 1936 - protein, 9 aa, BK virus
FPGHMKGIY

SEQ ID NO: 1937 - protein, 9 aa, BK virus
PGHMKGIYS

SEQ ID NO: 1938 - protein, 9 aa, BK virus
GHMKGIYSF

SEQ ID NO: 1939 - protein, 9 aa, BK virus
HMKGIYSFF

SEQ ID NO: 1940 - protein, 9 aa, BK virus
MKGIYSFFS

SEQ ID NO: 1941 - protein, 9 aa, BK virus
NCIYCLLTN

SEQ ID NO: 1942 - protein, 9 aa, BK virus
CIYCLLTNT

SEQ ID NO: 1943 - protein, 9 aa, BK virus
IYCLLTNTF

SEQ ID NO: 1944 - protein, 9 aa, BK virus
YCLLTNTFL

SEQ ID NO: 1945 - protein, 9 aa, BK virus
CLLTNTFLI

SEQ ID NO: 1946 - protein, 9 aa, BK virus
LLTNTFLIF

SEQ ID NO: 1947 - protein, 9 aa, BK virus
LTNTFLIFT

SEQ ID NO: 1948 - protein, 9 aa, BK virus
TNTFLIFTF

SEQ ID NO: 1949 - protein, 9 aa, BK virus
NTFLIFTFC

SEQ ID NO: 1950 - protein, 9 aa, BK virus
TFLIFTFCK

SEQ ID NO: 1951 - protein, 9 aa, BK virus
FLIFTFCKN

SEQ ID NO: 1952 - protein, 9 aa, BK virus
LIFTFCKNN

SEQ ID NO: 1953 - protein, 9 aa, BK virus
IFTFCKNNS

SEQ ID NO: 1954 - protein, 9 aa, BK virus
FTFCKNNSI

SEQ ID NO: 1955 - protein, 9 aa, BK virus
TFCKNNSIC

SEQ ID NO: 1956 - protein, 9 aa, BK virus
FCKNNSICK

SEQ ID NO: 1957 - protein, 9 aa, BK virus
CKNNSICKV

SEQ ID NO: 1958 - protein, 9 aa, BK virus
KNNSICKVL

SEQ ID NO: 1959 - protein, 9 aa, BK virus
NNSICKVLF

SEQ ID NO: 1960 - protein, 9 aa, BK virus
NSICKVLFM

SEQ ID NO: 1961 - protein, 9 aa, BK virus
SICKVLFMI

SEQ ID NO: 1962 - protein, 9 aa, BK virus
ICKVLFMIL

SEQ ID NO: 1963 - protein, 9 aa, BK virus
CKVLFMILK

SEQ ID NO: 1964 - protein, 9 aa, BK virus
KVLFMILKV

SEQ ID NO: 1965 - protein, 9 aa, BK virus
VLFMILKVI

SEQ ID NO: 1966 - protein, 9 aa, BK virus
LFMILKVIR

SEQ ID NO: 1967 - protein, 9 aa, BK virus
FMILKVIRL

SEQ ID NO: 1968 - protein, 9 aa, BK virus
MILKVIRLV

SEQ ID NO: 1969 - protein, 9 aa, BK virus
ILKVIRLVF

SEQ ID NO: 1970 - protein, 9 aa, BK virus
LKVIRLVFF

SEQ ID NO: 1971 - protein, 9 aa, BK virus
KVIRLVFFL

SEQ ID NO: 1972 - protein, 9 aa, BK virus
VIRLVFFLT

SEQ ID NO: 1973 - protein, 9 aa, BK virus
IRLVFFLTL

SEQ ID NO: 1974 - protein, 9 aa, BK virus
RLVFFLTLF

SEQ ID NO: 1975 - protein, 9 aa, BK virus
LVFFLTLFT

SEQ ID NO: 1976 - protein, 9 aa, BK virus
VFFLTLFTL

SEQ ID NO: 1977 - protein, 9 aa, BK virus
FFLTLFTLL

SEQ ID NO: 1978 - protein, 9 aa, BK virus
FLTLFTLLY

SEQ ID NO: 1979 - protein, 9 aa, BK virus
LTLFTLLYI

SEQ ID NO: 1980 - protein, 9 aa, BK virus
TLFTLLYIV

SEQ ID NO: 1981 - protein, 9 aa, BK virus
LFTLLYIVL

SEQ ID NO: 1982 - protein, 9 aa, BK virus
FTLLYIVLK

SEQ ID NO: 1983 - protein, 9 aa, BK virus
TLLYIVLKF

SEQ ID NO: 1984 - protein, 9 aa, BK virus
KHILTLCLY

SEQ ID NO: 1985 - protein, 9 aa, BK virus
HILTLCLYC

SEQ ID NO: 1986 - protein, 9 aa, BK virus
ILTLCLYCI

SEQ ID NO: 1987 - protein, 9 aa, BK virus
LTLCLYCIL

SEQ ID NO: 1988 - protein, 9 aa, BK virus
TLCLYCILS

SEQ ID NO: 1989 - protein, 9 aa, BK virus
LCLYCILSN

SEQ ID NO: 1990 - protein, 9 aa, BK virus
FPRHLLCFF

SEQ ID NO: 1991 - protein, 9 aa, BK virus
PRHLLCFFR

SEQ ID NO: 1992 - protein, 9 aa, BK virus
RHLLCFFRL

SEQ ID NO: 1993 - protein, 9 aa, BK virus
HLLCFFRLF

SEQ ID NO: 1994 - protein, 9 aa, BK virus
LLCFFRLFW

SEQ ID NO: 1995 - protein, 9 aa, BK virus
LCFFRLFWA

SEQ ID NO: 1996 - protein, 9 aa, BK virus
CFFRLFWAK

SEQ ID NO: 1997 - protein, 9 aa, BK virus
FFRLFWAKI

SEQ ID NO: 1998 - protein, 9 aa, BK virus
FRLFWAKIM

SEQ ID NO: 1999 - protein, 9 aa, BK virus
RLFWAKIML

SEQ ID NO: 2000 - protein, 9 aa, BK virus
LFWAKIMLL

SEQ ID NO: 2001 - protein, 9 aa, BK virus
APLNAFFYS

SEQ ID NO: 2002 - protein, 9 aa, BK virus
PLNAFFYSM

SEQ ID NO: 2003 - protein, 9 aa, BK virus
LNAFFYSMV

SEQ ID NO: 2004 - protein, 9 aa, BK virus
NAFFYSMVW

SEQ ID NO: 2005 - protein, 9 aa, BK virus
AFFYSMVWI

SEQ ID NO: 2006 - protein, 9 aa, BK virus
FFYSMVWIS

SEQ ID NO: 2007 - protein, 9 aa, BK virus
FYSMVWISS

SEQ ID NO: 2008 - protein, 9 aa, BK virus
VFLINTLTN

SEQ ID NO: 2009 - protein, 9 aa, BK virus
KTKGTQLLT

SEQ ID NO: 2010 - protein, 9 aa, BK virus
TKGTQLLTE

SEQ ID NO: 2011 - protein, 9 aa, BK virus
KGTQLLTEI

SEQ ID NO: 2012 - protein, 9 aa, BK virus
GTQLLTEII

SEQ ID NO: 2013 - protein, 9 aa, BK virus
TQLLTEIIN

SEQ ID NO: 2014 - protein, 9 aa, BK virus
QLLTEIINC

SEQ ID NO: 2015 - protein, 9 aa, BK virus
LLTEIINCR

SEQ ID NO: 2016 - protein, 9 aa, BK virus
LTEIINCRN

SEQ ID NO: 2017 - protein, 9 aa, BK virus
TEIINCRNS

SEQ ID NO: 2018 - protein, 9 aa, BK virus
EIINCRNSM

SEQ ID NO: 2019 - protein, 9 aa, BK virus
IINCRNSMS

SEQ ID NO: 2020 - protein, 9 aa, BK virus
INCRNSMSM

SEQ ID NO: 2021 - protein, 9 aa, BK virus
NCRNSMSMW

SEQ ID NO: 2022 - protein, 9 aa, BK virus
CRNSMSMWS

SEQ ID NO: 2023 - protein, 9 aa, BK virus
KEYNIMPST

SEQ ID NO: 2024 - protein, 9 aa, BK virus
EYNIMPSTH

SEQ ID NO: 2025 - protein, 9 aa, BK virus
YNIMPSTHV

SEQ ID NO: 2026 - protein, 9 aa, BK virus
NIMPSTHVS

SEQ ID NO: 2027 - protein, 9 aa, BK virus
IMPSTHVST

SEQ ID NO: 2028 - protein, 9 aa, BK virus
MPSTHVSTN

SEQ ID NO: 2029 - protein, 9 aa, BK virus
PSTHVSTNK

SEQ ID NO: 2030 - protein, 9 aa, BK virus
STHVSTNKS

SEQ ID NO: 2031 - protein, 9 aa, BK virus
THVSTNKSY

SEQ ID NO: 2032 - protein, 9 aa, BK virus
HVSTNKSYR

SEQ ID NO: 2033 - protein, 9 aa, BK virus
VSTNKSYRI

SEQ ID NO: 2034 - protein, 9 aa, BK virus
STNKSYRIF

SEQ ID NO: 2035 - protein, 9 aa, BK virus
TNKSYRIFF

SEQ ID NO: 2036 - protein, 9 aa, BK virus
NKSYRIFFH

SEQ ID NO: 2037 - protein, 9 aa, BK virus
KSYRIFFHK

SEQ ID NO: 2038 - protein, 9 aa, BK virus
SYRIFFHKF

SEQ ID NO: 2039 - protein, 9 aa, BK virus
YRIFFHKFF

SEQ ID NO: 2040 - protein, 9 aa, BK virus
RIFFHKFFI

SEQ ID NO: 2041 - protein, 9 aa, BK virus
IFFHKFFIQ

SEQ ID NO: 2042 - protein, 9 aa, BK virus
FFHKFFIQN

SEQ ID NO: 2043 - protein, 9 aa, BK virus
FHKFFIQNL

SEQ ID NO: 2044 - protein, 9 aa, BK virus
HKFFIQNLS

SEQ ID NO: 2045 - protein, 9 aa, BK virus
KFFIQNLSF

SEQ ID NO: 2046 - protein, 9 aa, BK virus
FFIQNLSFF

SEQ ID NO: 2047 - protein, 9 aa, BK virus
FIQNLSFFF

SEQ ID NO: 2048 - protein, 9 aa, BK virus
IQNLSFFFS

SEQ ID NO: 2049 - protein, 9 aa, BK virus
QNLSFFFSS

SEQ ID NO: 2050 - protein, 9 aa, BK virus
NLSFFFSSI

SEQ ID NO: 2051 - protein, 9 aa, BK virus
LSFFFSSIH

SEQ ID NO: 2052 - protein, 9 aa, BK virus
SFFFSSIHS

SEQ ID NO: 2053 - protein, 9 aa, BK virus
FFFSSIHSK

SEQ ID NO: 2054 - protein, 9 aa, BK virus
FFSSIHSKA

SEQ ID NO: 2055 - protein, 9 aa, BK virus
FSSIHSKAG

SEQ ID NO: 2056 - protein, 9 aa, BK virus
SSIHSKAGK

SEQ ID NO: 2057 - protein, 9 aa, BK virus
SIHSKAGKG

SEQ ID NO: 2058 - protein, 9 aa, BK virus
IHSKAGKGS

SEQ ID NO: 2059 - protein, 9 aa, BK virus
HSKAGKGSI

SEQ ID NO: 2060 - protein, 9 aa, BK virus
SKAGKGSIT

SEQ ID NO: 2061 - protein, 9 aa, BK virus
KAGKGSITK

SEQ ID NO: 2062 - protein, 9 aa, BK virus
AGKGSITKY

SEQ ID NO: 2063 - protein, 9 aa, BK virus
GKGSITKYS

SEQ ID NO: 2064 - protein, 9 aa, BK virus
KGSITKYSL

SEQ ID NO: 2065 - protein, 9 aa, BK virus
GSITKYSLT

SEQ ID NO: 2066 - protein, 9 aa, BK virus
SITKYSLTK

SEQ ID NO: 2067 - protein, 9 aa, BK virus
ITKYSLTKK

SEQ ID NO: 2068 - protein, 9 aa, BK virus
TKYSLTKKL

SEQ ID NO: 2069 - protein, 9 aa, BK virus
KYSLTKKLV

SEQ ID NO: 2070 - protein, 9 aa, BK virus
IRGKVFRVF

SEQ ID NO: 2071 - protein, 9 aa, BK virus
RGKVFRVFY

SEQ ID NO: 2072 - protein, 9 aa, BK virus
GKVFRVFYL

SEQ ID NO: 2073 - protein, 9 aa, BK virus
KVFRVFYLS

SEQ ID NO: 2074 - protein, 9 aa, BK virus
VFRVFYLSF

SEQ ID NO: 2075 - protein, 9 aa, BK virus
FRVFYLSFF

SEQ ID NO: 2076 - protein, 9 aa, BK virus
RVFYLSFFF

SEQ ID NO: 2077 - protein, 9 aa, BK virus
VFYLSFFFG

SEQ ID NO: 2078 - protein, 9 aa, BK virus
FYLSFFFGW

SEQ ID NO: 2079 - protein, 9 aa, BK virus
YLSFFFGWC

SEQ ID NO: 2080 - protein, 9 aa, BK virus
VLRICCCFF

SEQ ID NO: 2081 - protein, 9 aa, BK virus
LRICCCFFI

SEQ ID NO: 2082 - protein, 9 aa, BK virus
RICCCFFIT

SEQ ID NO: 2083 - protein, 9 aa, BK virus
ICCCFFITG

SEQ ID NO: 2084 - protein, 9 aa, BK virus
CCCFFITGK

SEQ ID NO: 2085 - protein, 9 aa, BK virus
CCFFITGKH

SEQ ID NO: 2086 - protein, 9 aa, BK virus
CFFITGKHI

SEQ ID NO: 2087 - protein, 9 aa, BK virus
FFITGKHIF

SEQ ID NO: 2088 - protein, 9 aa, BK virus
FITGKHIFM

SEQ ID NO: 2089 - protein, 9 aa, BK virus
ITGKHIFMA

SEQ ID NO: 2090 - protein, 9 aa, BK virus
TGKHIFMAK

SEQ ID NO: 2091 - protein, 9 aa, BK virus
IFIPFFIKG

SEQ ID NO: 2092 - protein, 9 aa, BK virus
FIPFFIKGT

SEQ ID NO: 2093 - protein, 9 aa, BK virus
IPFFIKGTP

SEQ ID NO: 2094 - protein, 9 aa, BK virus
PFFIKGTPP

SEQ ID NO: 2095 - protein, 9 aa, BK virus
FFIKGTPPG

SEQ ID NO: 2096 - protein, 9 aa, BK virus
FIKGTPPGL

SEQ ID NO: 2097 - protein, 9 aa, BK virus
IKGTPPGLP

SEQ ID NO: 2098 - protein, 9 aa, BK virus
KGTPPGLPL

SEQ ID NO: 2099 - protein, 9 aa, BK virus
GTPPGLPLF

SEQ ID NO: 2100 - protein, 9 aa, BK virus
TPPGLPLFC

SEQ ID NO: 2101 - protein, 9 aa, BK virus
PPGLPLFCS

SEQ ID NO: 2102 - protein, 9 aa, BK virus
PGLPLFCSI

SEQ ID NO: 2103 - protein, 9 aa, BK virus
GLPLFCSIG

SEQ ID NO: 2104 - protein, 9 aa, BK virus
LPLFCSIGW

SEQ ID NO: 2105 - protein, 9 aa, BK virus
PLFCSIGWH

SEQ ID NO: 2106 - protein, 9 aa, BK virus
LFCSIGWHL

SEQ ID NO: 2107 - protein, 9 aa, BK virus
YFIIYLNIS

SEQ ID NO: 2108 - protein, 9 aa, BK virus
SFRSLKGVS

SEQ ID NO: 2109 - protein, 9 aa, BK virus
FRSLKGVSP

SEQ ID NO: 2110 - protein, 9 aa, BK virus
RSLKGVSPI

SEQ ID NO: 2111 - protein, 9 aa, BK virus
SLKGVSPII

SEQ ID NO: 2112 - protein, 9 aa, BK virus
LKGVSPIIW

SEQ ID NO: 2113 - protein, 9 aa, BK virus
KGVSPIIWT

SEQ ID NO: 2114 - protein, 9 aa, BK virus
GVSPIIWTH

SEQ ID NO: 2115 - protein, 9 aa, BK virus
VSPIIWTHH

SEQ ID NO: 2116 - protein, 9 aa, BK virus
SPIIWTHHC

SEQ ID NO: 2117 - protein, 9 aa, BK virus
PIIWTHHCR

SEQ ID NO: 2118 - protein, 9 aa, BK virus
IIWTHHCRV

SEQ ID NO: 2119 - protein, 9 aa, BK virus
IWTHHCRVS

SEQ ID NO: 2120 - protein, 9 aa, BK virus
WTHHCRVSS

SEQ ID NO: 2121 - protein, 9 aa, BK virus
THHCRVSSV

SEQ ID NO: 2122 - protein, 9 aa, BK virus
HHCRVSSVR

SEQ ID NO: 2123 - protein, 9 aa, BK virus
HCRVSSVRS

SEQ ID NO: 2124 - protein, 9 aa, BK virus
CRVSSVRSK

SEQ ID NO: 2125 - protein, 9 aa, BK virus
RVSSVRSKP

SEQ ID NO: 2126 - protein, 9 aa, BK virus
VSSVRSKPN

SEQ ID NO: 2127 - protein, 9 aa, BK virus
SSVRSKPNH

SEQ ID NO: 2128 - protein, 9 aa, BK virus
SVRSKPNHC

SEQ ID NO: 2129 - protein, 9 aa, BK virus
VRSKPNHCV

SEQ ID NO: 2130 - protein, 9 aa, BK virus
RSKPNHCVK

SEQ ID NO: 2131 - protein, 9 aa, BK virus
SKPNHCVKQ

SEQ ID NO: 2132 - protein, 9 aa, BK virus
KPNHCVKQS

SEQ ID NO: 2133 - protein, 9 aa, BK virus
PNHCVKQSM

SEQ ID NO: 2134 - protein, 9 aa, BK virus
NHCVKQSMQ

SEQ ID NO: 2135 - protein, 9 aa, BK virus
QSIQTKGSF

SEQ ID NO: 2136 - protein, 9 aa, BK virus
SIQTKGSFL

SEQ ID NO: 2137 - protein, 9 aa, BK virus
IQTKGSFLK

SEQ ID NO: 2138 - protein, 9 aa, BK virus
QTKGSFLKN

SEQ ID NO: 2139 - protein, 9 aa, BK virus
TKGSFLKNF

SEQ ID NO: 2140 - protein, 9 aa, BK virus
KGSFLKNFL

SEQ ID NO: 2141 - protein, 9 aa, BK virus
GSFLKNFLF

SEQ ID NO: 2142 - protein, 9 aa, BK virus
SFLKNFLFK

SEQ ID NO: 2143 - protein, 9 aa, BK virus
FLKNFLFKC

SEQ ID NO: 2144 - protein, 9 aa, BK virus
LKNFLFKCL

SEQ ID NO: 2145 - protein, 9 aa, BK virus
KNFLFKCLN

SEQ ID NO: 2146 - protein, 9 aa, BK virus
NFLFKCLNL

SEQ ID NO: 2147 - protein, 9 aa, BK virus
FLFKCLNLS

SEQ ID NO: 2148 - protein, 9 aa, BK virus
HSMQGQCTE

SEQ ID NO: 2149 - protein, 9 aa, BK virus
SMQGQCTEG

SEQ ID NO: 2150 - protein, 9 aa, BK virus
MQGQCTEGF

SEQ ID NO: 2151 - protein, 9 aa, BK virus
QGQCTEGFL

SEQ ID NO: 2152 - protein, 9 aa, BK virus
GQCTEGFLE

SEQ ID NO: 2153 - protein, 9 aa, BK virus
QCTEGFLEQ

SEQ ID NO: 2154 - protein, 9 aa, BK virus
CTEGFLEQI

SEQ ID NO: 2155 - protein, 9 aa, BK virus
TEGFLEQIG

SEQ ID NO: 2156 - protein, 9 aa, BK virus
EGFLEQIGH

SEQ ID NO: 2157 - protein, 9 aa, BK virus
GFLEQIGHS

SEQ ID NO: 2158 - protein, 9 aa, BK virus
FLEQIGHSL

SEQ ID NO: 2159 - protein, 9 aa, BK virus
LEQIGHSLQ

SEQ ID NO: 2160 - protein, 9 aa, BK virus
EQIGHSLQY

SEQ ID NO: 2161 - protein, 9 aa, BK virus
QIGHSLQYR

SEQ ID NO: 2162 - protein, 9 aa, BK virus
IGHSLQYRV

SEQ ID NO: 2163 - protein, 9 aa, BK virus
GHSLQYRVS

SEQ ID NO: 2164 - protein, 9 aa, BK virus
HSLQYRVSG

SEQ ID NO: 2165 - protein, 9 aa, BK virus
SLQYRVSGQ

SEQ ID NO: 2166 - protein, 9 aa, BK virus
LQYRVSGQR

SEQ ID NO: 2167 - protein, 9 aa, BK virus
QYRVSGQRG

SEQ ID NO: 2168 - protein, 9 aa, BK virus
YRVSGQRGK

SEQ ID NO: 2169 - protein, 9 aa, BK virus
RVSGQRGKS

SEQ ID NO: 2170 - protein, 9 aa, BK virus
VSGQRGKSA

SEQ ID NO: 2171 - protein, 9 aa, BK virus
SGQRGKSAQ

SEQ ID NO: 2172 - protein, 9 aa, BK virus
GQRGKSAQT

SEQ ID NO: 2173 - protein, 9 aa, BK virus
QRGKSAQTS

SEQ ID NO: 2174 - protein, 9 aa, BK virus
RGKSAQTSE

SEQ ID NO: 2175 - protein, 9 aa, BK virus
GKSAQTSEL

SEQ ID NO: 2176 - protein, 9 aa, BK virus
KSAQTSELL

SEQ ID NO: 2177 - protein, 9 aa, BK virus
SAQTSELLQ

SEQ ID NO: 2178 - protein, 9 aa, BK virus
AQTSELLQV

SEQ ID NO: 2179 - protein, 9 aa, BK virus
QTSELLQVP

SEQ ID NO: 2180 - protein, 9 aa, BK virus
TSELLQVPK

SEQ ID NO: 2181 - protein, 9 aa, BK virus
SELLQVPKS

SEQ ID NO: 2182 - protein, 9 aa, BK virus
ELLQVPKSG

SEQ ID NO: 2183 - protein, 9 aa, BK virus
ATFTSCSIF

SEQ ID NO: 2184 - protein, 9 aa, BK virus
TFTSCSIFL

SEQ ID NO: 2185 - protein, 9 aa, BK virus
FTSCSIFLY

SEQ ID NO: 2186 - protein, 9 aa, BK virus
TSCSIFLYK

SEQ ID NO: 2187 - protein, 9 aa, BK virus
SCSIFLYKV

SEQ ID NO: 2188 - protein, 9 aa, BK virus
CSIFLYKVF

SEQ ID NO: 2189 - protein, 9 aa, BK virus
SIFLYKVFI

SEQ ID NO: 2190 - protein, 9 aa, BK virus
IFLYKVFIL

SEQ ID NO: 2191 - protein, 9 aa, BK virus
FLYKVFILF

SEQ ID NO: 2192 - protein, 9 aa, BK virus
LYKVFILFI

SEQ ID NO: 2193 - protein, 9 aa, BK virus
YKVFILFIL

SEQ ID NO: 2194 - protein, 9 aa, BK virus
KVFILFILS

SEQ ID NO: 2195 - protein, 9 aa, BK virus
VFILFILSS

SEQ ID NO: 2196 - protein, 9 aa, BK virus
FILFILSSS

SEQ ID NO: 2197 - protein, 9 aa, BK virus
ILFILSSSP

SEQ ID NO: 2198 - protein, 9 aa, BK virus
LFILSSSPP

SEQ ID NO: 2199 - protein, 9 aa, BK virus
FILSSSPPL

SEQ ID NO: 2200 - protein, 9 aa, BK virus
ILSSSPPLS

SEQ ID NO: 2201 - protein, 9 aa, BK virus
LSSSPPLSG

SEQ ID NO: 2202 - protein, 9 aa, BK virus
AFLIKGRFP

SEQ ID NO: 2203 - protein, 9 aa, BK virus
FLIKGRFPQ

SEQ ID NO: 2204 - protein, 9 aa, BK virus
LIKGRFPQA

SEQ ID NO: 2205 - protein, 9 aa, BK virus
IKGRFPQAA

SEQ ID NO: 2206 - protein, 9 aa, BK virus
KGRFPQAAL

SEQ ID NO: 2207 - protein, 9 aa, BK virus
GRFPQAALS

SEQ ID NO: 2208 - protein, 9 aa, BK virus
RFPQAALSR

SEQ ID NO: 2209 - protein, 9 aa, BK virus
FPQAALSRP

SEQ ID NO: 2210 - protein, 9 aa, BK virus
PQAALSRPK

SEQ ID NO: 2211 - protein, 9 aa, BK virus
QAALSRPKR

SEQ ID NO: 2212 - protein, 9 aa, BK virus
AALSRPKRS

SEQ ID NO: 2213 - protein, 9 aa, BK virus
ALSRPKRSM

SEQ ID NO: 2214 - protein, 9 aa, BK virus
LSRPKRSMS

SEQ ID NO: 2215 - protein, 9 aa, BK virus
SRPKRSMSS

SEQ ID NO: 2216 - protein, 9 aa, BK virus
RPKRSMSSM

SEQ ID NO: 2217 - protein, 9 aa, BK virus
PKRSMSSMD

SEQ ID NO: 2218 - protein, 9 aa, BK virus
KRSMSSMDS

SEQ ID NO: 2219 - protein, 9 aa, BK virus
RSMSSMDSS

SEQ ID NO: 2220 - protein, 9 aa, BK virus
SMSSMDSSL

SEQ ID NO: 2221 - protein, 9 aa, BK virus
MSSMDSSLL

SEQ ID NO: 2222 - protein, 9 aa, BK virus
SSMDSSLLR

SEQ ID NO: 2223 - protein, 9 aa, BK virus
SMDSSLLRT

SEQ ID NO: 2224 - protein, 9 aa, BK virus
MDSSLLRTL

SEQ ID NO: 2225 - protein, 9 aa, BK virus
DSSLLRTLS

SEQ ID NO: 2226 - protein, 10 aa, BK virus
FCKNCKRIGI

SEQ ID NO: 2227 - protein, 10 aa, BK virus
CKNCKRIGIS

SEQ ID NO: 2228 - protein, 10 aa, BK virus
KNCKRIGISP

SEQ ID NO: 2229 - protein, 10 aa, BK virus
NCKRIGISPN

SEQ ID NO: 2230 - protein, 10 aa, BK virus
CKRIGISPNS

SEQ ID NO: 2231 - protein, 10 aa, BK virus
KRIGISPNSF

SEQ ID NO: 2232 - protein, 10 aa, BK virus
RIGISPNSFA

SEQ ID NO: 2233 - protein, 10 aa, BK virus
IGISPNSFAR

SEQ ID NO: 2234 - protein, 10 aa, BK virus
GISPNSFARP

SEQ ID NO: 2235 - protein, 10 aa, BK virus
ISPNSFARPQ

SEQ ID NO: 2236 - protein, 10 aa, BK virus
SPNSFARPQK

SEQ ID NO: 2237 - protein, 10 aa, BK virus
PNSFARPQKK

SEQ ID NO: 2238 - protein, 10 aa, BK virus
NSFARPQKKP

SEQ ID NO: 2239 - protein, 10 aa, BK virus
SFARPQKKPP

SEQ ID NO: 2240 - protein, 10 aa, BK virus
FARPQKKPPH

SEQ ID NO: 2241 - protein, 10 aa, BK virus
ARPQKKPPHP

SEQ ID NO: 2242 - protein, 10 aa, BK virus
RPQKKPPHPY

SEQ ID NO: 2243 - protein, 10 aa, BK virus
PQKKPPHPYY

SEQ ID NO: 2244 - protein, 10 aa, BK virus
QKKPPHPYYL

SEQ ID NO: 2245 - protein, 10 aa, BK virus
KKPPHPYYLR

SEQ ID NO: 2246 - protein, 10 aa, BK virus
KPPHPYYLRE

SEQ ID NO: 2247 - protein, 10 aa, BK virus
PPHPYYLRER

SEQ ID NO: 2248 - protein, 10 aa, BK virus
PHPYYLRERV

SEQ ID NO: 2249 - protein, 10 aa, BK virus
HPYYLRERVE

SEQ ID NO: 2250 - protein, 10 aa, BK virus
PYYLRERVEA

SEQ ID NO: 2251 - protein, 10 aa, BK virus
YYLRERVEAE

SEQ ID NO: 2252 - protein, 10 aa, BK virus
YLRERVEAEA

SEQ ID NO: 2253 - protein, 10 aa, BK virus
LRERVEAEAA

SEQ ID NO: 2254 - protein, 10 aa, BK virus
RERVEAEAAS

SEQ ID NO: 2255 - protein, 10 aa, BK virus
ERVEAEAASA

SEQ ID NO: 2256 - protein, 10 aa, BK virus
RVEAEAASAS

SEQ ID NO: 2257 - protein, 10 aa, BK virus
VEAEAASASY

SEQ ID NO: 2258 - protein, 10 aa, BK virus
EAEAASASYI

SEQ ID NO: 2259 - protein, 10 aa, BK virus
AEAASASYIL

SEQ ID NO: 2260 - protein, 10 aa, BK virus
KKRPQGGAAY

SEQ ID NO: 2261 - protein, 10 aa, BK virus
KRPQGGAAYP

SEQ ID NO: 2262 - protein, 10 aa, BK virus
RPQGGAAYPW

SEQ ID NO: 2263 - protein, 10 aa, BK virus
PQGGAAYPWN

SEQ ID NO: 2264 - protein, 10 aa, BK virus
QGGAAYPWNA

SEQ ID NO: 2265 - protein, 10 aa, BK virus
GGAAYPWNAA

SEQ ID NO: 2266 - protein, 10 aa, BK virus
GAAYPWNAAK

SEQ ID NO: 2267 - protein, 10 aa, BK virus
AAYPWNAAKP

SEQ ID NO: 2268 - protein, 10 aa, BK virus
PQEGKCMTHR

SEQ ID NO: 2269 - protein, 10 aa, BK virus
QEGKCMTHRG

SEQ ID NO: 2270 - protein, 10 aa, BK virus
EGKCMTHRGM

SEQ ID NO: 2271 - protein, 10 aa, BK virus
GKCMTHRGMQ

SEQ ID NO: 2272 - protein, 10 aa, BK virus
KCMTHRGMQP

SEQ ID NO: 2273 - protein, 10 aa, BK virus
CMTHRGMQPN

SEQ ID NO: 2274 - protein, 10 aa, BK virus
MTHRGMQPNH

SEQ ID NO: 2275 - protein, 10 aa, BK virus
THRGMQPNHD

SEQ ID NO: 2276 - protein, 10 aa, BK virus
HRGMQPNHDL

SEQ ID NO: 2277 - protein, 10 aa, BK virus
RGMQPNHDLR

SEQ ID NO: 2278 - protein, 10 aa, BK virus
GMQPNHDLRK

SEQ ID NO: 2279 - protein, 10 aa, BK virus
MQPNHDLRKE

SEQ ID NO: 2280 - protein, 10 aa, BK virus
QPNHDLRKES

SEQ ID NO: 2281 - protein, 10 aa, BK virus
PNHDLRKESA

SEQ ID NO: 2282 - protein, 10 aa, BK virus
LTGRSCLPME

SEQ ID NO: 2283 - protein, 10 aa, BK virus
TGRSCLPMEC

SEQ ID NO: 2284 - protein, 10 aa, BK virus
GRSCLPMECS

SEQ ID NO: 2285 - protein, 10 aa, BK virus
RSCLPMECSQ

SEQ ID NO: 2286 - protein, 10 aa, BK virus
SCLPMECSQT

SEQ ID NO: 2287 - protein, 10 aa, BK virus
CLPMECSQTM

SEQ ID NO: 2288 - protein, 10 aa, BK virus
LPMECSQTMT

SEQ ID NO: 2289 - protein, 10 aa, BK virus
PMECSQTMTS

SEQ ID NO: 2290 - protein, 10 aa, BK virus
MECSQTMTSG

SEQ ID NO: 2291 - protein, 10 aa, BK virus
ECSQTMTSGR

SEQ ID NO: 2292 - protein, 10 aa, BK virus
CSQTMTSGRK

SEQ ID NO: 2293 - protein, 10 aa, BK virus
SQTMTSGRKV

SEQ ID NO: 2294 - protein, 10 aa, BK virus
QTMTSGRKVH

SEQ ID NO: 2295 - protein, 10 aa, BK virus
TMTSGRKVHD

SEQ ID NO: 2296 - protein, 10 aa, BK virus
MTSGRKVHDR

SEQ ID NO: 2297 - protein, 10 aa, BK virus
TSGRKVHDRH

SEQ ID NO: 2298 - protein, 10 aa, BK virus
SGRKVHDRHV

SEQ ID NO: 2299 - protein, 10 aa, BK virus
GRKVHDRHVL

SEQ ID NO: 2300 - protein, 10 aa, BK virus
RKVHDRHVLR

SEQ ID NO: 2301 - protein, 10 aa, BK virus
KVHDRHVLRA

SEQ ID NO: 2302 - protein, 10 aa, BK virus
ESWPCPQLNW

SEQ ID NO: 2303 - protein, 10 aa, BK virus
SWPCPQLNWT

SEQ ID NO: 2304 - protein, 10 aa, BK virus
WPCPQLNWTK

SEQ ID NO: 2305 - protein, 10 aa, BK virus
PCPQLNWTKA

SEQ ID NO: 2306 - protein, 10 aa, BK virus
CPQLNWTKAM

SEQ ID NO: 2307 - protein, 10 aa, BK virus
PQLNWTKAMV

SEQ ID NO: 2308 - protein, 10 aa, BK virus
QLNWTKAMVL

SEQ ID NO: 2309 - protein, 10 aa, BK virus
LNWTKAMVLR

SEQ ID NO: 2310 - protein, 10 aa, BK virus
NWTKAMVLRQ

SEQ ID NO: 2311 - protein, 10 aa, BK virus
WTKAMVLRQL

SEQ ID NO: 2312 - protein, 10 aa, BK virus
TKAMVLRQLS

SEQ ID NO: 2313 - protein, 10 aa, BK virus
KAMVLRQLSR

SEQ ID NO: 2314 - protein, 10 aa, BK virus
AMVLRQLSRQ

SEQ ID NO: 2315 - protein, 10 aa, BK virus
MVLRQLSRQA

SEQ ID NO: 2316 - protein, 10 aa, BK virus
VLRQLSRQAS

SEQ ID NO: 2317 - protein, 10 aa, BK virus
LRQLSRQASV

SEQ ID NO: 2318 - protein, 10 aa, BK virus
RQLSRQASVK

SEQ ID NO: 2319 - protein, 10 aa, BK virus
QLSRQASVKV

SEQ ID NO: 2320 - protein, 10 aa, BK virus
LSRQASVKVG

SEQ ID NO: 2321 - protein, 10 aa, BK virus
SRQASVKVGK

SEQ ID NO: 2322 - protein, 10 aa, BK virus
RQASVKVGKT

SEQ ID NO: 2323 - protein, 10 aa, BK virus
QASVKVGKTW

SEQ ID NO: 2324 - protein, 10 aa, BK virus
ASVKVGKTWT

SEQ ID NO: 2325 - protein, 10 aa, BK virus
SVKVGKTWTG

SEQ ID NO: 2326 - protein, 10 aa, BK virus
VKVGKTWTGT

SEQ ID NO: 2327 - protein, 10 aa, BK virus
KVGKTWTGTK

SEQ ID NO: 2328 - protein, 10 aa, BK virus
VGKTWTGTKK

SEQ ID NO: 2329 - protein, 10 aa, BK virus
GKTWTGTKKR

SEQ ID NO: 2330 - protein, 10 aa, BK virus
KTWTGTKKRA

SEQ ID NO: 2331 - protein, 10 aa, BK virus
TWTGTKKRAQ

SEQ ID NO: 2332 - protein, 10 aa, BK virus
WTGTKKRAQR

SEQ ID NO: 2333 - protein, 10 aa, BK virus
TGTKKRAQRI

SEQ ID NO: 2334 - protein, 10 aa, BK virus
GTKKRAQRIF

SEQ ID NO: 2335 - protein, 10 aa, BK virus
TKKRAQRIFI

SEQ ID NO: 2336 - protein, 10 aa, BK virus
KKRAQRIFIF

SEQ ID NO: 2337 - protein, 10 aa, BK virus
KRAQRIFIFI

SEQ ID NO: 2338 - protein, 10 aa, BK virus
RAQRIFIFIL

SEQ ID NO: 2339 - protein, 10 aa, BK virus
AQRIFIFILE

SEQ ID NO: 2340 - protein, 10 aa, BK virus
QRIFIFILEL

SEQ ID NO: 2341 - protein, 10 aa, BK virus
RIFIFILELL

SEQ ID NO: 2342 - protein, 10 aa, BK virus
IFIFILELLL

SEQ ID NO: 2343 - protein, 10 aa, BK virus
FIFILELLLE

SEQ ID NO: 2344 - protein, 10 aa, BK virus
IFILELLLEF

SEQ ID NO: 2345 - protein, 10 aa, BK virus
FILELLLEFC

SEQ ID NO: 2346 - protein, 10 aa, BK virus
ILELLLEFCR

SEQ ID NO: 2347 - protein, 10 aa, BK virus
LELLLEFCRG

SEQ ID NO: 2348 - protein, 10 aa, BK virus
ELLLEFCRGE

SEQ ID NO: 2349 - protein, 10 aa, BK virus
LLLEFCRGED

SEQ ID NO: 2350 - protein, 10 aa, BK virus
LLEFCRGEDS

SEQ ID NO: 2351 - protein, 10 aa, BK virus
LEFCRGEDSV

SEQ ID NO: 2352 - protein, 10 aa, BK virus
EFCRGEDSVD

SEQ ID NO: 2353 - protein, 10 aa, BK virus
FCRGEDSVDG

SEQ ID NO: 2354 - protein, 10 aa, BK virus
CRGEDSVDGK

SEQ ID NO: 2355 - protein, 10 aa, BK virus
RGEDSVDGKN

SEQ ID NO: 2356 - protein, 10 aa, BK virus
GEDSVDGKNK

SEQ ID NO: 2357 - protein, 10 aa, BK virus
EDSVDGKNKS

SEQ ID NO: 2358 - protein, 10 aa, BK virus
DSVDGKNKST

SEQ ID NO: 2359 - protein, 10 aa, BK virus
SVDGKNKSTT

SEQ ID NO: 2360 - protein, 10 aa, BK virus
VDGKNKSTTA

SEQ ID NO: 2361 - protein, 10 aa, BK virus
DGKNKSTTAL

SEQ ID NO: 2362 - protein, 10 aa, BK virus
GKNKSTTALP

SEQ ID NO: 2363 - protein, 10 aa, BK virus
KNKSTTALPA

SEQ ID NO: 2364 - protein, 10 aa, BK virus
NKSTTALPAV

SEQ ID NO: 2365 - protein, 10 aa, BK virus
KSTTALPAVK

SEQ ID NO: 2366 - protein, 10 aa, BK virus
STTALPAVKD

SEQ ID NO: 2367 - protein, 10 aa, BK virus
TTALPAVKDS

SEQ ID NO: 2368 - protein, 10 aa, BK virus
TALPAVKDSV

SEQ ID NO: 2369 - protein, 10 aa, BK virus
ALPAVKDSVK

SEQ ID NO: 2370 - protein, 10 aa, BK virus
LPAVKDSVKD

SEQ ID NO: 2371 - protein, 10 aa, BK virus
PAVKDSVKDS

SEQ ID NO: 2372 - protein, 10 aa, BK virus
VSNPFFFVFP

SEQ ID NO: 2373 - protein, 10 aa, BK virus
SNPFFFVFPG

SEQ ID NO: 2374 - protein, 10 aa, BK virus
NPFFFVFPGS

SEQ ID NO: 2375 - protein, 10 aa, BK virus
PFFFVFPGSW

SEQ ID NO: 2376 - protein, 10 aa, BK virus
FFFVFPGSWV

SEQ ID NO: 2377 - protein, 10 aa, BK virus
FFVFPGSWVL

SEQ ID NO: 2378 - protein, 10 aa, BK virus
FVFPGSWVLL

SEQ ID NO: 2379 - protein, 10 aa, BK virus
LPVYLRLLLP

SEQ ID NO: 2380 - protein, 10 aa, BK virus
PVYLRLLLPQ

SEQ ID NO: 2381 - protein, 10 aa, BK virus
VYLRLLLPQD

SEQ ID NO: 2382 - protein, 10 aa, BK virus
YLRLLLPQDF

SEQ ID NO: 2383 - protein, 10 aa, BK virus
LRLLLPQDFQ

SEQ ID NO: 2384 - protein, 10 aa, BK virus
RLLLPQDFQW

SEQ ID NO: 2385 - protein, 10 aa, BK virus
LLLPQDFQWL

SEQ ID NO: 2386 - protein, 10 aa, BK virus
LLPQDFQWLK

SEQ ID NO: 2387 - protein, 10 aa, BK virus
LPQDFQWLKL

SEQ ID NO: 2388 - protein, 10 aa, BK virus
PQDFQWLKLL

SEQ ID NO: 2389 - protein, 10 aa, BK virus
QDFQWLKLLL

SEQ ID NO: 2390 - protein, 10 aa, BK virus
DFQWLKLLLG

SEQ ID NO: 2391 - protein, 10 aa, BK virus
FQWLKLLLGR

SEQ ID NO: 2392 - protein, 10 aa, BK virus
QWLKLLLGRL

SEQ ID NO: 2393 - protein, 10 aa, BK virus
WLKLLLGRLL

SEQ ID NO: 2394 - protein, 10 aa, BK virus
LKLLLGRLLL

SEQ ID NO: 2395 - protein, 10 aa, BK virus
KLLLGRLLLL

SEQ ID NO: 2396 - protein, 10 aa, BK virus
LLVLLGLLLG

SEQ ID NO: 2397 - protein, 10 aa, BK virus
LVLLGLLLGL

SEQ ID NO: 2398 - protein, 10 aa, BK virus
VLLGLLLGLL

SEQ ID NO: 2399 - protein, 10 aa, BK virus
LLGLLLGLLL

SEQ ID NO: 2400 - protein, 10 aa, BK virus
GISSLMIGIT

SEQ ID NO: 2401 - protein, 10 aa, BK virus
ISSLMIGITK

SEQ ID NO: 2402 - protein, 10 aa, BK virus
SSLMIGITKF

SEQ ID NO: 2403 - protein, 10 aa, BK virus
SLMIGITKFP

SEQ ID NO: 2404 - protein, 10 aa, BK virus
LMIGITKFPL

SEQ ID NO: 2405 - protein, 10 aa, BK virus
ASISNQAWLW

SEQ ID NO: 2406 - protein, 10 aa, BK virus
SISNQAWLWN

SEQ ID NO: 2407 - protein, 10 aa, BK virus
ISNQAWLWNC

SEQ ID NO: 2408 - protein, 10 aa, BK virus
SNQAWLWNCL

SEQ ID NO: 2409 - protein, 10 aa, BK virus
NQAWLWNCLT

SEQ ID NO: 2410 - protein, 10 aa, BK virus
QAWLWNCLTQ

SEQ ID NO: 2411 - protein, 10 aa, BK virus
AWLWNCLTQM

SEQ ID NO: 2412 - protein, 10 aa, BK virus
WLWNCLTQMS

SEQ ID NO: 2413 - protein, 10 aa, BK virus
LWNCLTQMST

SEQ ID NO: 2414 - protein, 10 aa, BK virus
WNCLTQMSTM

SEQ ID NO: 2415 - protein, 10 aa, BK virus
NCLTQMSTMI

SEQ ID NO: 2416 - protein, 10 aa, BK virus
CLTQMSTMIF

SEQ ID NO: 2417 - protein, 10 aa, BK virus
LTQMSTMIFC

SEQ ID NO: 2418 - protein, 10 aa, BK virus
TQMSTMIFCF

SEQ ID NO: 2419 - protein, 10 aa, BK virus
QMSTMIFCFL

SEQ ID NO: 2420 - protein, 10 aa, BK virus
MSTMIFCFLV

SEQ ID NO: 2421 - protein, 10 aa, BK virus
ILLLIIFNTL

SEQ ID NO: 2422 - protein, 10 aa, BK virus
LLLIIFNTLI

SEQ ID NO: 2423 - protein, 10 aa, BK virus
LLIIFNTLIL

SEQ ID NO: 2424 - protein, 10 aa, BK virus
LIIFNTLILG

SEQ ID NO: 2425 - protein, 10 aa, BK virus
IIFNTLILGI

SEQ ID NO: 2426 - protein, 10 aa, BK virus
IFNTLILGIG

SEQ ID NO: 2427 - protein, 10 aa, BK virus
FNTLILGIGV

SEQ ID NO: 2428 - protein, 10 aa, BK virus
NTLILGIGVL

SEQ ID NO: 2429 - protein, 10 aa, BK virus
TLILGIGVLL

SEQ ID NO: 2430 - protein, 10 aa, BK virus
LILGIGVLLC

SEQ ID NO: 2431 - protein, 10 aa, BK virus
ILGIGVLLCL

SEQ ID NO: 2432 - protein, 10 aa, BK virus
LGIGVLLCLL

SEQ ID NO: 2433 - protein, 10 aa, BK virus
GIGVLLCLLL

SEQ ID NO: 2434 - protein, 10 aa, BK virus
IGVLLCLLLF

SEQ ID NO: 2435 - protein, 10 aa, BK virus
GVLLCLLLFP

SEQ ID NO: 2436 - protein, 10 aa, BK virus
VLLCLLLFPR

SEQ ID NO: 2437 - protein, 10 aa, BK virus
LLCLLLFPRL

SEQ ID NO: 2438 - protein, 10 aa, BK virus
LCLLLFPRLC

SEQ ID NO: 2439 - protein, 10 aa, BK virus
CLLLFPRLCG

SEQ ID NO: 2440 - protein, 10 aa, BK virus
LLLFPRLCGM

SEQ ID NO: 2441 - protein, 10 aa, BK virus
LLFPRLCGML

SEQ ID NO: 2442 - protein, 10 aa, BK virus
LFPRLCGMLL

SEQ ID NO: 2443 - protein, 10 aa, BK virus
FPRLCGMLLG

SEQ ID NO: 2444 - protein, 10 aa, BK virus
PRLCGMLLGM

SEQ ID NO: 2445 - protein, 10 aa, BK virus
RLCGMLLGMI

SEQ ID NO: 2446 - protein, 10 aa, BK virus
LCGMLLGMIY

SEQ ID NO: 2447 - protein, 10 aa, BK virus
CGMLLGMIYL

SEQ ID NO: 2448 - protein, 10 aa, BK virus
GMLLGMIYLL

SEQ ID NO: 2449 - protein, 10 aa, BK virus
PHRNCREEQK

SEQ ID NO: 2450 - protein, 10 aa, BK virus
HRNCREEQKD

SEQ ID NO: 2451 - protein, 10 aa, BK virus
RNCREEQKDF

SEQ ID NO: 2452 - protein, 10 aa, BK virus
NCREEQKDFL

SEQ ID NO: 2453 - protein, 10 aa, BK virus
CREEQKDFLE

SEQ ID NO: 2454 - protein, 10 aa, BK virus
REEQKDFLET

SEQ ID NO: 2455 - protein, 10 aa, BK virus
EEQKDFLETP

SEQ ID NO: 2456 - protein, 10 aa, BK virus
EQKDFLETPW

SEQ ID NO: 2457 - protein, 10 aa, BK virus
QKDFLETPWL

SEQ ID NO: 2458 - protein, 10 aa, BK virus
KDFLETPWLD

SEQ ID NO: 2459 - protein, 10 aa, BK virus
DFLETPWLDF

SEQ ID NO: 2460 - protein, 10 aa, BK virus
FLETPWLDFW

SEQ ID NO: 2461 - protein, 10 aa, BK virus
LETPWLDFWR

SEQ ID NO: 2462 - protein, 10 aa, BK virus
ETPWLDFWRK

SEQ ID NO: 2463 - protein, 10 aa, BK virus
TPWLDFWRKL

SEQ ID NO: 2464 - protein, 10 aa, BK virus
PWLDFWRKLP

SEQ ID NO: 2465 - protein, 10 aa, BK virus
WLDFWRKLPG

SEQ ID NO: 2466 - protein, 10 aa, BK virus
LDFWRKLPGQ

SEQ ID NO: 2467 - protein, 10 aa, BK virus
DFWRKLPGQL

SEQ ID NO: 2468 - protein, 10 aa, BK virus
TFIIIFNNII

SEQ ID NO: 2469 - protein, 10 aa, BK virus
FIIIFNNIIL

SEQ ID NO: 2470 - protein, 10 aa, BK virus
IIIFNNIILI

SEQ ID NO: 2471 - protein, 10 aa, BK virus
IIFNNIILIF

SEQ ID NO: 2472 - protein, 10 aa, BK virus
IFNNIILIFP

SEQ ID NO: 2473 - protein, 10 aa, BK virus
FNNIILIFPL

SEQ ID NO: 2474 - protein, 10 aa, BK virus
NNIILIFPLL

SEQ ID NO: 2475 - protein, 10 aa, BK virus
NIILIFPLLG

SEQ ID NO: 2476 - protein, 10 aa, BK virus
IILIFPLLGP

SEQ ID NO: 2477 - protein, 10 aa, BK virus
ILIFPLLGPQ

SEQ ID NO: 2478 - protein, 10 aa, BK virus
LIFPLLGPQW

SEQ ID NO: 2479 - protein, 10 aa, BK virus
IFPLLGPQWL

SEQ ID NO: 2480 - protein, 10 aa, BK virus
FPLLGPQWLD

SEQ ID NO: 2481 - protein, 10 aa, BK virus
PLLGPQWLDK

SEQ ID NO: 2482 - protein, 10 aa, BK virus
LKGKVPVYIL

SEQ ID NO: 2483 - protein, 10 aa, BK virus
KGKVPVYILA

SEQ ID NO: 2484 - protein, 10 aa, BK virus
GKVPVYILAI

SEQ ID NO: 2485 - protein, 10 aa, BK virus
KVPVYILAIL

SEQ ID NO: 2486 - protein, 10 aa, BK virus
VPVYILAILI

SEQ ID NO: 2487 - protein, 10 aa, BK virus
PVYILAILIV

SEQ ID NO: 2488 - protein, 10 aa, BK virus
EINKVYIQES

SEQ ID NO: 2489 - protein, 10 aa, BK virus
INKVYIQESL

SEQ ID NO: 2490 - protein, 10 aa, BK virus
KKLLPQEVLI

SEQ ID NO: 2491 - protein, 10 aa, BK virus
KLLPQEVLIK

SEQ ID NO: 2492 - protein, 10 aa, BK virus
LLPQEVLIKE

SEQ ID NO: 2493 - protein, 10 aa, BK virus
LPQEVLIKEL

SEQ ID NO: 2494 - protein, 10 aa, BK virus
PQEVLIKELL

SEQ ID NO: 2495 - protein, 10 aa, BK virus
QEVLIKELLL

SEQ ID NO: 2496 - protein, 10 aa, BK virus
EVLIKELLLN

SEQ ID NO: 2497 - protein, 10 aa, BK virus
VLIKELLLNG

SEQ ID NO: 2498 - protein, 10 aa, BK virus
LIKELLLNGC

SEQ ID NO: 2499 - protein, 10 aa, BK virus
IKELLLNGCC

SEQ ID NO: 2500 - protein, 10 aa, BK virus
KELLLNGCCL

SEQ ID NO: 2501 - protein, 10 aa, BK virus
ELLLNGCCLY

SEQ ID NO: 2502 - protein, 10 aa, BK virus
LLLNGCCLYF

SEQ ID NO: 2503 - protein, 10 aa, BK virus
HLLLKHMKMA

SEQ ID NO: 2504 - protein, 10 aa, BK virus
LLLKHMKMAP

SEQ ID NO: 2505 - protein, 10 aa, BK virus
LLKHMKMAPT

SEQ ID NO: 2506 - protein, 10 aa, BK virus
LKHMKMAPTK

SEQ ID NO: 2507 - protein, 10 aa, BK virus
KHMKMAPTKR

SEQ ID NO: 2508 - protein, 10 aa, BK virus
HMKMAPTKRK

SEQ ID NO: 2509 - protein, 10 aa, BK virus
MKMAPTKRKG

SEQ ID NO: 2510 - protein, 10 aa, BK virus
KMAPTKRKGE

SEQ ID NO: 2511 - protein, 10 aa, BK virus
MAPTKRKGEC

SEQ ID NO: 2512 - protein, 10 aa, BK virus
APTKRKGECP

SEQ ID NO: 2513 - protein, 10 aa, BK virus
PTKRKGECPG

SEQ ID NO: 2514 - protein, 10 aa, BK virus
TKRKGECPGA

SEQ ID NO: 2515 - protein, 10 aa, BK virus
KRKGECPGAA

SEQ ID NO: 2516 - protein, 10 aa, BK virus
RKGECPGAAP

SEQ ID NO: 2517 - protein, 10 aa, BK virus
KGECPGAAPK

SEQ ID NO: 2518 - protein, 10 aa, BK virus
GECPGAAPKK

SEQ ID NO: 2519 - protein, 10 aa, BK virus
ECPGAAPKKP

SEQ ID NO: 2520 - protein, 10 aa, BK virus
CPGAAPKKPK

SEQ ID NO: 2521 - protein, 10 aa, BK virus
PGAAPKKPKE

SEQ ID NO: 2522 - protein, 10 aa, BK virus
GAAPKKPKEP

SEQ ID NO: 2523 - protein, 10 aa, BK virus
AAPKKPKEPV

SEQ ID NO: 2524 - protein, 10 aa, BK virus
APKKPKEPVQ

SEQ ID NO: 2525 - protein, 10 aa, BK virus
PKKPKEPVQV

SEQ ID NO: 2526 - protein, 10 aa, BK virus
KKPKEPVQVP

SEQ ID NO: 2527 - protein, 10 aa, BK virus
KPKEPVQVPK

SEQ ID NO: 2528 - protein, 10 aa, BK virus
PKEPVQVPKL

SEQ ID NO: 2529 - protein, 10 aa, BK virus
KEPVQVPKLL

SEQ ID NO: 2530 - protein, 10 aa, BK virus
EPVQVPKLLI

SEQ ID NO: 2531 - protein, 10 aa, BK virus
PVQVPKLLIK

SEQ ID NO: 2532 - protein, 10 aa, BK virus
VQVPKLLIKG

SEQ ID NO: 2533 - protein, 10 aa, BK virus
QVPKLLIKGG

SEQ ID NO: 2534 - protein, 10 aa, BK virus
VPKLLIKGGV

SEQ ID NO: 2535 - protein, 10 aa, BK virus
PKLLIKGGVE

SEQ ID NO: 2536 - protein, 10 aa, BK virus
KLLIKGGVEV

SEQ ID NO: 2537 - protein, 10 aa, BK virus
LLIKGGVEVL

SEQ ID NO: 2538 - protein, 10 aa, BK virus
LIKGGVEVLE

SEQ ID NO: 2539 - protein, 10 aa, BK virus
IKGGVEVLEV

SEQ ID NO: 2540 - protein, 10 aa, BK virus
KGGVEVLEVK

SEQ ID NO: 2541 - protein, 10 aa, BK virus
GGVEVLEVKT

SEQ ID NO: 2542 - protein, 10 aa, BK virus
GVEVLEVKTG

SEQ ID NO: 2543 - protein, 10 aa, BK virus
VEVLEVKTGV

SEQ ID NO: 2544 - protein, 10 aa, BK virus
EVLEVKTGVD

SEQ ID NO: 2545 - protein, 10 aa, BK virus
VLEVKTGVDA

SEQ ID NO: 2546 - protein, 10 aa, BK virus
LEVKTGVDAI

SEQ ID NO: 2547 - protein, 10 aa, BK virus
EVKTGVDAIT

SEQ ID NO: 2548 - protein, 10 aa, BK virus
VKTGVDAITE

SEQ ID NO: 2549 - protein, 10 aa, BK virus
KTGVDAITEV

SEQ ID NO: 2550 - protein, 10 aa, BK virus
TGVDAITEVE

SEQ ID NO: 2551 - protein, 10 aa, BK virus
GVDAITEVEC

SEQ ID NO: 2552 - protein, 10 aa, BK virus
VDAITEVECF

SEQ ID NO: 2553 - protein, 10 aa, BK virus
DAITEVECFL

SEQ ID NO: 2554 - protein, 10 aa, BK virus
AITEVECFLN

SEQ ID NO: 2555 - protein, 10 aa, BK virus
ITEVECFLNP

SEQ ID NO: 2556 - protein, 10 aa, BK virus
TEVECFLNPE

SEQ ID NO: 2557 - protein, 10 aa, BK virus
EVECFLNPEM

SEQ ID NO: 2558 - protein, 10 aa, BK virus
VECFLNPEMG

SEQ ID NO: 2559 - protein, 10 aa, BK virus
ECFLNPEMGD

SEQ ID NO: 2560 - protein, 10 aa, BK virus
CFLNPEMGDP

SEQ ID NO: 2561 - protein, 10 aa, BK virus
FLNPEMGDPD

SEQ ID NO: 2562 - protein, 10 aa, BK virus
LNPEMGDPDE

SEQ ID NO: 2563 - protein, 10 aa, BK virus
NPEMGDPDEN

SEQ ID NO: 2564 - protein, 10 aa, BK virus
PEMGDPDENL

SEQ ID NO: 2565 - protein, 10 aa, BK virus
EMGDPDENLR

SEQ ID NO: 2566 - protein, 10 aa, BK virus
MGDPDENLRG

SEQ ID NO: 2567 - protein, 10 aa, BK virus
GDPDENLRGF

SEQ ID NO: 2568 - protein, 10 aa, BK virus
DPDENLRGFS

SEQ ID NO: 2569 - protein, 10 aa, BK virus
PDENLRGFSL

SEQ ID NO: 2570 - protein, 10 aa, BK virus
DENLRGFSLK

SEQ ID NO: 2571 - protein, 10 aa, BK virus
ENLRGFSLKL

SEQ ID NO: 2572 - protein, 10 aa, BK virus
NLRGFSLKLS

SEQ ID NO: 2573 - protein, 10 aa, BK virus
LRGFSLKLSA

SEQ ID NO: 2574 - protein, 10 aa, BK virus
RGFSLKLSAE

SEQ ID NO: 2575 - protein, 10 aa, BK virus
GFSLKLSAEN

SEQ ID NO: 2576 - protein, 10 aa, BK virus
FSLKLSAEND

SEQ ID NO: 2577 - protein, 10 aa, BK virus
SLKLSAENDF

SEQ ID NO: 2578 - protein, 10 aa, BK virus
LKLSAENDFS

SEQ ID NO: 2579 - protein, 10 aa, BK virus
KLSAENDFSS

SEQ ID NO: 2580 - protein, 10 aa, BK virus
LSAENDFSSD

SEQ ID NO: 2581 - protein, 10 aa, BK virus
SAENDFSSDS

SEQ ID NO: 2582 - protein, 10 aa, BK virus
AENDFSSDSP

SEQ ID NO: 2583 - protein, 10 aa, BK virus
ENDFSSDSPE

SEQ ID NO: 2584 - protein, 10 aa, BK virus
NDFSSDSPER

SEQ ID NO: 2585 - protein, 10 aa, BK virus
DFSSDSPERK

SEQ ID NO: 2586 - protein, 10 aa, BK virus
FSSDSPERKM

SEQ ID NO: 2587 - protein, 10 aa, BK virus
SSDSPERKML

SEQ ID NO: 2588 - protein, 10 aa, BK virus
SDSPERKMLP

SEQ ID NO: 2589 - protein, 10 aa, BK virus
DSPERKMLPC

SEQ ID NO: 2590 - protein, 10 aa, BK virus
SPERKMLPCY

SEQ ID NO: 2591 - protein, 10 aa, BK virus
PERKMLPCYS

SEQ ID NO: 2592 - protein, 10 aa, BK virus
ERKMLPCYST

SEQ ID NO: 2593 - protein, 10 aa, BK virus
RKMLPCYSTA

SEQ ID NO: 2594 - protein, 10 aa, BK virus
KMLPCYSTAR

SEQ ID NO: 2595 - protein, 10 aa, BK virus
MLPCYSTARI

SEQ ID NO: 2596 - protein, 10 aa, BK virus
LPCYSTARIP

SEQ ID NO: 2597 - protein, 10 aa, BK virus
PCYSTARIPL

SEQ ID NO: 2598 - protein, 10 aa, BK virus
CYSTARIPLP

SEQ ID NO: 2599 - protein, 10 aa, BK virus
YSTARIPLPN

SEQ ID NO: 2600 - protein, 10 aa, BK virus
STARIPLPNL

SEQ ID NO: 2601 - protein, 10 aa, BK virus
TARIPLPNLN

SEQ ID NO: 2602 - protein, 10 aa, BK virus
ARIPLPNLNE

SEQ ID NO: 2603 - protein, 10 aa, BK virus
RIPLPNLNED

SEQ ID NO: 2604 - protein, 10 aa, BK virus
IPLPNLNEDL

SEQ ID NO: 2605 - protein, 10 aa, BK virus
PLPNLNEDLT

SEQ ID NO: 2606 - protein, 10 aa, BK virus
LPNLNEDLTC

SEQ ID NO: 2607 - protein, 10 aa, BK virus
PNLNEDLTCG

SEQ ID NO: 2608 - protein, 10 aa, BK virus
NLNEDLTCGN

SEQ ID NO: 2609 - protein, 10 aa, BK virus
LNEDLTCGNL

SEQ ID NO: 2610 - protein, 10 aa, BK virus
NEDLTCGNLL

SEQ ID NO: 2611 - protein, 10 aa, BK virus
EDLTCGNLLM

SEQ ID NO: 2612 - protein, 10 aa, BK virus
DLTCGNLLMW

SEQ ID NO: 2613 - protein, 10 aa, BK virus
LTCGNLLMWE

SEQ ID NO: 2614 - protein, 10 aa, BK virus
TCGNLLMWEA

SEQ ID NO: 2615 - protein, 10 aa, BK virus
CGNLLMWEAV

SEQ ID NO: 2616 - protein, 10 aa, BK virus
GNLLMWEAVT

SEQ ID NO: 2617 - protein, 10 aa, BK virus
NLLMWEAVTV

SEQ ID NO: 2618 - protein, 10 aa, BK virus
LLMWEAVTVQ

SEQ ID NO: 2619 - protein, 10 aa, BK virus
LMWEAVTVQT

SEQ ID NO: 2620 - protein, 10 aa, BK virus
MWEAVTVQTE

SEQ ID NO: 2621 - protein, 10 aa, BK virus
WEAVTVQTEV

SEQ ID NO: 2622 - protein, 10 aa, BK virus
EAVTVQTEVI

SEQ ID NO: 2623 - protein, 10 aa, BK virus
AVTVQTEVIG

SEQ ID NO: 2624 - protein, 10 aa, BK virus
VTVQTEVIGI

SEQ ID NO: 2625 - protein, 10 aa, BK virus
TVQTEVIGIT

SEQ ID NO: 2626 - protein, 10 aa, BK virus
VQTEVIGITS

SEQ ID NO: 2627 - protein, 10 aa, BK virus
QTEVIGITSM

SEQ ID NO: 2628 - protein, 10 aa, BK virus
TEVIGITSML

SEQ ID NO: 2629 - protein, 10 aa, BK virus
EVIGITSMLN

SEQ ID NO: 2630 - protein, 10 aa, BK virus
VIGITSMLNL

SEQ ID NO: 2631 - protein, 10 aa, BK virus
IGITSMLNLH

SEQ ID NO: 2632 - protein, 10 aa, BK virus
GITSMLNLHA

SEQ ID NO: 2633 - protein, 10 aa, BK virus
ITSMLNLHAG

SEQ ID NO: 2634 - protein, 10 aa, BK virus
TSMLNLHAGS

SEQ ID NO: 2635 - protein, 10 aa, BK virus
SMLNLHAGSQ

SEQ ID NO: 2636 - protein, 10 aa, BK virus
MLNLHAGSQK

SEQ ID NO: 2637 - protein, 10 aa, BK virus
LNLHAGSQKV

SEQ ID NO: 2638 - protein, 10 aa, BK virus
NLHAGSQKVH

SEQ ID NO: 2639 - protein, 10 aa, BK virus
LHAGSQKVHE

SEQ ID NO: 2640 - protein, 10 aa, BK virus
HAGSQKVHEH

SEQ ID NO: 2641 - protein, 10 aa, BK virus
AGSQKVHEHG

SEQ ID NO: 2642 - protein, 10 aa, BK virus
GSQKVHEHGG

SEQ ID NO: 2643 - protein, 10 aa, BK virus
SQKVHEHGGG

SEQ ID NO: 2644 - protein, 10 aa, BK virus
QKVHEHGGGK

SEQ ID NO: 2645 - protein, 10 aa, BK virus
KVHEHGGGKP

SEQ ID NO: 2646 - protein, 10 aa, BK virus
VHEHGGGKPI

SEQ ID NO: 2647 - protein, 10 aa, BK virus
HEHGGGKPIQ

SEQ ID NO: 2648 - protein, 10 aa, BK virus
EHGGGKPIQG

SEQ ID NO: 2649 - protein, 10 aa, BK virus
HGGGKPIQGS

SEQ ID NO: 2650 - protein, 10 aa, BK virus
GGGKPIQGSN

SEQ ID NO: 2651 - protein, 10 aa, BK virus
GGKPIQGSNF

SEQ ID NO: 2652 - protein, 10 aa, BK virus
GKPIQGSNFH

SEQ ID NO: 2653 - protein, 10 aa, BK virus
KPIQGSNFHF

SEQ ID NO: 2654 - protein, 10 aa, BK virus
PIQGSNFHFF

SEQ ID NO: 2655 - protein, 10 aa, BK virus
IQGSNFHFFA

SEQ ID NO: 2656 - protein, 10 aa, BK virus
QGSNFHFFAV

SEQ ID NO: 2657 - protein, 10 aa, BK virus
GSNFHFFAVG

SEQ ID NO: 2658 - protein, 10 aa, BK virus
SNFHFFAVGG

SEQ ID NO: 2659 - protein, 10 aa, BK virus
NFHFFAVGGE

SEQ ID NO: 2660 - protein, 10 aa, BK virus
FHFFAVGGEP

SEQ ID NO: 2661 - protein, 10 aa, BK virus
HFFAVGGEPL

SEQ ID NO: 2662 - protein, 10 aa, BK virus
FFAVGGEPLE

SEQ ID NO: 2663 - protein, 10 aa, BK virus
FAVGGEPLEM

SEQ ID NO: 2664 - protein, 10 aa, BK virus
AVGGEPLEMQ

SEQ ID NO: 2665 - protein, 10 aa, BK virus
VGGEPLEMQG

SEQ ID NO: 2666 - protein, 10 aa, BK virus
GGEPLEMQGV

SEQ ID NO: 2667 - protein, 10 aa, BK virus
GEPLEMQGVL

SEQ ID NO: 2668 - protein, 10 aa, BK virus
EPLEMQGVLM

SEQ ID NO: 2669 - protein, 10 aa, BK virus
PLEMQGVLMN

SEQ ID NO: 2670 - protein, 10 aa, BK virus
LEMQGVLMNY

SEQ ID NO: 2671 - protein, 10 aa, BK virus
EMQGVLMNYR

SEQ ID NO: 2672 - protein, 10 aa, BK virus
MQGVLMNYRS

SEQ ID NO: 2673 - protein, 10 aa, BK virus
QGVLMNYRSK

SEQ ID NO: 2674 - protein, 10 aa, BK virus
GVLMNYRSKY

SEQ ID NO: 2675 - protein, 10 aa, BK virus
VLMNYRSKYP

SEQ ID NO: 2676 - protein, 10 aa, BK virus
LMNYRSKYPD

SEQ ID NO: 2677 - protein, 10 aa, BK virus
MNYRSKYPDG

SEQ ID NO: 2678 - protein, 10 aa, BK virus
NYRSKYPDGT

SEQ ID NO: 2679 - protein, 10 aa, BK virus
YRSKYPDGTI

SEQ ID NO: 2680 - protein, 10 aa, BK virus
RSKYPDGTIT

SEQ ID NO: 2681 - protein, 10 aa, BK virus
SKYPDGTITP

SEQ ID NO: 2682 - protein, 10 aa, BK virus
KYPDGTITPK

SEQ ID NO: 2683 - protein, 10 aa, BK virus
YPDGTITPKN

SEQ ID NO: 2684 - protein, 10 aa, BK virus
PDGTITPKNP

SEQ ID NO: 2685 - protein, 10 aa, BK virus
DGTITPKNPT

SEQ ID NO: 2686 - protein, 10 aa, BK virus
GTITPKNPTA

SEQ ID NO: 2687 - protein, 10 aa, BK virus
TITPKNPTAQ

SEQ ID NO: 2688 - protein, 10 aa, BK virus
ITPKNPTAQS

SEQ ID NO: 2689 - protein, 10 aa, BK virus
TPKNPTAQSQ

SEQ ID NO: 2690 - protein, 10 aa, BK virus
PKNPTAQSQV

SEQ ID NO: 2691 - protein, 10 aa, BK virus
KNPTAQSQVM

SEQ ID NO: 2692 - protein, 10 aa, BK virus
NPTAQSQVMN

SEQ ID NO: 2693 - protein, 10 aa, BK virus
PTAQSQVMNT

SEQ ID NO: 2694 - protein, 10 aa, BK virus
TAQSQVMNTD

SEQ ID NO: 2695 - protein, 10 aa, BK virus
AQSQVMNTDH

SEQ ID NO: 2696 - protein, 10 aa, BK virus
QSQVMNTDHK

SEQ ID NO: 2697 - protein, 10 aa, BK virus
SQVMNTDHKA

SEQ ID NO: 2698 - protein, 10 aa, BK virus
QVMNTDHKAY

SEQ ID NO: 2699 - protein, 10 aa, BK virus
VMNTDHKAYL

SEQ ID NO: 2700 - protein, 10 aa, BK virus
MNTDHKAYLD

SEQ ID NO: 2701 - protein, 10 aa, BK virus
NTDHKAYLDK

SEQ ID NO: 2702 - protein, 10 aa, BK virus
TDHKAYLDKN

SEQ ID NO: 2703 - protein, 10 aa, BK virus
DHKAYLDKNN

SEQ ID NO: 2704 - protein, 10 aa, BK virus
HKAYLDKNNA

SEQ ID NO: 2705 - protein, 10 aa, BK virus
KAYLDKNNAY

SEQ ID NO: 2706 - protein, 10 aa, BK virus
AYLDKNNAYP

SEQ ID NO: 2707 - protein, 10 aa, BK virus
YLDKNNAYPV

SEQ ID NO: 2708 - protein, 10 aa, BK virus
LDKNNAYPVE

SEQ ID NO: 2709 - protein, 10 aa, BK virus
DKNNAYPVEC

SEQ ID NO: 2710 - protein, 10 aa, BK virus
KNNAYPVECW

SEQ ID NO: 2711 - protein, 10 aa, BK virus
NNAYPVECWV

SEQ ID NO: 2712 - protein, 10 aa, BK virus
NAYPVECWVP

SEQ ID NO: 2713 - protein, 10 aa, BK virus
AYPVECWVPD

SEQ ID NO: 2714 - protein, 10 aa, BK virus
YPVECWVPDP

SEQ ID NO: 2715 - protein, 10 aa, BK virus
PVECWVPDPS

SEQ ID NO: 2716 - protein, 10 aa, BK virus
VECWVPDPSR

SEQ ID NO: 2717 - protein, 10 aa, BK virus
ECWVPDPSRN

SEQ ID NO: 2718 - protein, 10 aa, BK virus
CWVPDPSRNE

SEQ ID NO: 2719 - protein, 10 aa, BK virus
WVPDPSRNEN

SEQ ID NO: 2720 - protein, 10 aa, BK virus
VPDPSRNENA

SEQ ID NO: 2721 - protein, 10 aa, BK virus
PDPSRNENAR

SEQ ID NO: 2722 - protein, 10 aa, BK virus
DPSRNENARY

SEQ ID NO: 2723 - protein, 10 aa, BK virus
PSRNENARYF

SEQ ID NO: 2724 - protein, 10 aa, BK virus
SRNENARYFG

SEQ ID NO: 2725 - protein, 10 aa, BK virus
RNENARYFGT

SEQ ID NO: 2726 - protein, 10 aa, BK virus
NENARYFGTF

SEQ ID NO: 2727 - protein, 10 aa, BK virus
ENARYFGTFT

SEQ ID NO: 2728 - protein, 10 aa, BK virus
NARYFGTFTG

SEQ ID NO: 2729 - protein, 10 aa, BK virus
ARYFGTFTGG

SEQ ID NO: 2730 - protein, 10 aa, BK virus
RYFGTFTGGE

SEQ ID NO: 2731 - protein, 10 aa, BK virus
YFGTFTGGEN

SEQ ID NO: 2732 - protein, 10 aa, BK virus
FGTFTGGENV

SEQ ID NO: 2733 - protein, 10 aa, BK virus
GTFTGGENVP

SEQ ID NO: 2734 - protein, 10 aa, BK virus
TFTGGENVPP

SEQ ID NO: 2735 - protein, 10 aa, BK virus
FTGGENVPPV

SEQ ID NO: 2736 - protein, 10 aa, BK virus
TGGENVPPVL

SEQ ID NO: 2737 - protein, 10 aa, BK virus
GGENVPPVLH

SEQ ID NO: 2738 - protein, 10 aa, BK virus
GENVPPVLHV

SEQ ID NO: 2739 - protein, 10 aa, BK virus
ENVPPVLHVT

SEQ ID NO: 2740 - protein, 10 aa, BK virus
NVPPVLHVTN

SEQ ID NO: 2741 - protein, 10 aa, BK virus
VPPVLHVTNT

SEQ ID NO: 2742 - protein, 10 aa, BK virus
PPVLHVTNTA

SEQ ID NO: 2743 - protein, 10 aa, BK virus
PVLHVTNTAT

SEQ ID NO: 2744 - protein, 10 aa, BK virus
VLHVTNTATT

SEQ ID NO: 2745 - protein, 10 aa, BK virus
LHVTNTATTV

SEQ ID NO: 2746 - protein, 10 aa, BK virus
HVTNTATTVL

SEQ ID NO: 2747 - protein, 10 aa, BK virus
VTNTATTVLL

SEQ ID NO: 2748 - protein, 10 aa, BK virus
TNTATTVLLD

SEQ ID NO: 2749 - protein, 10 aa, BK virus
NTATTVLLDE

SEQ ID NO: 2750 - protein, 10 aa, BK virus
TATTVLLDEQ

SEQ ID NO: 2751 - protein, 10 aa, BK virus
ATTVLLDEQG

SEQ ID NO: 2752 - protein, 10 aa, BK virus
TTVLLDEQGV

SEQ ID NO: 2753 - protein, 10 aa, BK virus
TVLLDEQGVG

SEQ ID NO: 2754 - protein, 10 aa, BK virus
VLLDEQGVGP

SEQ ID NO: 2755 - protein, 10 aa, BK virus
LLDEQGVGPL

SEQ ID NO: 2756 - protein, 10 aa, BK virus
LDEQGVGPLC

SEQ ID NO: 2757 - protein, 10 aa, BK virus
DEQGVGPLCK

SEQ ID NO: 2758 - protein, 10 aa, BK virus
EQGVGPLCKA

SEQ ID NO: 2759 - protein, 10 aa, BK virus
QGVGPLCKAD

SEQ ID NO: 2760 - protein, 10 aa, BK virus
GVGPLCKADS

SEQ ID NO: 2761 - protein, 10 aa, BK virus
VGPLCKADSL

SEQ ID NO: 2762 - protein, 10 aa, BK virus
GPLCKADSLY

SEQ ID NO: 2763 - protein, 10 aa, BK virus
PLCKADSLYV

SEQ ID NO: 2764 - protein, 10 aa, BK virus
LCKADSLYVS

SEQ ID NO: 2765 - protein, 10 aa, BK virus
CKADSLYVSA

SEQ ID NO: 2766 - protein, 10 aa, BK virus
KADSLYVSAA

SEQ ID NO: 2767 - protein, 10 aa, BK virus
ADSLYVSAAD

SEQ ID NO: 2768 - protein, 10 aa, BK virus
DSLYVSAADI

SEQ ID NO: 2769 - protein, 10 aa, BK virus
SLYVSAADIC

SEQ ID NO: 2770 - protein, 10 aa, BK virus
LYVSAADICG

SEQ ID NO: 2771 - protein, 10 aa, BK virus
YVSAADICGL

SEQ ID NO: 2772 - protein, 10 aa, BK virus
VSAADICGLF

SEQ ID NO: 2773 - protein, 10 aa, BK virus
SAADICGLFT

SEQ ID NO: 2774 - protein, 10 aa, BK virus
AADICGLFTN

SEQ ID NO: 2775 - protein, 10 aa, BK virus
ADICGLFTNS

SEQ ID NO: 2776 - protein, 10 aa, BK virus
DICGLFTNSS

SEQ ID NO: 2777 - protein, 10 aa, BK virus
ICGLFTNSSG

SEQ ID NO: 2778 - protein, 10 aa, BK virus
CGLFTNSSGT

SEQ ID NO: 2779 - protein, 10 aa, BK virus
GLFTNSSGTQ

SEQ ID NO: 2780 - protein, 10 aa, BK virus
LFTNSSGTQQ

SEQ ID NO: 2781 - protein, 10 aa, BK virus
FTNSSGTQQW

SEQ ID NO: 2782 - protein, 10 aa, BK virus
TNSSGTQQWR

SEQ ID NO: 2783 - protein, 10 aa, BK virus
NSSGTQQWRG

SEQ ID NO: 2784 - protein, 10 aa, BK virus
SSGTQQWRGL

SEQ ID NO: 2785 - protein, 10 aa, BK virus
SGTQQWRGLA

SEQ ID NO: 2786 - protein, 10 aa, BK virus
GTQQWRGLAR

SEQ ID NO: 2787 - protein, 10 aa, BK virus
TQQWRGLARY

SEQ ID NO: 2788 - protein, 10 aa, BK virus
QQWRGLARYF

SEQ ID NO: 2789 - protein, 10 aa, BK virus
QWRGLARYFK

SEQ ID NO: 2790 - protein, 10 aa, BK virus
WRGLARYFKI

SEQ ID NO: 2791 - protein, 10 aa, BK virus
RGLARYFKIR

SEQ ID NO: 2792 - protein, 10 aa, BK virus
GLARYFKIRL

SEQ ID NO: 2793 - protein, 10 aa, BK virus
LARYFKIRLR

SEQ ID NO: 2794 - protein, 10 aa, BK virus
ARYFKIRLRK

SEQ ID NO: 2795 - protein, 10 aa, BK virus
RYFKIRLRKR

SEQ ID NO: 2796 - protein, 10 aa, BK virus
YFKIRLRKRS

SEQ ID NO: 2797 - protein, 10 aa, BK virus
FKIRLRKRSV

SEQ ID NO: 2798 - protein, 10 aa, BK virus
KIRLRKRSVK

SEQ ID NO: 2799 - protein, 10 aa, BK virus
IRLRKRSVKN

SEQ ID NO: 2800 - protein, 10 aa, BK virus
RLRKRSVKNP

SEQ ID NO: 2801 - protein, 10 aa, BK virus
LRKRSVKNPY

SEQ ID NO: 2802 - protein, 10 aa, BK virus
RKRSVKNPYP

SEQ ID NO: 2803 - protein, 10 aa, BK virus
KRSVKNPYPI

SEQ ID NO: 2804 - protein, 10 aa, BK virus
RSVKNPYPIS

SEQ ID NO: 2805 - protein, 10 aa, BK virus
SVKNPYPISF

SEQ ID NO: 2806 - protein, 10 aa, BK virus
VKNPYPISFL

SEQ ID NO: 2807 - protein, 10 aa, BK virus
KNPYPISFLL

SEQ ID NO: 2808 - protein, 10 aa, BK virus
NPYPISFLLS

SEQ ID NO: 2809 - protein, 10 aa, BK virus
PYPISFLLSD

SEQ ID NO: 2810 - protein, 10 aa, BK virus
YPISFLLSDL

SEQ ID NO: 2811 - protein, 10 aa, BK virus
PISFLLSDLI

SEQ ID NO: 2812 - protein, 10 aa, BK virus
ISFLLSDLIN

SEQ ID NO: 2813 - protein, 10 aa, BK virus
SFLLSDLINR

SEQ ID NO: 2814 - protein, 10 aa, BK virus
FLLSDLINRR

SEQ ID NO: 2815 - protein, 10 aa, BK virus
LLSDLINRRT

SEQ ID NO: 2816 - protein, 10 aa, BK virus
LSDLINRRTQ

SEQ ID NO: 2817 - protein, 10 aa, BK virus
SDLINRRTQR

SEQ ID NO: 2818 - protein, 10 aa, BK virus
DLINRRTQRV

SEQ ID NO: 2819 - protein, 10 aa, BK virus
LINRRTQRVD

SEQ ID NO: 2820 - protein, 10 aa, BK virus
INRRTQRVDG

SEQ ID NO: 2821 - protein, 10 aa, BK virus
NRRTQRVDGQ

SEQ ID NO: 2822 - protein, 10 aa, BK virus
RRTQRVDGQP

SEQ ID NO: 2823 - protein, 10 aa, BK virus
RTQRVDGQPM

SEQ ID NO: 2824 - protein, 10 aa, BK virus
TQRVDGQPMY

SEQ ID NO: 2825 - protein, 10 aa, BK virus
QRVDGQPMYG

SEQ ID NO: 2826 - protein, 10 aa, BK virus
RVDGQPMYGM

SEQ ID NO: 2827 - protein, 10 aa, BK virus
VDGQPMYGME

SEQ ID NO: 2828 - protein, 10 aa, BK virus
DGQPMYGMES

SEQ ID NO: 2829 - protein, 10 aa, BK virus
GQPMYGMESQ

SEQ ID NO: 2830 - protein, 10 aa, BK virus
QPMYGMESQV

SEQ ID NO: 2831 - protein, 10 aa, BK virus
PMYGMESQVE

SEQ ID NO: 2832 - protein, 10 aa, BK virus
MYGMESQVEE

SEQ ID NO: 2833 - protein, 10 aa, BK virus
YGMESQVEEV

SEQ ID NO: 2834 - protein, 10 aa, BK virus
GMESQVEEVR

SEQ ID NO: 2835 - protein, 10 aa, BK virus
MESQVEEVRV

SEQ ID NO: 2836 - protein, 10 aa, BK virus
ESQVEEVRVF

SEQ ID NO: 2837 - protein, 10 aa, BK virus
SQVEEVRVFD

SEQ ID NO: 2838 - protein, 10 aa, BK virus
QVEEVRVFDG

SEQ ID NO: 2839 - protein, 10 aa, BK virus
VEEVRVFDGT

SEQ ID NO: 2840 - protein, 10 aa, BK virus
EEVRVFDGTE

SEQ ID NO: 2841 - protein, 10 aa, BK virus
EVRVFDGTER

SEQ ID NO: 2842 - protein, 10 aa, BK virus
VRVFDGTERL

SEQ ID NO: 2843 - protein, 10 aa, BK virus
RVFDGTERLP

SEQ ID NO: 2844 - protein, 10 aa, BK virus
VFDGTERLPG

SEQ ID NO: 2845 - protein, 10 aa, BK virus
FDGTERLPGD

SEQ ID NO: 2846 - protein, 10 aa, BK virus
DGTERLPGDP

SEQ ID NO: 2847 - protein, 10 aa, BK virus
GTERLPGDPD

SEQ ID NO: 2848 - protein, 10 aa, BK virus
TERLPGDPDM

SEQ ID NO: 2849 - protein, 10 aa, BK virus
ERLPGDPDMI

SEQ ID NO: 2850 - protein, 10 aa, BK virus
RLPGDPDMIR

SEQ ID NO: 2851 - protein, 10 aa, BK virus
LPGDPDMIRY

SEQ ID NO: 2852 - protein, 10 aa, BK virus
PGDPDMIRYI

SEQ ID NO: 2853 - protein, 10 aa, BK virus
GDPDMIRYID

SEQ ID NO: 2854 - protein, 10 aa, BK virus
DPDMIRYIDK

SEQ ID NO: 2855 - protein, 10 aa, BK virus
PDMIRYIDKQ

SEQ ID NO: 2856 - protein, 10 aa, BK virus
DMIRYIDKQG

SEQ ID NO: 2857 - protein, 10 aa, BK virus
MIRYIDKQGQ

SEQ ID NO: 2858 - protein, 10 aa, BK virus
IRYIDKQGQL

SEQ ID NO: 2859 - protein, 10 aa, BK virus
RYIDKQGQLQ

SEQ ID NO: 2860 - protein, 10 aa, BK virus
YIDKQGQLQT

SEQ ID NO: 2861 - protein, 10 aa, BK virus
IDKQGQLQTK

SEQ ID NO: 2862 - protein, 10 aa, BK virus
DKQGQLQTKM

SEQ ID NO: 2863 - protein, 10 aa, BK virus
KQGQLQTKML

SEQ ID NO: 2864 - protein, 10 aa, BK virus
TGAFIVHIHL

SEQ ID NO: 2865 - protein, 10 aa, BK virus
GAFIVHIHLI

SEQ ID NO: 2866 - protein, 10 aa, BK virus
AFIVHIHLIN

SEQ ID NO: 2867 - protein, 10 aa, BK virus
FIVHIHLINA

SEQ ID NO: 2868 - protein, 10 aa, BK virus
IVHIHLINAA

SEQ ID NO: 2869 - protein, 10 aa, BK virus
VHIHLINAAF

SEQ ID NO: 2870 - protein, 10 aa, BK virus
HIHLINAAFV

SEQ ID NO: 2871 - protein, 10 aa, BK virus
ATFKLVLFWG

SEQ ID NO: 2872 - protein, 10 aa, BK virus
TFKLVLFWGW

SEQ ID NO: 2873 - protein, 10 aa, BK virus
FKLVLFWGWC

SEQ ID NO: 2874 - protein, 10 aa, BK virus
KLVLFWGWCF

SEQ ID NO: 2875 - protein, 10 aa, BK virus
LVLFWGWCFR

SEQ ID NO: 2876 - protein, 10 aa, BK virus
VLFWGWCFRP

SEQ ID NO: 2877 - protein, 10 aa, BK virus
LFWGWCFRPF

SEQ ID NO: 2878 - protein, 10 aa, BK virus
FWGWCFRPFK

SEQ ID NO: 2879 - protein, 10 aa, BK virus
WGWCFRPFKT

SEQ ID NO: 2880 - protein, 10 aa, BK virus
GWCFRPFKTL

SEQ ID NO: 2881 - protein, 10 aa, BK virus
WCFRPFKTLK

SEQ ID NO: 2882 - protein, 10 aa, BK virus
CFRPFKTLKA

SEQ ID NO: 2883 - protein, 10 aa, BK virus
FRPFKTLKAF

SEQ ID NO: 2884 - protein, 10 aa, BK virus
RPFKTLKAFT

SEQ ID NO: 2885 - protein, 10 aa, BK virus
PFKTLKAFTQ

SEQ ID NO: 2886 - protein, 10 aa, BK virus
FKTLKAFTQM

SEQ ID NO: 2887 - protein, 10 aa, BK virus
KTLKAFTQMQ

SEQ ID NO: 2888 - protein, 10 aa, BK virus
TLKAFTQMQL

SEQ ID NO: 2889 - protein, 10 aa, BK virus
LKAFTQMQLL

SEQ ID NO: 2890 - protein, 10 aa, BK virus
KAFTQMQLLT

SEQ ID NO: 2891 - protein, 10 aa, BK virus
AFTQMQLLTM

SEQ ID NO: 2892 - protein, 10 aa, BK virus
FTQMQLLTMG

SEQ ID NO: 2893 - protein, 10 aa, BK virus
TQMQLLTMGV

SEQ ID NO: 2894 - protein, 10 aa, BK virus
ILFSCNIKNT

SEQ ID NO: 2895 - protein, 10 aa, BK virus
LFSCNIKNTF

SEQ ID NO: 2896 - protein, 10 aa, BK virus
FSCNIKNTFP

SEQ ID NO: 2897 - protein, 10 aa, BK virus
SCNIKNTFPH

SEQ ID NO: 2898 - protein, 10 aa, BK virus
CNIKNTFPHA

SEQ ID NO: 2899 - protein, 10 aa, BK virus
NIKNTFPHAY

SEQ ID NO: 2900 - protein, 10 aa, BK virus
IKNTFPHAYI

SEQ ID NO: 2901 - protein, 10 aa, BK virus
KNTFPHAYII

SEQ ID NO: 2902 - protein, 10 aa, BK virus
NTFPHAYIIF

SEQ ID NO: 2903 - protein, 10 aa, BK virus
TFPHAYIIFH

SEQ ID NO: 2904 - protein, 10 aa, BK virus
FPHAYIIFHP

SEQ ID NO: 2905 - protein, 10 aa, BK virus
KSIHTYLRIQ

SEQ ID NO: 2906 - protein, 10 aa, BK virus
SIHTYLRIQP

SEQ ID NO: 2907 - protein, 10 aa, BK virus
IHTYLRIQPF

SEQ ID NO: 2908 - protein, 10 aa, BK virus
HTYLRIQPFL

SEQ ID NO: 2909 - protein, 10 aa, BK virus
TYLRIQPFLP

SEQ ID NO: 2910 - protein, 10 aa, BK virus
YLRIQPFLPF

SEQ ID NO: 2911 - protein, 10 aa, BK virus
LRIQPFLPFN

SEQ ID NO: 2912 - protein, 10 aa, BK virus
RIQPFLPFNN

SEQ ID NO: 2913 - protein, 10 aa, BK virus
IQPFLPFNNS

SEQ ID NO: 2914 - protein, 10 aa, BK virus
QPFLPFNNSR

SEQ ID NO: 2915 - protein, 10 aa, BK virus
PFLPFNNSRL

SEQ ID NO: 2916 - protein, 10 aa, BK virus
FLPFNNSRLY

SEQ ID NO: 2917 - protein, 10 aa, BK virus
LPFNNSRLYI

SEQ ID NO: 2918 - protein, 10 aa, BK virus
PFNNSRLYIS

SEQ ID NO: 2919 - protein, 10 aa, BK virus
FNNSRLYISC

SEQ ID NO: 2920 - protein, 10 aa, BK virus
NNSRLYISCK

SEQ ID NO: 2921 - protein, 10 aa, BK virus
NSRLYISCKI

SEQ ID NO: 2922 - protein, 10 aa, BK virus
SRLYISCKIS

SEQ ID NO: 2923 - protein, 10 aa, BK virus
RLYISCKISY

SEQ ID NO: 2924 - protein, 10 aa, BK virus
LYISCKISYR

SEQ ID NO: 2925 - protein, 10 aa, BK virus
YISCKISYRP

SEQ ID NO: 2926 - protein, 10 aa, BK virus
ISCKISYRPK

SEQ ID NO: 2927 - protein, 10 aa, BK virus
SCKISYRPKP

SEQ ID NO: 2928 - protein, 10 aa, BK virus
CKISYRPKPN

SEQ ID NO: 2929 - protein, 10 aa, BK virus
IYFGPKIYLS

SEQ ID NO: 2930 - protein, 10 aa, BK virus
YFGPKIYLSY

SEQ ID NO: 2931 - protein, 10 aa, BK virus
FGPKIYLSYK

SEQ ID NO: 2932 - protein, 10 aa, BK virus
GPKIYLSYKS

SEQ ID NO: 2933 - protein, 10 aa, BK virus
PKIYLSYKSS

SEQ ID NO: 2934 - protein, 10 aa, BK virus
KIYLSYKSSL

SEQ ID NO: 2935 - protein, 10 aa, BK virus
IYLSYKSSLQ

SEQ ID NO: 2936 - protein, 10 aa, BK virus
YLSYKSSLQG

SEQ ID NO: 2937 - protein, 10 aa, BK virus
LSYKSSLQGF

SEQ ID NO: 2938 - protein, 10 aa, BK virus
SYKSSLQGFR

SEQ ID NO: 2939 - protein, 10 aa, BK virus
YKSSLQGFRD

SEQ ID NO: 2940 - protein, 10 aa, BK virus
KSSLQGFRDR

SEQ ID NO: 2941 - protein, 10 aa, BK virus
SSLQGFRDRI

SEQ ID NO: 2942 - protein, 10 aa, BK virus
SLQGFRDRIL

SEQ ID NO: 2943 - protein, 10 aa, BK virus
LQGFRDRILI

SEQ ID NO: 2944 - protein, 10 aa, BK virus
QGFRDRILIH

SEQ ID NO: 2945 - protein, 10 aa, BK virus
GFRDRILIHC

SEQ ID NO: 2946 - protein, 10 aa, BK virus
FRDRILIHCN

SEQ ID NO: 2947 - protein, 10 aa, BK virus
RDRILIHCNQ

SEQ ID NO: 2948 - protein, 10 aa, BK virus
DRILIHCNQA

SEQ ID NO: 2949 - protein, 10 aa, BK virus
RILIHCNQAW

SEQ ID NO: 2950 - protein, 10 aa, BK virus
ILIHCNQAWW

SEQ ID NO: 2951 - protein, 10 aa, BK virus
LIHCNQAWWK

SEQ ID NO: 2952 - protein, 10 aa, BK virus
IHCNQAWWKY

SEQ ID NO: 2953 - protein, 10 aa, BK virus
HCNQAWWKYL

SEQ ID NO: 2954 - protein, 10 aa, BK virus
CNQAWWKYLG

SEQ ID NO: 2955 - protein, 10 aa, BK virus
NQAWWKYLGS

SEQ ID NO: 2956 - protein, 10 aa, BK virus
QAWWKYLGSF

SEQ ID NO: 2957 - protein, 10 aa, BK virus
AWWKYLGSFV

SEQ ID NO: 2958 - protein, 10 aa, BK virus
FSSCPFYIFK

SEQ ID NO: 2959 - protein, 10 aa, BK virus
SSCPFYIFKN

SEQ ID NO: 2960 - protein, 10 aa, BK virus
SCPFYIFKNN

SEQ ID NO: 2961 - protein, 10 aa, BK virus
CPFYIFKNNH

SEQ ID NO: 2962 - protein, 10 aa, BK virus
PFYIFKNNHV

SEQ ID NO: 2963 - protein, 10 aa, BK virus
FYIFKNNHVL

SEQ ID NO: 2964 - protein, 10 aa, BK virus
YIFKNNHVLI

SEQ ID NO: 2965 - protein, 10 aa, BK virus
IFKNNHVLIY

SEQ ID NO: 2966 - protein, 10 aa, BK virus
FKNNHVLIYS

SEQ ID NO: 2967 - protein, 10 aa, BK virus
KNNHVLIYSY

SEQ ID NO: 2968 - protein, 10 aa, BK virus
NNHVLIYSYT

SEQ ID NO: 2969 - protein, 10 aa, BK virus
CCFSTINGTF

SEQ ID NO: 2970 - protein, 10 aa, BK virus
CFSTINGTFK

SEQ ID NO: 2971 - protein, 10 aa, BK virus
PVSSFRYIEN

SEQ ID NO: 2972 - protein, 10 aa, BK virus
VSSFRYIENN

SEQ ID NO: 2973 - protein, 10 aa, BK virus
SSFRYIENNT

SEQ ID NO: 2974 - protein, 10 aa, BK virus
SFRYIENNTV

SEQ ID NO: 2975 - protein, 10 aa, BK virus
FRYIENNTVQ

SEQ ID NO: 2976 - protein, 10 aa, BK virus
RYIENNTVQK

SEQ ID NO: 2977 - protein, 10 aa, BK virus
YIENNTVQKI

SEQ ID NO: 2978 - protein, 10 aa, BK virus
IENNTVQKIK

SEQ ID NO: 2979 - protein, 10 aa, BK virus
ENNTVQKIKY

SEQ ID NO: 2980 - protein, 10 aa, BK virus
NNTVQKIKYY

SEQ ID NO: 2981 - protein, 10 aa, BK virus
NTVQKIKYYR

SEQ ID NO: 2982 - protein, 10 aa, BK virus
TVQKIKYYRI

SEQ ID NO: 2983 - protein, 10 aa, BK virus
VQKIKYYRIH

SEQ ID NO: 2984 - protein, 10 aa, BK virus
QKIKYYRIHF

SEQ ID NO: 2985 - protein, 10 aa, BK virus
KIKYYRIHFR

SEQ ID NO: 2986 - protein, 10 aa, BK virus
QTVQPSNTCH

SEQ ID NO: 2987 - protein, 10 aa, BK virus
TVQPSNTCHI

SEQ ID NO: 2988 - protein, 10 aa, BK virus
VQPSNTCHIL

SEQ ID NO: 2989 - protein, 10 aa, BK virus
QPSNTCHILF

SEQ ID NO: 2990 - protein, 10 aa, BK virus
HFFPGHMKGI

SEQ ID NO: 2991 - protein, 10 aa, BK virus
FFPGHMKGIY

SEQ ID NO: 2992 - protein, 10 aa, BK virus
FPGHMKGIYS

SEQ ID NO: 2993 - protein, 10 aa, BK virus
PGHMKGIYSF

SEQ ID NO: 2994 - protein, 10 aa, BK virus
GHMKGIYSFF

SEQ ID NO: 2995 - protein, 10 aa, BK virus
HMKGIYSFFS

SEQ ID NO: 2996 - protein, 10 aa, BK virus
NCIYCLLTNT

SEQ ID NO: 2997 - protein, 10 aa, BK virus
CIYCLLTNTF

SEQ ID NO: 2998 - protein, 10 aa, BK virus
IYCLLTNTFL

SEQ ID NO: 2999 - protein, 10 aa, BK virus
YCLLTNTFLI

SEQ ID NO: 3000 - protein, 10 aa, BK virus
CLLTNTFLIF

SEQ ID NO: 3001 - protein, 10 aa, BK virus
LLTNTFLIFT

SEQ ID NO: 3002 - protein, 10 aa, BK virus
LTNTFLIFTF

SEQ ID NO: 3003 - protein, 10 aa, BK virus
TNTFLIFTFC

SEQ ID NO: 3004 - protein, 10 aa, BK virus
NTFLIFTFCK

SEQ ID NO: 3005 - protein, 10 aa, BK virus
TFLIFTFCKN

SEQ ID NO: 3006 - protein, 10 aa, BK virus
FLIFTFCKNN

SEQ ID NO: 3007 - protein, 10 aa, BK virus
LIFTFCKNNS

SEQ ID NO: 3008 - protein, 10 aa, BK virus
IFTFCKNNSI

SEQ ID NO: 3009 - protein, 10 aa, BK virus
FTFCKNNSIC

SEQ ID NO: 3010 - protein, 10 aa, BK virus
TFCKNNSICK

SEQ ID NO: 3011 - protein, 10 aa, BK virus
FCKNNSICKV

SEQ ID NO: 3012 - protein, 10 aa, BK virus
CKNNSICKVL

SEQ ID NO: 3013 - protein, 10 aa, BK virus
KNNSICKVLF

SEQ ID NO: 3014 - protein, 10 aa, BK virus
NNSICKVLFM

SEQ ID NO: 3015 - protein, 10 aa, BK virus
NSICKVLFMI

SEQ ID NO: 3016 - protein, 10 aa, BK virus
SICKVLFMIL

SEQ ID NO: 3017 - protein, 10 aa, BK virus
ICKVLFMILK

SEQ ID NO: 3018 - protein, 10 aa, BK virus
CKVLFMILKV

SEQ ID NO: 3019 - protein, 10 aa, BK virus
KVLFMILKVI

SEQ ID NO: 3020 - protein, 10 aa, BK virus
VLFMILKVIR

SEQ ID NO: 3021 - protein, 10 aa, BK virus
LFMILKVIRL

SEQ ID NO: 3022 - protein, 10 aa, BK virus
FMILKVIRLV

SEQ ID NO: 3023 - protein, 10 aa, BK virus
MILKVIRLVF

SEQ ID NO: 3024 - protein, 10 aa, BK virus
ILKVIRLVFF

SEQ ID NO: 3025 - protein, 10 aa, BK virus
LKVIRLVFFL

SEQ ID NO: 3026 - protein, 10 aa, BK virus
KVIRLVFFLT

SEQ ID NO: 3027 - protein, 10 aa, BK virus
VIRLVFFLTL

SEQ ID NO: 3028 - protein, 10 aa, BK virus
IRLVFFLTLF

SEQ ID NO: 3029 - protein, 10 aa, BK virus
RLVFFLTLFT

SEQ ID NO: 3030 - protein, 10 aa, BK virus
LVFFLTLFTL

SEQ ID NO: 3031 - protein, 10 aa, BK virus
VFFLTLFTLL

SEQ ID NO: 3032 - protein, 10 aa, BK virus
FFLTLFTLLY

SEQ ID NO: 3033 - protein, 10 aa, BK virus
FLTLFTLLYI

SEQ ID NO: 3034 - protein, 10 aa, BK virus
LTLFTLLYIV

SEQ ID NO: 3035 - protein, 10 aa, BK virus
TLFTLLYIVL

SEQ ID NO: 3036 - protein, 10 aa, BK virus
LFTLLYIVLK

SEQ ID NO: 3037 - protein, 10 aa, BK virus
FTLLYIVLKF

SEQ ID NO: 3038 - protein, 10 aa, BK virus
KHILTLCLYC

SEQ ID NO: 3039 - protein, 10 aa, BK virus
HILTLCLYCI

SEQ ID NO: 3040 - protein, 10 aa, BK virus
ILTLCLYCIL

SEQ ID NO: 3041 - protein, 10 aa, BK virus
LTLCLYCILS

SEQ ID NO: 3042 - protein, 10 aa, BK virus
TLCLYCILSN

SEQ ID NO: 3043 - protein, 10 aa, BK virus
FPRHLLCFFR

SEQ ID NO: 3044 - protein, 10 aa, BK virus
PRHLLCFFRL

SEQ ID NO: 3045 - protein, 10 aa, BK virus
RHLLCFFRLF

SEQ ID NO: 3046 - protein, 10 aa, BK virus
HLLCFFRLFW

SEQ ID NO: 3047 - protein, 10 aa, BK virus
LLCFFRLFWA

SEQ ID NO: 3048 - protein, 10 aa, BK virus
LCFFRLFWAK

SEQ ID NO: 3049 - protein, 10 aa, BK virus
CFFRLFWAKI

SEQ ID NO: 3050 - protein, 10 aa, BK virus
FFRLFWAKIM

SEQ ID NO: 3051 - protein, 10 aa, BK virus
FRLFWAKIML

SEQ ID NO: 3052 - protein, 10 aa, BK virus
RLFWAKIMLL

SEQ ID NO: 3053 - protein, 10 aa, BK virus
APLNAFFYSM

SEQ ID NO: 3054 - protein, 10 aa, BK virus
PLNAFFYSMV

SEQ ID NO: 3055 - protein, 10 aa, BK virus
LNAFFYSMVW

SEQ ID NO: 3056 - protein, 10 aa, BK virus
NAFFYSMVWI

SEQ ID NO: 3057 - protein, 10 aa, BK virus
AFFYSMVWIS

SEQ ID NO: 3058 - protein, 10 aa, BK virus
FFYSMVWISS

SEQ ID NO: 3059 - protein, 10 aa, BK virus
KTKGTQLLTE

SEQ ID NO: 3060 - protein, 10 aa, BK virus
TKGTQLLTEI

SEQ ID NO: 3061 - protein, 10 aa, BK virus
KGTQLLTEII

SEQ ID NO: 3062 - protein, 10 aa, BK virus
GTQLLTEIIN

SEQ ID NO: 3063 - protein, 10 aa, BK virus
TQLLTEIINC

SEQ ID NO: 3064 - protein, 10 aa, BK virus
QLLTEIINCR

SEQ ID NO: 3065 - protein, 10 aa, BK virus
LLTEIINCRN

SEQ ID NO: 3066 - protein, 10 aa, BK virus
LTEIINCRNS

SEQ ID NO: 3067 - protein, 10 aa, BK virus
TEIINCRNSM

SEQ ID NO: 3068 - protein, 10 aa, BK virus
EIINCRNSMS

SEQ ID NO: 3069 - protein, 10 aa, BK virus
IINCRNSMSM

SEQ ID NO: 3070 - protein, 10 aa, BK virus
INCRNSMSMW

SEQ ID NO: 3071 - protein, 10 aa, BK virus
NCRNSMSMWS

SEQ ID NO: 3072 - protein, 10 aa, BK virus
KEYNIMPSTH

SEQ ID NO: 3073 - protein, 10 aa, BK virus
EYNIMPSTHV

SEQ ID NO: 3074 - protein, 10 aa, BK virus
YNIMPSTHVS

SEQ ID NO: 3075 - protein, 10 aa, BK virus
NIMPSTHVST

SEQ ID NO: 3076 - protein, 10 aa, BK virus
IMPSTHVSTN

SEQ ID NO: 3077 - protein, 10 aa, BK virus
MPSTHVSTNK

SEQ ID NO: 3078 - protein, 10 aa, BK virus
PSTHVSTNKS

SEQ ID NO: 3079 - protein, 10 aa, BK virus
STHVSTNKSY

SEQ ID NO: 3080 - protein, 10 aa, BK virus
THVSTNKSYR

SEQ ID NO: 3081 - protein, 10 aa, BK virus
HVSTNKSYRI

SEQ ID NO: 3082 - protein, 10 aa, BK virus
VSTNKSYRIF

SEQ ID NO: 3083 - protein, 10 aa, BK virus
STNKSYRIFF

SEQ ID NO: 3084 - protein, 10 aa, BK virus
TNKSYRIFFH

SEQ ID NO: 3085 - protein, 10 aa, BK virus
NKSYRIFFHK

SEQ ID NO: 3086 - protein, 10 aa, BK virus
KSYRIFFHKF

SEQ ID NO: 3087 - protein, 10 aa, BK virus
SYRIFFHKFF

SEQ ID NO: 3088 - protein, 10 aa, BK virus
YRIFFHKFFI

SEQ ID NO: 3089 - protein, 10 aa, BK virus
RIFFHKFFIQ

SEQ ID NO: 3090 - protein, 10 aa, BK virus
IFFHKFFIQN

SEQ ID NO: 3091 - protein, 10 aa, BK virus
FFHKFFIQNL

SEQ ID NO: 3092 - protein, 10 aa, BK virus
FHKFFIQNLS

SEQ ID NO: 3093 - protein, 10 aa, BK virus
HKFFIQNLSF

SEQ ID NO: 3094 - protein, 10 aa, BK virus
KFFIQNLSFF

SEQ ID NO: 3095 - protein, 10 aa, BK virus
FFIQNLSFFF

SEQ ID NO: 3096 - protein, 10 aa, BK virus
FIQNLSFFFS

SEQ ID NO: 3097 - protein, 10 aa, BK virus
IQNLSFFFSS

SEQ ID NO: 3098 - protein, 10 aa, BK virus
QNLSFFFSSI

SEQ ID NO: 3099 - protein, 10 aa, BK virus
NLSFFFSSIH

SEQ ID NO: 3100 - protein, 10 aa, BK virus
LSFFFSSIHS

SEQ ID NO: 3101 - protein, 10 aa, BK virus
SFFFSSIHSK

SEQ ID NO: 3102 - protein, 10 aa, BK virus
FFFSSIHSKA

SEQ ID NO: 3103 - protein, 10 aa, BK virus
FFSSIHSKAG

SEQ ID NO: 3104 - protein, 10 aa, BK virus
FSSIHSKAGK

SEQ ID NO: 3105 - protein, 10 aa, BK virus
SSIHSKAGKG

SEQ ID NO: 3106 - protein, 10 aa, BK virus
SIHSKAGKGS

SEQ ID NO: 3107 - protein, 10 aa, BK virus
IHSKAGKGSI

SEQ ID NO: 3108 - protein, 10 aa, BK virus
HSKAGKGSIT

SEQ ID NO: 3109 - protein, 10 aa, BK virus
SKAGKGSITK

SEQ ID NO: 3110 - protein, 10 aa, BK virus
KAGKGSITKY

SEQ ID NO: 3111 - protein, 10 aa, BK virus
AGKGSITKYS

SEQ ID NO: 3112 - protein, 10 aa, BK virus
GKGSITKYSL

SEQ ID NO: 3113 - protein, 10 aa, BK virus
KGSITKYSLT

SEQ ID NO: 3114 - protein, 10 aa, BK virus
GSITKYSLTK

SEQ ID NO: 3115 - protein, 10 aa, BK virus
SITKYSLTKK

SEQ ID NO: 3116 - protein, 10 aa, BK virus
ITKYSLTKKL

SEQ ID NO: 3117 - protein, 10 aa, BK virus
TKYSLTKKLV

SEQ ID NO: 3118 - protein, 10 aa, BK virus
IRGKVFRVFY

SEQ ID NO: 3119 - protein, 10 aa, BK virus
RGKVFRVFYL

SEQ ID NO: 3120 - protein, 10 aa, BK virus
GKVFRVFYLS

SEQ ID NO: 3121 - protein, 10 aa, BK virus
KVFRVFYLSF

SEQ ID NO: 3122 - protein, 10 aa, BK virus
VFRVFYLSFF

SEQ ID NO: 3123 - protein, 10 aa, BK virus
FRVFYLSFFF

SEQ ID NO: 3124 - protein, 10 aa, BK virus
RVFYLSFFFG

SEQ ID NO: 3125 - protein, 10 aa, BK virus
VFYLSFFFGW

SEQ ID NO: 3126 - protein, 10 aa, BK virus
FYLSFFFGWC

SEQ ID NO: 3127 - protein, 10 aa, BK virus
VLRICCCFFI

SEQ ID NO: 3128 - protein, 10 aa, BK virus
LRICCCFFIT

SEQ ID NO: 3129 - protein, 10 aa, BK virus
RICCCFFITG

SEQ ID NO: 3130 - protein, 10 aa, BK virus
ICCCFFITGK

SEQ ID NO: 3131 - protein, 10 aa, BK virus
CCCFFITGKH

SEQ ID NO: 3132 - protein, 10 aa, BK virus
CCFFITGKHI

SEQ ID NO: 3133 - protein, 10 aa, BK virus
CFFITGKHIF

SEQ ID NO: 3134 - protein, 10 aa, BK virus
FFITGKHIFM

SEQ ID NO: 3135 - protein, 10 aa, BK virus
FITGKHIFMA

SEQ ID NO: 3136 - protein, 10 aa, BK virus
ITGKHIFMAK

SEQ ID NO: 3137 - protein, 10 aa, BK virus
IFIPFFIKGT

SEQ ID NO: 3138 - protein, 10 aa, BK virus
FIPFFIKGTP

SEQ ID NO: 3139 - protein, 10 aa, BK virus
IPFFIKGTPP

SEQ ID NO: 3140 - protein, 10 aa, BK virus
PFFIKGTPPG

SEQ ID NO: 3141 - protein, 10 aa, BK virus
FFIKGTPPGL

SEQ ID NO: 3142 - protein, 10 aa, BK virus
FIKGTPPGLP

SEQ ID NO: 3143 - protein, 10 aa, BK virus
IKGTPPGLPL

SEQ ID NO: 3144 - protein, 10 aa, BK virus
KGTPPGLPLF

SEQ ID NO: 3145 - protein, 10 aa, BK virus
GTPPGLPLFC

SEQ ID NO: 3146 - protein, 10 aa, BK virus
TPPGLPLFCS

SEQ ID NO: 3147 - protein, 10 aa, BK virus
PPGLPLFCSI

SEQ ID NO: 3148 - protein, 10 aa, BK virus
PGLPLFCSIG

SEQ ID NO: 3149 - protein, 10 aa, BK virus
GLPLFCSIGW

SEQ ID NO: 3150 - protein, 10 aa, BK virus
LPLFCSIGWH

SEQ ID NO: 3151 - protein, 10 aa, BK virus
PLFCSIGWHL

SEQ ID NO: 3152 - protein, 10 aa, BK virus
SFRSLKGVSP

SEQ ID NO: 3153 - protein, 10 aa, BK virus
FRSLKGVSPI

SEQ ID NO: 3154 - protein, 10 aa, BK virus
RSLKGVSPII

SEQ ID NO: 3155 - protein, 10 aa, BK virus
SLKGVSPIIW

SEQ ID NO: 3156 - protein, 10 aa, BK virus
LKGVSPIIWT

SEQ ID NO: 3157 - protein, 10 aa, BK virus
KGVSPIIWTH

SEQ ID NO: 3158 - protein, 10 aa, BK virus
GVSPIIWTHH

SEQ ID NO: 3159 - protein, 10 aa, BK virus
VSPIIWTHHC

SEQ ID NO: 3160 - protein, 10 aa, BK virus
SPIIWTHHCR

SEQ ID NO: 3161 - protein, 10 aa, BK virus
PIIWTHHCRV

SEQ ID NO: 3162 - protein, 10 aa, BK virus
IIWTHHCRVS

SEQ ID NO: 3163 - protein, 10 aa, BK virus
IWTHHCRVSS

SEQ ID NO: 3164 - protein, 10 aa, BK virus
WTHHCRVSSV

SEQ ID NO: 3165 - protein, 10 aa, BK virus
THHCRVSSVR

SEQ ID NO: 3166 - protein, 10 aa, BK virus
HHCRVSSVRS

SEQ ID NO: 3167 - protein, 10 aa, BK virus
HCRVSSVRSK

SEQ ID NO: 3168 - protein, 10 aa, BK virus
CRVSSVRSKP

SEQ ID NO: 3169 - protein, 10 aa, BK virus
RVSSVRSKPN

SEQ ID NO: 3170 - protein, 10 aa, BK virus
VSSVRSKPNH

SEQ ID NO: 3171 - protein, 10 aa, BK virus
SSVRSKPNHC

SEQ ID NO: 3172 - protein, 10 aa, BK virus
SVRSKPNHCV

SEQ ID NO: 3173 - protein, 10 aa, BK virus
VRSKPNHCVK

SEQ ID NO: 3174 - protein, 10 aa, BK virus
RSKPNHCVKQ

SEQ ID NO: 3175 - protein, 10 aa, BK virus
SKPNHCVKQS

SEQ ID NO: 3176 - protein, 10 aa, BK virus
KPNHCVKQSM

SEQ ID NO: 3177 - protein, 10 aa, BK virus
PNHCVKQSMQ

SEQ ID NO: 3178 - protein, 10 aa, BK virus
QSIQTKGSFL

SEQ ID NO: 3179 - protein, 10 aa, BK virus
SIQTKGSFLK

SEQ ID NO: 3180 - protein, 10 aa, BK virus
IQTKGSFLKN

SEQ ID NO: 3181 - protein, 10 aa, BK virus
QTKGSFLKNF

SEQ ID NO: 3182 - protein, 10 aa, BK virus
TKGSFLKNFL

SEQ ID NO: 3183 - protein, 10 aa, BK virus
KGSFLKNFLF

SEQ ID NO: 3184 - protein, 10 aa, BK virus
GSFLKNFLFK

SEQ ID NO: 3185 - protein, 10 aa, BK virus
SFLKNFLFKC

SEQ ID NO: 3186 - protein, 10 aa, BK virus
FLKNFLFKCL

SEQ ID NO: 3187 - protein, 10 aa, BK virus
LKNFLFKCLN

SEQ ID NO: 3188 - protein, 10 aa, BK virus
KNFLFKCLNL

SEQ ID NO: 3189 - protein, 10 aa, BK virus
NFLFKCLNLS

SEQ ID NO: 3190 - protein, 10 aa, BK virus
HSMQGQCTEG

SEQ ID NO: 3191 - protein, 10 aa, BK virus
SMQGQCTEGF

SEQ ID NO: 3192 - protein, 10 aa, BK virus
MQGQCTEGFL

SEQ ID NO: 3193 - protein, 10 aa, BK virus
QGQCTEGFLE

SEQ ID NO: 3194 - protein, 10 aa, BK virus
GQCTEGFLEQ

SEQ ID NO: 3195 - protein, 10 aa, BK virus
QCTEGFLEQI

SEQ ID NO: 3196 - protein, 10 aa, BK virus
CTEGFLEQIG

SEQ ID NO: 3197 - protein, 10 aa, BK virus
TEGFLEQIGH

SEQ ID NO: 3198 - protein, 10 aa, BK virus
EGFLEQIGHS

SEQ ID NO: 3199 - protein, 10 aa, BK virus
GFLEQIGHSL

SEQ ID NO: 3200 - protein, 10 aa, BK virus
FLEQIGHSLQ

SEQ ID NO: 3201 - protein, 10 aa, BK virus
LEQIGHSLQY

SEQ ID NO: 3202 - protein, 10 aa, BK virus
EQIGHSLQYR

SEQ ID NO: 3203 - protein, 10 aa, BK virus
QIGHSLQYRV

SEQ ID NO: 3204 - protein, 10 aa, BK virus
IGHSLQYRVS

SEQ ID NO: 3205 - protein, 10 aa, BK virus
GHSLQYRVSG

SEQ ID NO: 3206 - protein, 10 aa, BK virus
HSLQYRVSGQ

SEQ ID NO: 3207 - protein, 10 aa, BK virus
SLQYRVSGQR

SEQ ID NO: 3208 - protein, 10 aa, BK virus
LQYRVSGQRG

SEQ ID NO: 3209 - protein, 10 aa, BK virus
QYRVSGQRGK

SEQ ID NO: 3210 - protein, 10 aa, BK virus
YRVSGQRGKS

SEQ ID NO: 3211 - protein, 10 aa, BK virus
RVSGQRGKSA

SEQ ID NO: 3212 - protein, 10 aa, BK virus
VSGQRGKSAQ

SEQ ID NO: 3213 - protein, 10 aa, BK virus
SGQRGKSAQT

SEQ ID NO: 3214 - protein, 10 aa, BK virus
GQRGKSAQTS

SEQ ID NO: 3215 - protein, 10 aa, BK virus
QRGKSAQTSE

SEQ ID NO: 3216 - protein, 10 aa, BK virus
RGKSAQTSEL

SEQ ID NO: 3217 - protein, 10 aa, BK virus
GKSAQTSELL

SEQ ID NO: 3218 - protein, 10 aa, BK virus
KSAQTSELLQ

SEQ ID NO: 3219 - protein, 10 aa, BK virus
SAQTSELLQV

SEQ ID NO: 3220 - protein, 10 aa, BK virus
AQTSELLQVP

SEQ ID NO: 3221 - protein, 10 aa, BK virus
QTSELLQVPK

SEQ ID NO: 3222 - protein, 10 aa, BK virus
TSELLQVPKS

SEQ ID NO: 3223 - protein, 10 aa, BK virus
SELLQVPKSG

SEQ ID NO: 3224 - protein, 10 aa, BK virus
ATFTSCSIFL

SEQ ID NO: 3225 - protein, 10 aa, BK virus
TFTSCSIFLY

SEQ ID NO: 3226 - protein, 10 aa, BK virus
FTSCSIFLYK

SEQ ID NO: 3227 - protein, 10 aa, BK virus
TSCSIFLYKV

SEQ ID NO: 3228 - protein, 10 aa, BK virus
SCSIFLYKVF

SEQ ID NO: 3229 - protein, 10 aa, BK virus
CSIFLYKVFI

SEQ ID NO: 3230 - protein, 10 aa, BK virus
SIFLYKVFIL

SEQ ID NO: 3231 - protein, 10 aa, BK virus
IFLYKVFILF

SEQ ID NO: 3232 - protein, 10 aa, BK virus
FLYKVFILFI

SEQ ID NO: 3233 - protein, 10 aa, BK virus
LYKVFILFIL

SEQ ID NO: 3234 - protein, 10 aa, BK virus
YKVFILFILS

SEQ ID NO: 3235 - protein, 10 aa, BK virus
KVFILFILSS

SEQ ID NO: 3236 - protein, 10 aa, BK virus
VFILFILSSS

SEQ ID NO: 3237 - protein, 10 aa, BK virus
FILFILSSSP

SEQ ID NO: 3238 - protein, 10 aa, BK virus
ILFILSSSPP

SEQ ID NO: 3239 - protein, 10 aa, BK virus
LFILSSSPPL

SEQ ID NO: 3240 - protein, 10 aa, BK virus
FILSSSPPLS

SEQ ID NO: 3241 - protein, 10 aa, BK virus
ILSSSPPLSG

SEQ ID NO: 3242 - protein, 10 aa, BK virus
AFLIKGRFPQ

SEQ ID NO: 3243 - protein, 10 aa, BK virus
FLIKGRFPQA

SEQ ID NO: 3244 - protein, 10 aa, BK virus
LIKGRFPQAA

SEQ ID NO: 3245 - protein, 10 aa, BK virus
IKGRFPQAAL

SEQ ID NO: 3246 - protein, 10 aa, BK virus
KGRFPQAALS

SEQ ID NO: 3247 - protein, 10 aa, BK virus
GRFPQAALSR

SEQ ID NO: 3248 - protein, 10 aa, BK virus
RFPQAALSRP

SEQ ID NO: 3249 - protein, 10 aa, BK virus
FPQAALSRPK

SEQ ID NO: 3250 - protein, 10 aa, BK virus
PQAALSRPKR

SEQ ID NO: 3251 - protein, 10 aa, BK virus
QAALSRPKRS

SEQ ID NO: 3252 - protein, 10 aa, BK virus
AALSRPKRSM

SEQ ID NO: 3253 - protein, 10 aa, BK virus
ALSRPKRSMS

SEQ ID NO: 3254 - protein, 10 aa, BK virus
LSRPKRSMSS

SEQ ID NO: 3255 - protein, 10 aa, BK virus
SRPKRSMSSM

SEQ ID NO: 3256 - protein, 10 aa, BK virus
RPKRSMSSMD

SEQ ID NO: 3257 - protein, 10 aa, BK virus
PKRSMSSMDS

SEQ ID NO: 3258 - protein, 10 aa, BK virus
KRSMSSMDSS

SEQ ID NO: 3259 - protein, 10 aa, BK virus
RSMSSMDSSL

SEQ ID NO: 3260 - protein, 10 aa, BK virus
SMSSMDSSLL

SEQ ID NO: 3261 - protein, 10 aa, BK virus
MSSMDSSLLR

SEQ ID NO: 3262 - protein, 10 aa, BK virus
SSMDSSLLRT

SEQ ID NO: 3263 - protein, 10 aa, BK virus
SMDSSLLRTL

SEQ ID NO: 3264 - protein, 10 aa, BK virus
MDSSLLRTLS

SEQ ID NO: 3265 - protein, 11 aa, BK virus
FCKNCKRIGIS

SEQ ID NO: 3266 - protein, 11 aa, BK virus
CKNCKRIGISP

SEQ ID NO: 3267 - protein, 11 aa, BK virus
KNCKRIGISPN

SEQ ID NO: 3268 - protein, 11 aa, BK virus
NCKRIGISPNS

SEQ ID NO: 3269 - protein, 11 aa, BK virus
CKRIGISPNSF

SEQ ID NO: 3270 - protein, 11 aa, BK virus
KRIGISPNSFA

SEQ ID NO: 3271 - protein, 11 aa, BK virus
RIGISPNSFAR

SEQ ID NO: 3272 - protein, 11 aa, BK virus
IGISPNSFARP

SEQ ID NO: 3273 - protein, 11 aa, BK virus
GISPNSFARPQ

SEQ ID NO: 3274 - protein, 11 aa, BK virus
ISPNSFARPQK

SEQ ID NO: 3275 - protein, 11 aa, BK virus
SPNSFARPQKK

SEQ ID NO: 3276 - protein, 11 aa, BK virus
PNSFARPQKKP

SEQ ID NO: 3277 - protein, 11 aa, BK virus
NSFARPQKKPP

SEQ ID NO: 3278 - protein, 11 aa, BK virus
SFARPQKKPPH

SEQ ID NO: 3279 - protein, 11 aa, BK virus
FARPQKKPPHP

SEQ ID NO: 3280 - protein, 11 aa, BK virus
ARPQKKPPHPY

SEQ ID NO: 3281 - protein, 11 aa, BK virus
RPQKKPPHPYY

SEQ ID NO: 3282 - protein, 11 aa, BK virus
PQKKPPHPYYL

SEQ ID NO: 3283 - protein, 11 aa, BK virus
QKKPPHPYYLR

SEQ ID NO: 3284 - protein, 11 aa, BK virus
KKPPHPYYLRE

SEQ ID NO: 3285 - protein, 11 aa, BK virus
KPPHPYYLRER

SEQ ID NO: 3286 - protein, 11 aa, BK virus
PPHPYYLRERV

SEQ ID NO: 3287 - protein, 11 aa, BK virus
PHPYYLRERVE

SEQ ID NO: 3288 - protein, 11 aa, BK virus
HPYYLRERVEA

SEQ ID NO: 3289 - protein, 11 aa, BK virus
PYYLRERVEAE

SEQ ID NO: 3290 - protein, 11 aa, BK virus
YYLRERVEAEA

SEQ ID NO: 3291 - protein, 11 aa, BK virus
YLRERVEAEAA

SEQ ID NO: 3292 - protein, 11 aa, BK virus
LRERVEAEAAS

SEQ ID NO: 3293 - protein, 11 aa, BK virus
RERVEAEAASA

SEQ ID NO: 3294 - protein, 11 aa, BK virus
ERVEAEAASAS

SEQ ID NO: 3295 - protein, 11 aa, BK virus
RVEAEAASASY

SEQ ID NO: 3296 - protein, 11 aa, BK virus
VEAEAASASYI

SEQ ID NO: 3297 - protein, 11 aa, BK virus
EAEAASASYIL

SEQ ID NO: 3298 - protein, 11 aa, BK virus
KKRPQGGAAYP

SEQ ID NO: 3299 - protein, 11 aa, BK virus
KRPQGGAAYPW

SEQ ID NO: 3300 - protein, 11 aa, BK virus
RPQGGAAYPWN

SEQ ID NO: 3301 - protein, 11 aa, BK virus
PQGGAAYPWNA

SEQ ID NO: 3302 - protein, 11 aa, BK virus
QGGAAYPWNAA

SEQ ID NO: 3303 - protein, 11 aa, BK virus
GGAAYPWNAAK

SEQ ID NO: 3304 - protein, 11 aa, BK virus
GAAYPWNAAKP

SEQ ID NO: 3305 - protein, 11 aa, BK virus
PQEGKCMTHRG

SEQ ID NO: 3306 - protein, 11 aa, BK virus
QEGKCMTHRGM

SEQ ID NO: 3307 - protein, 11 aa, BK virus
EGKCMTHRGMQ

SEQ ID NO: 3308 - protein, 11 aa, BK virus
GKCMTHRGMQP

SEQ ID NO: 3309 - protein, 11 aa, BK virus
KCMTHRGMQPN

SEQ ID NO: 3310 - protein, 11 aa, BK virus
CMTHRGMQPNH

SEQ ID NO: 3311 - protein, 11 aa, BK virus
MTHRGMQPNHD

SEQ ID NO: 3312 - protein, 11 aa, BK virus
THRGMQPNHDL

SEQ ID NO: 3313 - protein, 11 aa, BK virus
HRGMQPNHDLR

SEQ ID NO: 3314 - protein, 11 aa, BK virus
RGMQPNHDLRK

SEQ ID NO: 3315 - protein, 11 aa, BK virus
GMQPNHDLRKE

SEQ ID NO: 3316 - protein, 11 aa, BK virus
MQPNHDLRKES

SEQ ID NO: 3317 - protein, 11 aa, BK virus
QPNHDLRKESA

SEQ ID NO: 3318 - protein, 11 aa, BK virus
LTGRSCLPMEC

SEQ ID NO: 3319 - protein, 11 aa, BK virus
TGRSCLPMECS

SEQ ID NO: 3320 - protein, 11 aa, BK virus
GRSCLPMECSQ

SEQ ID NO: 3321 - protein, 11 aa, BK virus
RSCLPMECSQT

SEQ ID NO: 3322 - protein, 11 aa, BK virus
SCLPMECSQTM

SEQ ID NO: 3323 - protein, 11 aa, BK virus
CLPMECSQTMT

SEQ ID NO: 3324 - protein, 11 aa, BK virus
LPMECSQTMTS

SEQ ID NO: 3325 - protein, 11 aa, BK virus
PMECSQTMTSG

SEQ ID NO: 3326 - protein, 11 aa, BK virus
MECSQTMTSGR

SEQ ID NO: 3327 - protein, 11 aa, BK virus
ECSQTMTSGRK

SEQ ID NO: 3328 - protein, 11 aa, BK virus
CSQTMTSGRKV

SEQ ID NO: 3329 - protein, 11 aa, BK virus
SQTMTSGRKVH

SEQ ID NO: 3330 - protein, 11 aa, BK virus
QTMTSGRKVHD

SEQ ID NO: 3331 - protein, 11 aa, BK virus
TMTSGRKVHDR

SEQ ID NO: 3332 - protein, 11 aa, BK virus
MTSGRKVHDRH

SEQ ID NO: 3333 - protein, 11 aa, BK virus
TSGRKVHDRHV

SEQ ID NO: 3334 - protein, 11 aa, BK virus
SGRKVHDRHVL

SEQ ID NO: 3335 - protein, 11 aa, BK virus
GRKVHDRHVLR

SEQ ID NO: 3336 - protein, 11 aa, BK virus
RKVHDRHVLRA

SEQ ID NO: 3337 - protein, 11 aa, BK virus
ESWPCPQLNWT

SEQ ID NO: 3338 - protein, 11 aa, BK virus
SWPCPQLNWTK

SEQ ID NO: 3339 - protein, 11 aa, BK virus
WPCPQLNWTKA

SEQ ID NO: 3340 - protein, 11 aa, BK virus
PCPQLNWTKAM

SEQ ID NO: 3341 - protein, 11 aa, BK virus
CPQLNWTKAMV

SEQ ID NO: 3342 - protein, 11 aa, BK virus
PQLNWTKAMVL

SEQ ID NO: 3343 - protein, 11 aa, BK virus
QLNWTKAMVLR

SEQ ID NO: 3344 - protein, 11 aa, BK virus
LNWTKAMVLRQ

SEQ ID NO: 3345 - protein, 11 aa, BK virus
NWTKAMVLRQL

SEQ ID NO: 3346 - protein, 11 aa, BK virus
WTKAMVLRQLS

SEQ ID NO: 3347 - protein, 11 aa, BK virus
TKAMVLRQLSR

SEQ ID NO: 3348 - protein, 11 aa, BK virus
KAMVLRQLSRQ

SEQ ID NO: 3349 - protein, 11 aa, BK virus
AMVLRQLSRQA

SEQ ID NO: 3350 - protein, 11 aa, BK virus
MVLRQLSRQAS

SEQ ID NO: 3351 - protein, 11 aa, BK virus
VLRQLSRQASV

SEQ ID NO: 3352 - protein, 11 aa, BK virus
LRQLSRQASVK

SEQ ID NO: 3353 - protein, 11 aa, BK virus
RQLSRQASVKV

SEQ ID NO: 3354 - protein, 11 aa, BK virus
QLSRQASVKVG

SEQ ID NO: 3355 - protein, 11 aa, BK virus
LSRQASVKVGK

SEQ ID NO: 3356 - protein, 11 aa, BK virus
SRQASVKVGKT

SEQ ID NO: 3357 - protein, 11 aa, BK virus
RQASVKVGKTW

SEQ ID NO: 3358 - protein, 11 aa, BK virus
QASVKVGKTWT

SEQ ID NO: 3359 - protein, 11 aa, BK virus
ASVKVGKTWTG

SEQ ID NO: 3360 - protein, 11 aa, BK virus
SVKVGKTWTGT

SEQ ID NO: 3361 - protein, 11 aa, BK virus
VKVGKTWTGTK

SEQ ID NO: 3362 - protein, 11 aa, BK virus
KVGKTWTGTKK

SEQ ID NO: 3363 - protein, 11 aa, BK virus
VGKTWTGTKKR

SEQ ID NO: 3364 - protein, 11 aa, BK virus
GKTWTGTKKRA

SEQ ID NO: 3365 - protein, 11 aa, BK virus
KTWTGTKKRAQ

SEQ ID NO: 3366 - protein, 11 aa, BK virus
TWTGTKKRAQR

SEQ ID NO: 3367 - protein, 11 aa, BK virus
WTGTKKRAQRI

SEQ ID NO: 3368 - protein, 11 aa, BK virus
TGTKKRAQRIF

SEQ ID NO: 3369 - protein, 11 aa, BK virus
GTKKRAQRIFI

SEQ ID NO: 3370 - protein, 11 aa, BK virus
TKKRAQRIFIF

SEQ ID NO: 3371 - protein, 11 aa, BK virus
KKRAQRIFIFI

SEQ ID NO: 3372 - protein, 11 aa, BK virus
KRAQRIFIFIL

SEQ ID NO: 3373 - protein, 11 aa, BK virus
RAQRIFIFILE

SEQ ID NO: 3374 - protein, 11 aa, BK virus
AQRIFIFILEL

SEQ ID NO: 3375 - protein, 11 aa, BK virus
QRIFIFILELL

SEQ ID NO: 3376 - protein, 11 aa, BK virus
RIFIFILELLL

SEQ ID NO: 3377 - protein, 11 aa, BK virus
IFIFILELLLE

SEQ ID NO: 3378 - protein, 11 aa, BK virus
FIFILELLLEF

SEQ ID NO: 3379 - protein, 11 aa, BK virus
IFILELLLEFC

SEQ ID NO: 3380 - protein, 11 aa, BK virus
FILELLLEFCR

SEQ ID NO: 3381 - protein, 11 aa, BK virus
ILELLLEFCRG

SEQ ID NO: 3382 - protein, 11 aa, BK virus
LELLLEFCRGE

SEQ ID NO: 3383 - protein, 11 aa, BK virus
ELLLEFCRGED

SEQ ID NO: 3384 - protein, 11 aa, BK virus
LLLEFCRGEDS

SEQ ID NO: 3385 - protein, 11 aa, BK virus
LLEFCRGEDSV

SEQ ID NO: 3386 - protein, 11 aa, BK virus
LEFCRGEDSVD

SEQ ID NO: 3387 - protein, 11 aa, BK virus
EFCRGEDSVDG

SEQ ID NO: 3388 - protein, 11 aa, BK virus
FCRGEDSVDGK

SEQ ID NO: 3389 - protein, 11 aa, BK virus
CRGEDSVDGKN

SEQ ID NO: 3390 - protein, 11 aa, BK virus
RGEDSVDGKNK

SEQ ID NO: 3391 - protein, 11 aa, BK virus
GEDSVDGKNKS

SEQ ID NO: 3392 - protein, 11 aa, BK virus
EDSVDGKNKST

SEQ ID NO: 3393 - protein, 11 aa, BK virus
DSVDGKNKSTT

SEQ ID NO: 3394 - protein, 11 aa, BK virus
SVDGKNKSTTA

SEQ ID NO: 3395 - protein, 11 aa, BK virus
VDGKNKSTTAL

SEQ ID NO: 3396 - protein, 11 aa, BK virus
DGKNKSTTALP

SEQ ID NO: 3397 - protein, 11 aa, BK virus
GKNKSTTALPA

SEQ ID NO: 3398 - protein, 11 aa, BK virus
KNKSTTALPAV

SEQ ID NO: 3399 - protein, 11 aa, BK virus
NKSTTALPAVK

SEQ ID NO: 3400 - protein, 11 aa, BK virus
KSTTALPAVKD

SEQ ID NO: 3401 - protein, 11 aa, BK virus
STTALPAVKDS

SEQ ID NO: 3402 - protein, 11 aa, BK virus
TTALPAVKDSV

SEQ ID NO: 3403 - protein, 11 aa, BK virus
TALPAVKDSVK

SEQ ID NO: 3404 - protein, 11 aa, BK virus
ALPAVKDSVKD

SEQ ID NO: 3405 - protein, 11 aa, BK virus
LPAVKDSVKDS

SEQ ID NO: 3406 - protein, 11 aa, BK virus
VSNPFFFVFPG

SEQ ID NO: 3407 - protein, 11 aa, BK virus
SNPFFFVFPGS

SEQ ID NO: 3408 - protein, 11 aa, BK virus
NPFFFVFPGSW

SEQ ID NO: 3409 - protein, 11 aa, BK virus
PFFFVFPGSWV

SEQ ID NO: 3410 - protein, 11 aa, BK virus
FFFVFPGSWVL

SEQ ID NO: 3411 - protein, 11 aa, BK virus
FFVFPGSWVLL

SEQ ID NO: 3412 - protein, 11 aa, BK virus
LPVYLRLLLPQ

SEQ ID NO: 3413 - protein, 11 aa, BK virus
PVYLRLLLPQD

SEQ ID NO: 3414 - protein, 11 aa, BK virus
VYLRLLLPQDF

SEQ ID NO: 3415 - protein, 11 aa, BK virus
YLRLLLPQDFQ

SEQ ID NO: 3416 - protein, 11 aa, BK virus
LRLLLPQDFQW

SEQ ID NO: 3417 - protein, 11 aa, BK virus
RLLLPQDFQWL

SEQ ID NO: 3418 - protein, 11 aa, BK virus
LLLPQDFQWLK

SEQ ID NO: 3419 - protein, 11 aa, BK virus
LLPQDFQWLKL

SEQ ID NO: 3420 - protein, 11 aa, BK virus
LPQDFQWLKLL

SEQ ID NO: 3421 - protein, 11 aa, BK virus
PQDFQWLKLLL

SEQ ID NO: 3422 - protein, 11 aa, BK virus
QDFQWLKLLLG

SEQ ID NO: 3423 - protein, 11 aa, BK virus
DFQWLKLLLGR

SEQ ID NO: 3424 - protein, 11 aa, BK virus
FQWLKLLLGRL

SEQ ID NO: 3425 - protein, 11 aa, BK virus
QWLKLLLGRLL

SEQ ID NO: 3426 - protein, 11 aa, BK virus
WLKLLLGRLLL

SEQ ID NO: 3427 - protein, 11 aa, BK virus
LKLLLGRLLLL

SEQ ID NO: 3428 - protein, 11 aa, BK virus
LLVLLGLLLGL

SEQ ID NO: 3429 - protein, 11 aa, BK virus
LVLLGLLLGLL

SEQ ID NO: 3430 - protein, 11 aa, BK virus
VLLGLLLGLLL

SEQ ID NO: 3431 - protein, 11 aa, BK virus
GISSLMIGITK

SEQ ID NO: 3432 - protein, 11 aa, BK virus
ISSLMIGITKF

SEQ ID NO: 3433 - protein, 11 aa, BK virus
SSLMIGITKFP

SEQ ID NO: 3434 - protein, 11 aa, BK virus
SLMIGITKFPL

SEQ ID NO: 3435 - protein, 11 aa, BK virus
ASISNQAWLWN

SEQ ID NO: 3436 - protein, 11 aa, BK virus
SISNQAWLWNC

SEQ ID NO: 3437 - protein, 11 aa, BK virus
ISNQAWLWNCL

SEQ ID NO: 3438 - protein, 11 aa, BK virus
SNQAWLWNCLT

SEQ ID NO: 3439 - protein, 11 aa, BK virus
NQAWLWNCLTQ

SEQ ID NO: 3440 - protein, 11 aa, BK virus
QAWLWNCLTQM

SEQ ID NO: 3441 - protein, 11 aa, BK virus
AWLWNCLTQMS

SEQ ID NO: 3442 - protein, 11 aa, BK virus
WLWNCLTQMST

SEQ ID NO: 3443 - protein, 11 aa, BK virus
LWNCLTQMSTM

SEQ ID NO: 3444 - protein, 11 aa, BK virus
WNCLTQMSTMI

SEQ ID NO: 3445 - protein, 11 aa, BK virus
NCLTQMSTMIF

SEQ ID NO: 3446 - protein, 11 aa, BK virus
CLTQMSTMIFC

SEQ ID NO: 3447 - protein, 11 aa, BK virus
LTQMSTMIFCF

SEQ ID NO: 3448 - protein, 11 aa, BK virus
TQMSTMIFCFL

SEQ ID NO: 3449 - protein, 11 aa, BK virus
QMSTMIFCFLV

SEQ ID NO: 3450 - protein, 11 aa, BK virus
ILLLIIFNTLI

SEQ ID NO: 3451 - protein, 11 aa, BK virus
LLLIIFNTLIL

SEQ ID NO: 3452 - protein, 11 aa, BK virus
LLIIFNTLILG

SEQ ID NO: 3453 - protein, 11 aa, BK virus
LIIFNTLILGI

SEQ ID NO: 3454 - protein, 11 aa, BK virus
IIFNTLILGIG

SEQ ID NO: 3455 - protein, 11 aa, BK virus
IFNTLILGIGV

SEQ ID NO: 3456 - protein, 11 aa, BK virus
FNTLILGIGVL

SEQ ID NO: 3457 - protein, 11 aa, BK virus
NTLILGIGVLL

SEQ ID NO: 3458 - protein, 11 aa, BK virus
TLILGIGVLLC

SEQ ID NO: 3459 - protein, 11 aa, BK virus
LILGIGVLLCL

SEQ ID NO: 3460 - protein, 11 aa, BK virus
ILGIGVLLCLL

SEQ ID NO: 3461 - protein, 11 aa, BK virus
LGIGVLLCLLL

SEQ ID NO: 3462 - protein, 11 aa, BK virus
GIGVLLCLLLF

SEQ ID NO: 3463 - protein, 11 aa, BK virus
IGVLLCLLLFP

SEQ ID NO: 3464 - protein, 11 aa, BK virus
GVLLCLLLFPR

SEQ ID NO: 3465 - protein, 11 aa, BK virus
VLLCLLLFPRL

SEQ ID NO: 3466 - protein, 11 aa, BK virus
LLCLLLFPRLC

SEQ ID NO: 3467 - protein, 11 aa, BK virus
LCLLLFPRLCG

SEQ ID NO: 3468 - protein, 11 aa, BK virus
CLLLFPRLCGM

SEQ ID NO: 3469 - protein, 11 aa, BK virus
LLLFPRLCGML

SEQ ID NO: 3470 - protein, 11 aa, BK virus
LLFPRLCGMLL

SEQ ID NO: 3471 - protein, 11 aa, BK virus
LFPRLCGMLLG

SEQ ID NO: 3472 - protein, 11 aa, BK virus
FPRLCGMLLGM

SEQ ID NO: 3473 - protein, 11 aa, BK virus
PRLCGMLLGMI

SEQ ID NO: 3474 - protein, 11 aa, BK virus
RLCGMLLGMIY

SEQ ID NO: 3475 - protein, 11 aa, BK virus
LCGMLLGMIYL

SEQ ID NO: 3476 - protein, 11 aa, BK virus
CGMLLGMIYLL

SEQ ID NO: 3477 - protein, 11 aa, BK virus
PHRNCREEQKD

SEQ ID NO: 3478 - protein, 11 aa, BK virus
HRNCREEQKDF

SEQ ID NO: 3479 - protein, 11 aa, BK virus
RNCREEQKDFL

SEQ ID NO: 3480 - protein, 11 aa, BK virus
NCREEQKDFLE

SEQ ID NO: 3481 - protein, 11 aa, BK virus
CREEQKDFLET

SEQ ID NO: 3482 - protein, 11 aa, BK virus
REEQKDFLETP

SEQ ID NO: 3483 - protein, 11 aa, BK virus
EEQKDFLETPW

SEQ ID NO: 3484 - protein, 11 aa, BK virus
EQKDFLETPWL

SEQ ID NO: 3485 - protein, 11 aa, BK virus
QKDFLETPWLD

SEQ ID NO: 3486 - protein, 11 aa, BK virus
KDFLETPWLDF

SEQ ID NO: 3487 - protein, 11 aa, BK virus
DFLETPWLDFW

SEQ ID NO: 3488 - protein, 11 aa, BK virus
FLETPWLDFWR

SEQ ID NO: 3489 - protein, 11 aa, BK virus
LETPWLDFWRK

SEQ ID NO: 3490 - protein, 11 aa, BK virus
ETPWLDFWRKL

SEQ ID NO: 3491 - protein, 11 aa, BK virus
TPWLDFWRKLP

SEQ ID NO: 3492 - protein, 11 aa, BK virus
PWLDFWRKLPG

SEQ ID NO: 3493 - protein, 11 aa, BK virus
WLDFWRKLPGQ

SEQ ID NO: 3494 - protein, 11 aa, BK virus
LDFWRKLPGQL

SEQ ID NO: 3495 - protein, 11 aa, BK virus
TFIIIFNNIIL

SEQ ID NO: 3496 - protein, 11 aa, BK virus
FIIIFNNIILI

SEQ ID NO: 3497 - protein, 11 aa, BK virus
IIIFNNIILIF

SEQ ID NO: 3498 - protein, 11 aa, BK virus
IIFNNIILIFP

SEQ ID NO: 3499 - protein, 11 aa, BK virus
IFNNIILIFPL

SEQ ID NO: 3500 - protein, 11 aa, BK virus
FNNIILIFPLL

SEQ ID NO: 3501 - protein, 11 aa, BK virus
NNIILIFPLLG

SEQ ID NO: 3502 - protein, 11 aa, BK virus
NIILIFPLLGP

SEQ ID NO: 3503 - protein, 11 aa, BK virus
IILIFPLLGPQ

SEQ ID NO: 3504 - protein, 11 aa, BK virus
ILIFPLLGPQW

SEQ ID NO: 3505 - protein, 11 aa, BK virus
LIFPLLGPQWL

SEQ ID NO: 3506 - protein, 11 aa, BK virus
IFPLLGPQWLD

SEQ ID NO: 3507 - protein, 11 aa, BK virus
FPLLGPQWLDK

SEQ ID NO: 3508 - protein, 11 aa, BK virus
LKGKVPVYILA

SEQ ID NO: 3509 - protein, 11 aa, BK virus
KGKVPVYILAI

SEQ ID NO: 3510 - protein, 11 aa, BK virus
GKVPVYILAIL

SEQ ID NO: 3511 - protein, 11 aa, BK virus
KVPVYILAILI

SEQ ID NO: 3512 - protein, 11 aa, BK virus
VPVYILAILIV

SEQ ID NO: 3513 - protein, 11 aa, BK virus
EINKVYIQESL

SEQ ID NO: 3514 - protein, 11 aa, BK virus
KKLLPQEVLIK

SEQ ID NO: 3515 - protein, 11 aa, BK virus
KLLPQEVLIKE

SEQ ID NO: 3516 - protein, 11 aa, BK virus
LLPQEVLIKEL

SEQ ID NO: 3517 - protein, 11 aa, BK virus
LPQEVLIKELL

SEQ ID NO: 3518 - protein, 11 aa, BK virus
PQEVLIKELLL

SEQ ID NO: 3519 - protein, 11 aa, BK virus
QEVLIKELLLN

SEQ ID NO: 3520 - protein, 11 aa, BK virus
EVLIKELLLNG

SEQ ID NO: 3521 - protein, 11 aa, BK virus
VLIKELLLNGC

SEQ ID NO: 3522 - protein, 11 aa, BK virus
LIKELLLNGCC

SEQ ID NO: 3523 - protein, 11 aa, BK virus
IKELLLNGCCL

SEQ ID NO: 3524 - protein, 11 aa, BK virus
KELLLNGCCLY

SEQ ID NO: 3525 - protein, 11 aa, BK virus
ELLLNGCCLYF

SEQ ID NO: 3526 - protein, 11 aa, BK virus
HLLLKHMKMAP

SEQ ID NO: 3527 - protein, 11 aa, BK virus
LLLKHMKMAPT

SEQ ID NO: 3528 - protein, 11 aa, BK virus
LLKHMKMAPTK

SEQ ID NO: 3529 - protein, 11 aa, BK virus
LKHMKMAPTKR

SEQ ID NO: 3530 - protein, 11 aa, BK virus
KHMKMAPTKRK

SEQ ID NO: 3531 - protein, 11 aa, BK virus
HMKMAPTKRKG

SEQ ID NO: 3532 - protein, 11 aa, BK virus
MKMAPTKRKGE

SEQ ID NO: 3533 - protein, 11 aa, BK virus
KMAPTKRKGEC

SEQ ID NO: 3534 - protein, 11 aa, BK virus
MAPTKRKGECP

SEQ ID NO: 3535 - protein, 11 aa, BK virus
APTKRKGECPG

SEQ ID NO: 3536 - protein, 11 aa, BK virus
PTKRKGECPGA

SEQ ID NO: 3537 - protein, 11 aa, BK virus
TKRKGECPGAA

SEQ ID NO: 3538 - protein, 11 aa, BK virus
KRKGECPGAAP

SEQ ID NO: 3539 - protein, 11 aa, BK virus
RKGECPGAAPK

SEQ ID NO: 3540 - protein, 11 aa, BK virus
KGECPGAAPKK

SEQ ID NO: 3541 - protein, 11 aa, BK virus
GECPGAAPKKP

SEQ ID NO: 3542 - protein, 11 aa, BK virus
ECPGAAPKKPK

SEQ ID NO: 3543 - protein, 11 aa, BK virus
CPGAAPKKPKE

SEQ ID NO: 3544 - protein, 11 aa, BK virus
PGAAPKKPKEP

SEQ ID NO: 3545 - protein, 11 aa, BK virus
GAAPKKPKEPV

SEQ ID NO: 3546 - protein, 11 aa, BK virus
AAPKKPKEPVQ

SEQ ID NO: 3547 - protein, 11 aa, BK virus
APKKPKEPVQV

SEQ ID NO: 3548 - protein, 11 aa, BK virus
PKKPKEPVQVP

SEQ ID NO: 3549 - protein, 11 aa, BK virus
KKPKEPVQVPK

SEQ ID NO: 3550 - protein, 11 aa, BK virus
KPKEPVQVPKL

SEQ ID NO: 3551 - protein, 11 aa, BK virus
PKEPVQVPKLL

SEQ ID NO: 3552 - protein, 11 aa, BK virus
KEPVQVPKLLI

SEQ ID NO: 3553 - protein, 11 aa, BK virus
EPVQVPKLLIK

SEQ ID NO: 3554 - protein, 11 aa, BK virus
PVQVPKLLIKG

SEQ ID NO: 3555 - protein, 11 aa, BK virus
VQVPKLLIKGG

SEQ ID NO: 3556 - protein, 11 aa, BK virus
QVPKLLIKGGV

SEQ ID NO: 3557 - protein, 11 aa, BK virus
VPKLLIKGGVE

SEQ ID NO: 3558 - protein, 11 aa, BK virus
PKLLIKGGVEV

SEQ ID NO: 3559 - protein, 11 aa, BK virus
KLLIKGGVEVL

SEQ ID NO: 3560 - protein, 11 aa, BK virus
LLIKGGVEVLE

SEQ ID NO: 3561 - protein, 11 aa, BK virus
LIKGGVEVLEV

SEQ ID NO: 3562 - protein, 11 aa, BK virus
IKGGVEVLEVK

SEQ ID NO: 3563 - protein, 11 aa, BK virus
KGGVEVLEVKT

SEQ ID NO: 3564 - protein, 11 aa, BK virus
GGVEVLEVKTG

SEQ ID NO: 3565 - protein, 11 aa, BK virus
GVEVLEVKTGV

SEQ ID NO: 3566 - protein, 11 aa, BK virus
VEVLEVKTGVD

SEQ ID NO: 3567 - protein, 11 aa, BK virus
EVLEVKTGVDA

SEQ ID NO: 3568 - protein, 11 aa, BK virus
VLEVKTGVDAI

SEQ ID NO: 3569 - protein, 11 aa, BK virus
LEVKTGVDAIT

SEQ ID NO: 3570 - protein, 11 aa, BK virus
EVKTGVDAITE

SEQ ID NO: 3571 - protein, 11 aa, BK virus
VKTGVDAITEV

SEQ ID NO: 3572 - protein, 11 aa, BK virus
KTGVDAITEVE

SEQ ID NO: 3573 - protein, 11 aa, BK virus
TGVDAITEVEC

SEQ ID NO: 3574 - protein, 11 aa, BK virus
GVDAITEVECF

SEQ ID NO: 3575 - protein, 11 aa, BK virus
VDAITEVECFL

SEQ ID NO: 3576 - protein, 11 aa, BK virus
DAITEVECFLN

SEQ ID NO: 3577 - protein, 11 aa, BK virus
AITEVECFLNP

SEQ ID NO: 3578 - protein, 11 aa, BK virus
ITEVECFLNPE

SEQ ID NO: 3579 - protein, 11 aa, BK virus
TEVECFLNPEM

SEQ ID NO: 3580 - protein, 11 aa, BK virus
EVECFLNPEMG

SEQ ID NO: 3581 - protein, 11 aa, BK virus
VECFLNPEMGD

SEQ ID NO: 3582 - protein, 11 aa, BK virus
ECFLNPEMGDP

SEQ ID NO: 3583 - protein, 11 aa, BK virus
CFLNPEMGDPD

SEQ ID NO: 3584 - protein, 11 aa, BK virus
FLNPEMGDPDE

SEQ ID NO: 3585 - protein, 11 aa, BK virus
LNPEMGDPDEN

SEQ ID NO: 3586 - protein, 11 aa, BK virus
NPEMGDPDENL

SEQ ID NO: 3587 - protein, 11 aa, BK virus
PEMGDPDENLR

SEQ ID NO: 3588 - protein, 11 aa, BK virus
EMGDPDENLRG

SEQ ID NO: 3589 - protein, 11 aa, BK virus
MGDPDENLRGF

SEQ ID NO: 3590 - protein, 11 aa, BK virus
GDPDENLRGFS

SEQ ID NO: 3591 - protein, 11 aa, BK virus
DPDENLRGFSL

SEQ ID NO: 3592 - protein, 11 aa, BK virus
PDENLRGFSLK

SEQ ID NO: 3593 - protein, 11 aa, BK virus
DENLRGFSLKL

SEQ ID NO: 3594 - protein, 11 aa, BK virus
ENLRGFSLKLS

SEQ ID NO: 3595 - protein, 11 aa, BK virus
NLRGFSLKLSA

SEQ ID NO: 3596 - protein, 11 aa, BK virus
LRGFSLKLSAE

SEQ ID NO: 3597 - protein, 11 aa, BK virus
RGFSLKLSAEN

SEQ ID NO: 3598 - protein, 11 aa, BK virus
GFSLKLSAEND

SEQ ID NO: 3599 - protein, 11 aa, BK virus
FSLKLSAENDF

SEQ ID NO: 3600 - protein, 11 aa, BK virus
SLKLSAENDFS

SEQ ID NO: 3601 - protein, 11 aa, BK virus
LKLSAENDFSS

SEQ ID NO: 3602 - protein, 11 aa, BK virus
KLSAENDFSSD

SEQ ID NO: 3603 - protein, 11 aa, BK virus
LSAENDFSSDS

SEQ ID NO: 3604 - protein, 11 aa, BK virus
SAENDFSSDSP

SEQ ID NO: 3605 - protein, 11 aa, BK virus
AENDFSSDSPE

SEQ ID NO: 3606 - protein, 11 aa, BK virus
ENDFSSDSPER

SEQ ID NO: 3607 - protein, 11 aa, BK virus
NDFSSDSPERK

SEQ ID NO: 3608 - protein, 11 aa, BK virus
DFSSDSPERKM

SEQ ID NO: 3609 - protein, 11 aa, BK virus
FSSDSPERKML

SEQ ID NO: 3610 - protein, 11 aa, BK virus
SSDSPERKMLP

SEQ ID NO: 3611 - protein, 11 aa, BK virus
SDSPERKMLPC

SEQ ID NO: 3612 - protein, 11 aa, BK virus
DSPERKMLPCY

SEQ ID NO: 3613 - protein, 11 aa, BK virus
SPERKMLPCYS

SEQ ID NO: 3614 - protein, 11 aa, BK virus
PERKMLPCYST

SEQ ID NO: 3615 - protein, 11 aa, BK virus
ERKMLPCYSTA

SEQ ID NO: 3616 - protein, 11 aa, BK virus
RKMLPCYSTAR

SEQ ID NO: 3617 - protein, 11 aa, BK virus
KMLPCYSTARI

SEQ ID NO: 3618 - protein, 11 aa, BK virus
MLPCYSTARIP

SEQ ID NO: 3619 - protein, 11 aa, BK virus
LPCYSTARIPL

SEQ ID NO: 3620 - protein, 11 aa, BK virus
PCYSTARIPLP

SEQ ID NO: 3621 - protein, 11 aa, BK virus
CYSTARIPLPN

SEQ ID NO: 3622 - protein, 11 aa, BK virus
YSTARIPLPNL

SEQ ID NO: 3623 - protein, 11 aa, BK virus
STARIPLPNLN

SEQ ID NO: 3624 - protein, 11 aa, BK virus
TARIPLPNLNE

SEQ ID NO: 3625 - protein, 11 aa, BK virus
ARIPLPNLNED

SEQ ID NO: 3626 - protein, 11 aa, BK virus
RIPLPNLNEDL

SEQ ID NO: 3627 - protein, 11 aa, BK virus
IPLPNLNEDLT

SEQ ID NO: 3628 - protein, 11 aa, BK virus
PLPNLNEDLTC

SEQ ID NO: 3629 - protein, 11 aa, BK virus
LPNLNEDLTCG

SEQ ID NO: 3630 - protein, 11 aa, BK virus
PNLNEDLTCGN

SEQ ID NO: 3631 - protein, 11 aa, BK virus
NLNEDLTCGNL

SEQ ID NO: 3632 - protein, 11 aa, BK virus
LNEDLTCGNLL

SEQ ID NO: 3633 - protein, 11 aa, BK virus
NEDLTCGNLLM

SEQ ID NO: 3634 - protein, 11 aa, BK virus
EDLTCGNLLMW

SEQ ID NO: 3635 - protein, 11 aa, BK virus
DLTCGNLLMWE

SEQ ID NO: 3636 - protein, 11 aa, BK virus
LTCGNLLMWEA

SEQ ID NO: 3637 - protein, 11 aa, BK virus
TCGNLLMWEAV

SEQ ID NO: 3638 - protein, 11 aa, BK virus
CGNLLMWEAVT

SEQ ID NO: 3639 - protein, 11 aa, BK virus
GNLLMWEAVTV

SEQ ID NO: 3640 - protein, 11 aa, BK virus
NLLMWEAVTVQ

SEQ ID NO: 3641 - protein, 11 aa, BK virus
LLMWEAVTVQT

SEQ ID NO: 3642 - protein, 11 aa, BK virus
LMWEAVTVQTE

SEQ ID NO: 3643 - protein, 11 aa, BK virus
MWEAVTVQTEV

SEQ ID NO: 3644 - protein, 11 aa, BK virus
WEAVTVQTEVI

SEQ ID NO: 3645 - protein, 11 aa, BK virus
EAVTVQTEVIG

SEQ ID NO: 3646 - protein, 11 aa, BK virus
AVTVQTEVIGI

SEQ ID NO: 3647 - protein, 11 aa, BK virus
VTVQTEVIGIT

SEQ ID NO: 3648 - protein, 11 aa, BK virus
TVQTEVIGITS

SEQ ID NO: 3649 - protein, 11 aa, BK virus
VQTEVIGITSM

SEQ ID NO: 3650 - protein, 11 aa, BK virus
QTEVIGITSML

SEQ ID NO: 3651 - protein, 11 aa, BK virus
TEVIGITSMLN

SEQ ID NO: 3652 - protein, 11 aa, BK virus
EVIGITSMLNL

SEQ ID NO: 3653 - protein, 11 aa, BK virus
VIGITSMLNLH

SEQ ID NO: 3654 - protein, 11 aa, BK virus
IGITSMLNLHA

SEQ ID NO: 3655 - protein, 11 aa, BK virus
GITSMLNLHAG

SEQ ID NO: 3656 - protein, 11 aa, BK virus
ITSMLNLHAGS

SEQ ID NO: 3657 - protein, 11 aa, BK virus
TSMLNLHAGSQ

SEQ ID NO: 3658 - protein, 11 aa, BK virus
SMLNLHAGSQK

SEQ ID NO: 3659 - protein, 11 aa, BK virus
MLNLHAGSQKV

SEQ ID NO: 3660 - protein, 11 aa, BK virus
LNLHAGSQKVH

SEQ ID NO: 3661 - protein, 11 aa, BK virus
NLHAGSQKVHE

SEQ ID NO: 3662 - protein, 11 aa, BK virus
LHAGSQKVHEH

SEQ ID NO: 3663 - protein, 11 aa, BK virus
HAGSQKVHEHG

SEQ ID NO: 3664 - protein, 11 aa, BK virus
AGSQKVHEHGG

SEQ ID NO: 3665 - protein, 11 aa, BK virus
GSQKVHEHGGG

SEQ ID NO: 3666 - protein, 11 aa, BK virus
SQKVHEHGGGK

SEQ ID NO: 3667 - protein, 11 aa, BK virus
QKVHEHGGGKP

SEQ ID NO: 3668 - protein, 11 aa, BK virus
KVHEHGGGKPI

SEQ ID NO: 3669 - protein, 11 aa, BK virus
VHEHGGGKPIQ

SEQ ID NO: 3670 - protein, 11 aa, BK virus
HEHGGGKPIQG

SEQ ID NO: 3671 - protein, 11 aa, BK virus
EHGGGKPIQGS

SEQ ID NO: 3672 - protein, 11 aa, BK virus
HGGGKPIQGSN

SEQ ID NO: 3673 - protein, 11 aa, BK virus
GGGKPIQGSNF

SEQ ID NO: 3674 - protein, 11 aa, BK virus
GGKPIQGSNFH

SEQ ID NO: 3675 - protein, 11 aa, BK virus
GKPIQGSNFHF

SEQ ID NO: 3676 - protein, 11 aa, BK virus
KPIQGSNFHFF

SEQ ID NO: 3677 - protein, 11 aa, BK virus
PIQGSNFHFFA

SEQ ID NO: 3678 - protein, 11 aa, BK virus
IQGSNFHFFAV

SEQ ID NO: 3679 - protein, 11 aa, BK virus
QGSNFHFFAVG

SEQ ID NO: 3680 - protein, 11 aa, BK virus
GSNFHFFAVGG

SEQ ID NO: 3681 - protein, 11 aa, BK virus
SNFHFFAVGGE

SEQ ID NO: 3682 - protein, 11 aa, BK virus
NFHFFAVGGEP

SEQ ID NO: 3683 - protein, 11 aa, BK virus
FHFFAVGGEPL

SEQ ID NO: 3684 - protein, 11 aa, BK virus
HFFAVGGEPLE

SEQ ID NO: 3685 - protein, 11 aa, BK virus
FFAVGGEPLEM

SEQ ID NO: 3686 - protein, 11 aa, BK virus
FAVGGEPLEMQ

SEQ ID NO: 3687 - protein, 11 aa, BK virus
AVGGEPLEMQG

SEQ ID NO: 3688 - protein, 11 aa, BK virus
VGGEPLEMQGV

SEQ ID NO: 3689 - protein, 11 aa, BK virus
GGEPLEMQGVL

SEQ ID NO: 3690 - protein, 11 aa, BK virus
GEPLEMQGVLM

SEQ ID NO: 3691 - protein, 11 aa, BK virus
EPLEMQGVLMN

SEQ ID NO: 3692 - protein, 11 aa, BK virus
PLEMQGVLMNY

SEQ ID NO: 3693 - protein, 11 aa, BK virus
LEMQGVLMNYR

SEQ ID NO: 3694 - protein, 11 aa, BK virus
EMQGVLMNYRS

SEQ ID NO: 3695 - protein, 11 aa, BK virus
MQGVLMNYRSK

SEQ ID NO: 3696 - protein, 11 aa, BK virus
QGVLMNYRSKY

SEQ ID NO: 3697 - protein, 11 aa, BK virus
GVLMNYRSKYP

SEQ ID NO: 3698 - protein, 11 aa, BK virus
VLMNYRSKYPD

SEQ ID NO: 3699 - protein, 11 aa, BK virus
LMNYRSKYPDG

SEQ ID NO: 3700 - protein, 11 aa, BK virus
MNYRSKYPDGT

SEQ ID NO: 3701 - protein, 11 aa, BK virus
NYRSKYPDGTI

SEQ ID NO: 3702 - protein, 11 aa, BK virus
YRSKYPDGTIT

SEQ ID NO: 3703 - protein, 11 aa, BK virus
RSKYPDGTITP

SEQ ID NO: 3704 - protein, 11 aa, BK virus
SKYPDGTITPK

SEQ ID NO: 3705 - protein, 11 aa, BK virus
KYPDGTITPKN

SEQ ID NO: 3706 - protein, 11 aa, BK virus
YPDGTITPKNP

SEQ ID NO: 3707 - protein, 11 aa, BK virus
PDGTITPKNPT

SEQ ID NO: 3708 - protein, 11 aa, BK virus
DGTITPKNPTA

SEQ ID NO: 3709 - protein, 11 aa, BK virus
GTITPKNPTAQ

SEQ ID NO: 3710 - protein, 11 aa, BK virus
TITPKNPTAQS

SEQ ID NO: 3711 - protein, 11 aa, BK virus
ITPKNPTAQSQ

SEQ ID NO: 3712 - protein, 11 aa, BK virus
TPKNPTAQSQV

SEQ ID NO: 3713 - protein, 11 aa, BK virus
PKNPTAQSQVM

SEQ ID NO: 3714 - protein, 11 aa, BK virus
KNPTAQSQVMN

SEQ ID NO: 3715 - protein, 11 aa, BK virus
NPTAQSQVMNT

SEQ ID NO: 3716 - protein, 11 aa, BK virus
PTAQSQVMNTD

SEQ ID NO: 3717 - protein, 11 aa, BK virus
TAQSQVMNTDH

SEQ ID NO: 3718 - protein, 11 aa, BK virus
AQSQVMNTDHK

SEQ ID NO: 3719 - protein, 11 aa, BK virus
QSQVMNTDHKA

SEQ ID NO: 3720 - protein, 11 aa, BK virus
SQVMNTDHKAY

SEQ ID NO: 3721 - protein, 11 aa, BK virus
QVMNTDHKAYL

SEQ ID NO: 3722 - protein, 11 aa, BK virus
VMNTDHKAYLD

SEQ ID NO: 3723 - protein, 11 aa, BK virus
MNTDHKAYLDK

SEQ ID NO: 3724 - protein, 11 aa, BK virus
NTDHKAYLDKN

SEQ ID NO: 3725 - protein, 11 aa, BK virus
TDHKAYLDKNN

SEQ ID NO: 3726 - protein, 11 aa, BK virus
DHKAYLDKNNA

SEQ ID NO: 3727 - protein, 11 aa, BK virus
HKAYLDKNNAY

SEQ ID NO: 3728 - protein, 11 aa, BK virus
KAYLDKNNAYP

SEQ ID NO: 3729 - protein, 11 aa, BK virus
AYLDKNNAYPV

SEQ ID NO: 3730 - protein, 11 aa, BK virus
YLDKNNAYPVE

SEQ ID NO: 3731 - protein, 11 aa, BK virus
LDKNNAYPVEC

SEQ ID NO: 3732 - protein, 11 aa, BK virus
DKNNAYPVECW

SEQ ID NO: 3733 - protein, 11 aa, BK virus
KNNAYPVECWV

SEQ ID NO: 3734 - protein, 11 aa, BK virus
NNAYPVECWVP

SEQ ID NO: 3735 - protein, 11 aa, BK virus
NAYPVECWVPD

SEQ ID NO: 3736 - protein, 11 aa, BK virus
AYPVECWVPDP

SEQ ID NO: 3737 - protein, 11 aa, BK virus
YPVECWVPDPS

SEQ ID NO: 3738 - protein, 11 aa, BK virus
PVECWVPDPSR

SEQ ID NO: 3739 - protein, 11 aa, BK virus
VECWVPDPSRN

SEQ ID NO: 3740 - protein, 11 aa, BK virus
ECWVPDPSRNE

SEQ ID NO: 3741 - protein, 11 aa, BK virus
CWVPDPSRNEN

SEQ ID NO: 3742 - protein, 11 aa, BK virus
WVPDPSRNENA

SEQ ID NO: 3743 - protein, 11 aa, BK virus
VPDPSRNENAR

SEQ ID NO: 3744 - protein, 11 aa, BK virus
PDPSRNENARY

SEQ ID NO: 3745 - protein, 11 aa, BK virus
DPSRNENARYF

SEQ ID NO: 3746 - protein, 11 aa, BK virus
PSRNENARYFG

SEQ ID NO: 3747 - protein, 11 aa, BK virus
SRNENARYFGT

SEQ ID NO: 3748 - protein, 11 aa, BK virus
RNENARYFGTF

SEQ ID NO: 3749 - protein, 11 aa, BK virus
NENARYFGTFT

SEQ ID NO: 3750 - protein, 11 aa, BK virus
ENARYFGTFTG

SEQ ID NO: 3751 - protein, 11 aa, BK virus
NARYFGTFTGG

SEQ ID NO: 3752 - protein, 11 aa, BK virus
ARYFGTFTGGE

SEQ ID NO: 3753 - protein, 11 aa, BK virus
RYFGTFTGGEN

SEQ ID NO: 3754 - protein, 11 aa, BK virus
YFGTFTGGENV

SEQ ID NO: 3755 - protein, 11 aa, BK virus
FGTFTGGENVP

SEQ ID NO: 3756 - protein, 11 aa, BK virus
GTFTGGENVPP

SEQ ID NO: 3757 - protein, 11 aa, BK virus
TFTGGENVPPV

SEQ ID NO: 3758 - protein, 11 aa, BK virus
FTGGENVPPVL

SEQ ID NO: 3759 - protein, 11 aa, BK virus
TGGENVPPVLH

SEQ ID NO: 3760 - protein, 11 aa, BK virus
GGENVPPVLHV

SEQ ID NO: 3761 - protein, 11 aa, BK virus
GENVPPVLHVT

SEQ ID NO: 3762 - protein, 11 aa, BK virus
ENVPPVLHVTN

SEQ ID NO: 3763 - protein, 11 aa, BK virus
NVPPVLHVTNT

SEQ ID NO: 3764 - protein, 11 aa, BK virus
VPPVLHVTNTA

SEQ ID NO: 3765 - protein, 11 aa, BK virus
PPVLHVTNTAT

SEQ ID NO: 3766 - protein, 11 aa, BK virus
PVLHVTNTATT

SEQ ID NO: 3767 - protein, 11 aa, BK virus
VLHVTNTATTV

SEQ ID NO: 3768 - protein, 11 aa, BK virus
LHVTNTATTVL

SEQ ID NO: 3769 - protein, 11 aa, BK virus
HVTNTATTVLL

SEQ ID NO: 3770 - protein, 11 aa, BK virus
VTNTATTVLLD

SEQ ID NO: 3771 - protein, 11 aa, BK virus
TNTATTVLLDE

SEQ ID NO: 3772 - protein, 11 aa, BK virus
NTATTVLLDEQ

SEQ ID NO: 3773 - protein, 11 aa, BK virus
TATTVLLDEQG

SEQ ID NO: 3774 - protein, 11 aa, BK virus
ATTVLLDEQGV

SEQ ID NO: 3775 - protein, 11 aa, BK virus
TTVLLDEQGVG

SEQ ID NO: 3776 - protein, 11 aa, BK virus
TVLLDEQGVGP

SEQ ID NO: 3777 - protein, 11 aa, BK virus
VLLDEQGVGPL

SEQ ID NO: 3778 - protein, 11 aa, BK virus
LLDEQGVGPLC

SEQ ID NO: 3779 - protein, 11 aa, BK virus
LDEQGVGPLCK

SEQ ID NO: 3780 - protein, 11 aa, BK virus
DEQGVGPLCKA

SEQ ID NO: 3781 - protein, 11 aa, BK virus
EQGVGPLCKAD

SEQ ID NO: 3782 - protein, 11 aa, BK virus
QGVGPLCKADS

SEQ ID NO: 3783 - protein, 11 aa, BK virus
GVGPLCKADSL

SEQ ID NO: 3784 - protein, 11 aa, BK virus
VGPLCKADSLY

SEQ ID NO: 3785 - protein, 11 aa, BK virus
GPLCKADSLYV

SEQ ID NO: 3786 - protein, 11 aa, BK virus
PLCKADSLYVS

SEQ ID NO: 3787 - protein, 11 aa, BK virus
LCKADSLYVSA

SEQ ID NO: 3788 - protein, 11 aa, BK virus
CKADSLYVSAA

SEQ ID NO: 3789 - protein, 11 aa, BK virus
KADSLYVSAAD

SEQ ID NO: 3790 - protein, 11 aa, BK virus
ADSLYVSAADI

SEQ ID NO: 3791 - protein, 11 aa, BK virus
DSLYVSAADIC

SEQ ID NO: 3792 - protein, 11 aa, BK virus
SLYVSAADICG

SEQ ID NO: 3793 - protein, 11 aa, BK virus
LYVSAADICGL

SEQ ID NO: 3794 - protein, 11 aa, BK virus
YVSAADICGLF

SEQ ID NO: 3795 - protein, 11 aa, BK virus
VSAADICGLFT

SEQ ID NO: 3796 - protein, 11 aa, BK virus
SAADICGLFTN

SEQ ID NO: 3797 - protein, 11 aa, BK virus
AADICGLFTNS

SEQ ID NO: 3798 - protein, 11 aa, BK virus
ADICGLFTNSS

SEQ ID NO: 3799 - protein, 11 aa, BK virus
DICGLFTNSSG

SEQ ID NO: 3800 - protein, 11 aa, BK virus
ICGLFTNSSGT

SEQ ID NO: 3801 - protein, 11 aa, BK virus
CGLFTNSSGTQ

SEQ ID NO: 3802 - protein, 11 aa, BK virus
GLFTNSSGTQQ

SEQ ID NO: 3803 - protein, 11 aa, BK virus
LFTNSSGTQQW

SEQ ID NO: 3804 - protein, 11 aa, BK virus
FTNSSGTQQWR

SEQ ID NO: 3805 - protein, 11 aa, BK virus
TNSSGTQQWRG

SEQ ID NO: 3806 - protein, 11 aa, BK virus
NSSGTQQWRGL

SEQ ID NO: 3807 - protein, 11 aa, BK virus
SSGTQQWRGLA

SEQ ID NO: 3808 - protein, 11 aa, BK virus
SGTQQWRGLAR

SEQ ID NO: 3809 - protein, 11 aa, BK virus
GTQQWRGLARY

SEQ ID NO: 3810 - protein, 11 aa, BK virus
TQQWRGLARYF

SEQ ID NO: 3811 - protein, 11 aa, BK virus
QQWRGLARYFK

SEQ ID NO: 3812 - protein, 11 aa, BK virus
QWRGLARYFKI

SEQ ID NO: 3813 - protein, 11 aa, BK virus
WRGLARYFKIR

SEQ ID NO: 3814 - protein, 11 aa, BK virus
RGLARYFKIRL

SEQ ID NO: 3815 - protein, 11 aa, BK virus
GLARYFKIRLR

SEQ ID NO: 3816 - protein, 11 aa, BK virus
LARYFKIRLRK

SEQ ID NO: 3817 - protein, 11 aa, BK virus
ARYFKIRLRKR

SEQ ID NO: 3818 - protein, 11 aa, BK virus
RYFKIRLRKRS

SEQ ID NO: 3819 - protein, 11 aa, BK virus
YFKIRLRKRSV

SEQ ID NO: 3820 - protein, 11 aa, BK virus
FKIRLRKRSVK

SEQ ID NO: 3821 - protein, 11 aa, BK virus
KIRLRKRSVKN

SEQ ID NO: 3822 - protein, 11 aa, BK virus
IRLRKRSVKNP

SEQ ID NO: 3823 - protein, 11 aa, BK virus
RLRKRSVKNPY

SEQ ID NO: 3824 - protein, 11 aa, BK virus
LRKRSVKNPYP

SEQ ID NO: 3825 - protein, 11 aa, BK virus
RKRSVKNPYPI

SEQ ID NO: 3826 - protein, 11 aa, BK virus
KRSVKNPYPIS

SEQ ID NO: 3827 - protein, 11 aa, BK virus
RSVKNPYPISF

SEQ ID NO: 3828 - protein, 11 aa, BK virus
SVKNPYPISFL

SEQ ID NO: 3829 - protein, 11 aa, BK virus
VKNPYPISFLL

SEQ ID NO: 3830 - protein, 11 aa, BK virus
KNPYPISFLLS

SEQ ID NO: 3831 - protein, 11 aa, BK virus
NPYPISFLLSD

SEQ ID NO: 3832 - protein, 11 aa, BK virus
PYPISFLLSDL

SEQ ID NO: 3833 - protein, 11 aa, BK virus
YPISFLLSDLI

SEQ ID NO: 3834 - protein, 11 aa, BK virus
PISFLLSDLIN

SEQ ID NO: 3835 - protein, 11 aa, BK virus
ISFLLSDLINR

SEQ ID NO: 3836 - protein, 11 aa, BK virus
SFLLSDLINRR

SEQ ID NO: 3837 - protein, 11 aa, BK virus
FLLSDLINRRT

SEQ ID NO: 3838 - protein, 11 aa, BK virus
LLSDLINRRTQ

SEQ ID NO: 3839 - protein, 11 aa, BK virus
LSDLINRRTQR

SEQ ID NO: 3840 - protein, 11 aa, BK virus
SDLINRRTQRV

SEQ ID NO: 3841 - protein, 11 aa, BK virus
DLINRRTQRVD

SEQ ID NO: 3842 - protein, 11 aa, BK virus
LINRRTQRVDG

SEQ ID NO: 3843 - protein, 11 aa, BK virus
INRRTQRVDGQ

SEQ ID NO: 3844 - protein, 11 aa, BK virus
NRRTQRVDGQP

SEQ ID NO: 3845 - protein, 11 aa, BK virus
RRTQRVDGQPM

SEQ ID NO: 3846 - protein, 11 aa, BK virus
RTQRVDGQPMY

SEQ ID NO: 3847 - protein, 11 aa, BK virus
TQRVDGQPMYG

SEQ ID NO: 3848 - protein, 11 aa, BK virus
QRVDGQPMYGM

SEQ ID NO: 3849 - protein, 11 aa, BK virus
RVDGQPMYGME

SEQ ID NO: 3850 - protein, 11 aa, BK virus
VDGQPMYGMES

SEQ ID NO: 3851 - protein, 11 aa, BK virus
DGQPMYGMESQ

SEQ ID NO: 3852 - protein, 11 aa, BK virus
GQPMYGMESQV

SEQ ID NO: 3853 - protein, 11 aa, BK virus
QPMYGMESQVE

SEQ ID NO: 3854 - protein, 11 aa, BK virus
PMYGMESQVEE

SEQ ID NO: 3855 - protein, 11 aa, BK virus
MYGMESQVEEV

SEQ ID NO: 3856 - protein, 11 aa, BK virus
YGMESQVEEVR

SEQ ID NO: 3857 - protein, 11 aa, BK virus
GMESQVEEVRV

SEQ ID NO: 3858 - protein, 11 aa, BK virus
MESQVEEVRVF

SEQ ID NO: 3859 - protein, 11 aa, BK virus
ESQVEEVRVFD

SEQ ID NO: 3860 - protein, 11 aa, BK virus
SQVEEVRVFDG

SEQ ID NO: 3861 - protein, 11 aa, BK virus
QVEEVRVFDGT

SEQ ID NO: 3862 - protein, 11 aa, BK virus
VEEVRVFDGTE

SEQ ID NO: 3863 - protein, 11 aa, BK virus
EEVRVFDGTER

SEQ ID NO: 3864 - protein, 11 aa, BK virus
EVRVFDGTERL

SEQ ID NO: 3865 - protein, 11 aa, BK virus
VRVFDGTERLP

SEQ ID NO: 3866 - protein, 11 aa, BK virus
RVFDGTERLPG

SEQ ID NO: 3867 - protein, 11 aa, BK virus
VFDGTERLPGD

SEQ ID NO: 3868 - protein, 11 aa, BK virus
FDGTERLPGDP

SEQ ID NO: 3869 - protein, 11 aa, BK virus
DGTERLPGDPD

SEQ ID NO: 3870 - protein, 11 aa, BK virus
GTERLPGDPDM

SEQ ID NO: 3871 - protein, 11 aa, BK virus
TERLPGDPDMI

SEQ ID NO: 3872 - protein, 11 aa, BK virus
ERLPGDPDMIR

SEQ ID NO: 3873 - protein, 11 aa, BK virus
RLPGDPDMIRY

SEQ ID NO: 3874 - protein, 11 aa, BK virus
LPGDPDMIRYI

SEQ ID NO: 3875 - protein, 11 aa, BK virus
PGDPDMIRYID

SEQ ID NO: 3876 - protein, 11 aa, BK virus
GDPDMIRYIDK

SEQ ID NO: 3877 - protein, 11 aa, BK virus
DPDMIRYIDKQ

SEQ ID NO: 3878 - protein, 11 aa, BK virus
PDMIRYIDKQG

SEQ ID NO: 3879 - protein, 11 aa, BK virus
DMIRYIDKQGQ

SEQ ID NO: 3880 - protein, 11 aa, BK virus
MIRYIDKQGQL

SEQ ID NO: 3881 - protein, 11 aa, BK virus
IRYIDKQGQLQ

SEQ ID NO: 3882 - protein, 11 aa, BK virus
RYIDKQGQLQT

SEQ ID NO: 3883 - protein, 11 aa, BK virus
YIDKQGQLQTK

SEQ ID NO: 3884 - protein, 11 aa, BK virus
IDKQGQLQTKM

SEQ ID NO: 3885 - protein, 11 aa, BK virus
DKQGQLQTKML

SEQ ID NO: 3886 - protein, 11 aa, BK virus
TGAFIVHIHLI

SEQ ID NO: 3887 - protein, 11 aa, BK virus
GAFIVHIHLIN

SEQ ID NO: 3888 - protein, 11 aa, BK virus
AFIVHIHLINA

SEQ ID NO: 3889 - protein, 11 aa, BK virus
FIVHIHLINAA

SEQ ID NO: 3890 - protein, 11 aa, BK virus
IVHIHLINAAF

SEQ ID NO: 3891 - protein, 11 aa, BK virus
VHIHLINAAFV

SEQ ID NO: 3892 - protein, 11 aa, BK virus
ATFKLVLFWGW

SEQ ID NO: 3893 - protein, 11 aa, BK virus
TFKLVLFWGWC

SEQ ID NO: 3894 - protein, 11 aa, BK virus
FKLVLFWGWCF

SEQ ID NO: 3895 - protein, 11 aa, BK virus
KLVLFWGWCFR

SEQ ID NO: 3896 - protein, 11 aa, BK virus
LVLFWGWCFRP

SEQ ID NO: 3897 - protein, 11 aa, BK virus
VLFWGWCFRPF

SEQ ID NO: 3898 - protein, 11 aa, BK virus
LFWGWCFRPFK

SEQ ID NO: 3899 - protein, 11 aa, BK virus
FWGWCFRPFKT

SEQ ID NO: 3900 - protein, 11 aa, BK virus
WGWCFRPFKTL

SEQ ID NO: 3901 - protein, 11 aa, BK virus
GWCFRPFKTLK

SEQ ID NO: 3902 - protein, 11 aa, BK virus
WCFRPFKTLKA

SEQ ID NO: 3903 - protein, 11 aa, BK virus
CFRPFKTLKAF

SEQ ID NO: 3904 - protein, 11 aa, BK virus
FRPFKTLKAFT

SEQ ID NO: 3905 - protein, 11 aa, BK virus
RPFKTLKAFTQ

SEQ ID NO: 3906 - protein, 11 aa, BK virus
PFKTLKAFTQM

SEQ ID NO: 3907 - protein, 11 aa, BK virus
FKTLKAFTQMQ

SEQ ID NO: 3908 - protein, 11 aa, BK virus
KTLKAFTQMQL

SEQ ID NO: 3909 - protein, 11 aa, BK virus
TLKAFTQMQLL

SEQ ID NO: 3910 - protein, 11 aa, BK virus
LKAFTQMQLLT

SEQ ID NO: 3911 - protein, 11 aa, BK virus
KAFTQMQLLTM

SEQ ID NO: 3912 - protein, 11 aa, BK virus
AFTQMQLLTMG

SEQ ID NO: 3913 - protein, 11 aa, BK virus
FTQMQLLTMGV

SEQ ID NO: 3914 - protein, 11 aa, BK virus
ILFSCNIKNTF

SEQ ID NO: 3915 - protein, 11 aa, BK virus
LFSCNIKNTFP

SEQ ID NO: 3916 - protein, 11 aa, BK virus
FSCNIKNTFPH

SEQ ID NO: 3917 - protein, 11 aa, BK virus
SCNIKNTFPHA

SEQ ID NO: 3918 - protein, 11 aa, BK virus
CNIKNTFPHAY

SEQ ID NO: 3919 - protein, 11 aa, BK virus
NIKNTFPHAYI

SEQ ID NO: 3920 - protein, 11 aa, BK virus
IKNTFPHAYII

SEQ ID NO: 3921 - protein, 11 aa, BK virus
KNTFPHAYIIF

SEQ ID NO: 3922 - protein, 11 aa, BK virus
NTFPHAYIIFH

SEQ ID NO: 3923 - protein, 11 aa, BK virus
TFPHAYIIFHP

SEQ ID NO: 3924 - protein, 11 aa, BK virus
KSIHTYLRIQP

SEQ ID NO: 3925 - protein, 11 aa, BK virus
SIHTYLRIQPF

SEQ ID NO: 3926 - protein, 11 aa, BK virus
IHTYLRIQPFL

SEQ ID NO: 3927 - protein, 11 aa, BK virus
HTYLRIQPFLP

SEQ ID NO: 3928 - protein, 11 aa, BK virus
TYLRIQPFLPF

SEQ ID NO: 3929 - protein, 11 aa, BK virus
YLRIQPFLPFN

SEQ ID NO: 3930 - protein, 11 aa, BK virus
LRIQPFLPFNN

SEQ ID NO: 3931 - protein, 11 aa, BK virus
RIQPFLPFNNS

SEQ ID NO: 3932 - protein, 11 aa, BK virus
IQPFLPFNNSR

SEQ ID NO: 3933 - protein, 11 aa, BK virus
QPFLPFNNSRL

SEQ ID NO: 3934 - protein, 11 aa, BK virus
PFLPFNNSRLY

SEQ ID NO: 3935 - protein, 11 aa, BK virus
FLPFNNSRLYI

SEQ ID NO: 3936 - protein, 11 aa, BK virus
LPFNNSRLYIS

SEQ ID NO: 3937 - protein, 11 aa, BK virus
PFNNSRLYISC

SEQ ID NO: 3938 - protein, 11 aa, BK virus
FNNSRLYISCK

SEQ ID NO: 3939 - protein, 11 aa, BK virus
NNSRLYISCKI

SEQ ID NO: 3940 - protein, 11 aa, BK virus
NSRLYISCKIS

SEQ ID NO: 3941 - protein, 11 aa, BK virus
SRLYISCKISY

SEQ ID NO: 3942 - protein, 11 aa, BK virus
RLYISCKISYR

SEQ ID NO: 3943 - protein, 11 aa, BK virus
LYISCKISYRP

SEQ ID NO: 3944 - protein, 11 aa, BK virus
YISCKISYRPK

SEQ ID NO: 3945 - protein, 11 aa, BK virus
ISCKISYRPKP

SEQ ID NO: 3946 - protein, 11 aa, BK virus
SCKISYRPKPN

SEQ ID NO: 3947 - protein, 11 aa, BK virus
IYFGPKIYLSY

SEQ ID NO: 3948 - protein, 11 aa, BK virus
YFGPKIYLSYK

SEQ ID NO: 3949 - protein, 11 aa, BK virus
FGPKIYLSYKS

SEQ ID NO: 3950 - protein, 11 aa, BK virus
GPKIYLSYKSS

SEQ ID NO: 3951 - protein, 11 aa, BK virus
PKIYLSYKSSL

SEQ ID NO: 3952 - protein, 11 aa, BK virus
KIYLSYKSSLQ

SEQ ID NO: 3953 - protein, 11 aa, BK virus
IYLSYKSSLQG

SEQ ID NO: 3954 - protein, 11 aa, BK virus
YLSYKSSLQGF

SEQ ID NO: 3955 - protein, 11 aa, BK virus
LSYKSSLQGFR

SEQ ID NO: 3956 - protein, 11 aa, BK virus
SYKSSLQGFRD

SEQ ID NO: 3957 - protein, 11 aa, BK virus
YKSSLQGFRDR

SEQ ID NO: 3958 - protein, 11 aa, BK virus
KSSLQGFRDRI

SEQ ID NO: 3959 - protein, 11 aa, BK virus
SSLQGFRDRIL

SEQ ID NO: 3960 - protein, 11 aa, BK virus
SLQGFRDRILI

SEQ ID NO: 3961 - protein, 11 aa, BK virus
LQGFRDRILIH

SEQ ID NO: 3962 - protein, 11 aa, BK virus
QGFRDRILIHC

SEQ ID NO: 3963 - protein, 11 aa, BK virus
GFRDRILIHCN

SEQ ID NO: 3964 - protein, 11 aa, BK virus
FRDRILIHCNQ

SEQ ID NO: 3965 - protein, 11 aa, BK virus
RDRILIHCNQA

SEQ ID NO: 3966 - protein, 11 aa, BK virus
DRILIHCNQAW

SEQ ID NO: 3967 - protein, 11 aa, BK virus
RILIHCNQAWW

SEQ ID NO: 3968 - protein, 11 aa, BK virus
ILIHCNQAWWK

SEQ ID NO: 3969 - protein, 11 aa, BK virus
LIHCNQAWWKY

SEQ ID NO: 3970 - protein, 11 aa, BK virus
IHCNQAWWKYL

SEQ ID NO: 3971 - protein, 11 aa, BK virus
HCNQAWWKYLG

SEQ ID NO: 3972 - protein, 11 aa, BK virus
CNQAWWKYLGS

SEQ ID NO: 3973 - protein, 11 aa, BK virus
NQAWWKYLGSF

SEQ ID NO: 3974 - protein, 11 aa, BK virus
QAWWKYLGSFV

SEQ ID NO: 3975 - protein, 11 aa, BK virus
FSSCPFYIFKN

SEQ ID NO: 3976 - protein, 11 aa, BK virus
SSCPFYIFKNN

SEQ ID NO: 3977 - protein, 11 aa, BK virus
SCPFYIFKNNH

SEQ ID NO: 3978 - protein, 11 aa, BK virus
CPFYIFKNNHV

SEQ ID NO: 3979 - protein, 11 aa, BK virus
PFYIFKNNHVL

SEQ ID NO: 3980 - protein, 11 aa, BK virus
FYIFKNNHVLI

SEQ ID NO: 3981 - protein, 11 aa, BK virus
YIFKNNHVLIY

SEQ ID NO: 3982 - protein, 11 aa, BK virus
IFKNNHVLIYS

SEQ ID NO: 3983 - protein, 11 aa, BK virus
FKNNHVLIYSY

SEQ ID NO: 3984 - protein, 11 aa, BK virus
KNNHVLIYSYT

SEQ ID NO: 3985 - protein, 11 aa, BK virus
CCFSTINGTFK

SEQ ID NO: 3986 - protein, 11 aa, BK virus
PVSSFRYIENN

SEQ ID NO: 3987 - protein, 11 aa, BK virus
VSSFRYIENNT

SEQ ID NO: 3988 - protein, 11 aa, BK virus
SSFRYIENNTV

SEQ ID NO: 3989 - protein, 11 aa, BK virus
SFRYIENNTVQ

SEQ ID NO: 3990 - protein, 11 aa, BK virus
FRYIENNTVQK

SEQ ID NO: 3991 - protein, 11 aa, BK virus
RYIENNTVQKI

SEQ ID NO: 3992 - protein, 11 aa, BK virus
YIENNTVQKIK

SEQ ID NO: 3993 - protein, 11 aa, BK virus
IENNTVQKIKY

SEQ ID NO: 3994 - protein, 11 aa, BK virus
ENNTVQKIKYY

SEQ ID NO: 3995 - protein, 11 aa, BK virus
NNTVQKIKYYR

SEQ ID NO: 3996 - protein, 11 aa, BK virus
NTVQKIKYYRI

SEQ ID NO: 3997 - protein, 11 aa, BK virus
TVQKIKYYRIH

SEQ ID NO: 3998 - protein, 11 aa, BK virus
VQKIKYYRIHF

SEQ ID NO: 3999 - protein, 11 aa, BK virus
QKIKYYRIHFR

SEQ ID NO: 4000 - protein, 11 aa, BK virus
QTVQPSNTCHI

SEQ ID NO: 4001 - protein, 11 aa, BK virus
TVQPSNTCHIL

SEQ ID NO: 4002 - protein, 11 aa, BK virus
VQPSNTCHILF

SEQ ID NO: 4003 - protein, 11 aa, BK virus
HFFPGHMKGIY

SEQ ID NO: 4004 - protein, 11 aa, BK virus
FFPGHMKGIYS

SEQ ID NO: 4005 - protein, 11 aa, BK virus
FPGHMKGIYSF

SEQ ID NO: 4006 - protein, 11 aa, BK virus
PGHMKGIYSFF

SEQ ID NO: 4007 - protein, 11 aa, BK virus
GHMKGIYSFFS

SEQ ID NO: 4008 - protein, 11 aa, BK virus
NCIYCLLTNTF

SEQ ID NO: 4009 - protein, 11 aa, BK virus
CIYCLLTNTFL

SEQ ID NO: 4010 - protein, 11 aa, BK virus
IYCLLTNTFLI

SEQ ID NO: 4011 - protein, 11 aa, BK virus
YCLLTNTFLIF

SEQ ID NO: 4012 - protein, 11 aa, BK virus
CLLTNTFLIFT

SEQ ID NO: 4013 - protein, 11 aa, BK virus
LLTNTFLIFTF

SEQ ID NO: 4014 - protein, 11 aa, BK virus
LTNTFLIFTFC

SEQ ID NO: 4015 - protein, 11 aa, BK virus
TNTFLIFTFCK

SEQ ID NO: 4016 - protein, 11 aa, BK virus
NTFLIFTFCKN

SEQ ID NO: 4017 - protein, 11 aa, BK virus
TFLIFTFCKNN

SEQ ID NO: 4018 - protein, 11 aa, BK virus
FLIFTFCKNNS

SEQ ID NO: 4019 - protein, 11 aa, BK virus
LIFTFCKNNSI

SEQ ID NO: 4020 - protein, 11 aa, BK virus
IFTFCKNNSIC

SEQ ID NO: 4021 - protein, 11 aa, BK virus
FTFCKNNSICK

SEQ ID NO: 4022 - protein, 11 aa, BK virus
TFCKNNSICKV

SEQ ID NO: 4023 - protein, 11 aa, BK virus
FCKNNSICKVL

SEQ ID NO: 4024 - protein, 11 aa, BK virus
CKNNSICKVLF

SEQ ID NO: 4025 - protein, 11 aa, BK virus
KNNSICKVLFM

SEQ ID NO: 4026 - protein, 11 aa, BK virus
NNSICKVLFMI

SEQ ID NO: 4027 - protein, 11 aa, BK virus
NSICKVLFMIL

SEQ ID NO: 4028 - protein, 11 aa, BK virus
SICKVLFMILK

SEQ ID NO: 4029 - protein, 11 aa, BK virus
ICKVLFMILKV

SEQ ID NO: 4030 - protein, 11 aa, BK virus
CKVLFMILKVI

SEQ ID NO: 4031 - protein, 11 aa, BK virus
KVLFMILKVIR

SEQ ID NO: 4032 - protein, 11 aa, BK virus
VLFMILKVIRL

SEQ ID NO: 4033 - protein, 11 aa, BK virus
LFMILKVIRLV

SEQ ID NO: 4034 - protein, 11 aa, BK virus
FMILKVIRLVF

SEQ ID NO: 4035 - protein, 11 aa, BK virus
MILKVIRLVFF

SEQ ID NO: 4036 - protein, 11 aa, BK virus
ILKVIRLVFFL

SEQ ID NO: 4037 - protein, 11 aa, BK virus
LKVIRLVFFLT

SEQ ID NO: 4038 - protein, 11 aa, BK virus
KVIRLVFFLTL

SEQ ID NO: 4039 - protein, 11 aa, BK virus
VIRLVFFLTLF

SEQ ID NO: 4040 - protein, 11 aa, BK virus
IRLVFFLTLFT

SEQ ID NO: 4041 - protein, 11 aa, BK virus
RLVFFLTLFTL

SEQ ID NO: 4042 - protein, 11 aa, BK virus
LVFFLTLFTLL

SEQ ID NO: 4043 - protein, 11 aa, BK virus
VFFLTLFTLLY

SEQ ID NO: 4044 - protein, 11 aa, BK virus
FFLTLFTLLYI

SEQ ID NO: 4045 - protein, 11 aa, BK virus
FLTLFTLLYIV

SEQ ID NO: 4046 - protein, 11 aa, BK virus
LTLFTLLYIVL

SEQ ID NO: 4047 - protein, 11 aa, BK virus
TLFTLLYIVLK

SEQ ID NO: 4048 - protein, 11 aa, BK virus
LFTLLYIVLKF

SEQ ID NO: 4049 - protein, 11 aa, BK virus
KHILTLCLYCI

SEQ ID NO: 4050 - protein, 11 aa, BK virus
HILTLCLYCIL

SEQ ID NO: 4051 - protein, 11 aa, BK virus
ILTLCLYCILS

SEQ ID NO: 4052 - protein, 11 aa, BK virus
LTLCLYCILSN

SEQ ID NO: 4053 - protein, 11 aa, BK virus
FPRHLLCFFRL

SEQ ID NO: 4054 - protein, 11 aa, BK virus
PRHLLCFFRLF

SEQ ID NO: 4055 - protein, 11 aa, BK virus
RHLLCFFRLFW

SEQ ID NO: 4056 - protein, 11 aa, BK virus
HLLCFFRLFWA

SEQ ID NO: 4057 - protein, 11 aa, BK virus
LLCFFRLFWAK

SEQ ID NO: 4058 - protein, 11 aa, BK virus
LCFFRLFWAKI

SEQ ID NO: 4059 - protein, 11 aa, BK virus
CFFRLFWAKIM

SEQ ID NO: 4060 - protein, 11 aa, BK virus
FFRLFWAKIML

SEQ ID NO: 4061 - protein, 11 aa, BK virus
FRLFWAKIMLL

SEQ ID NO: 4062 - protein, 11 aa, BK virus
APLNAFFYSMV

SEQ ID NO: 4063 - protein, 11 aa, BK virus
PLNAFFYSMVW

SEQ ID NO: 4064 - protein, 11 aa, BK virus
LNAFFYSMVWI

SEQ ID NO: 4065 - protein, 11 aa, BK virus
NAFFYSMVWIS

SEQ ID NO: 4066 - protein, 11 aa, BK virus
AFFYSMVWISS

SEQ ID NO: 4067 - protein, 11 aa, BK virus
KTKGTQLLTEI

SEQ ID NO: 4068 - protein, 11 aa, BK virus
TKGTQLLTEII

SEQ ID NO: 4069 - protein, 11 aa, BK virus
KGTQLLTEIIN

SEQ ID NO: 4070 - protein, 11 aa, BK virus
GTQLLTEIINC

SEQ ID NO: 4071 - protein, 11 aa, BK virus
TQLLTEIINCR

SEQ ID NO: 4072 - protein, 11 aa, BK virus
QLLTEIINCRN

SEQ ID NO: 4073 - protein, 11 aa, BK virus
LLTEIINCRNS

SEQ ID NO: 4074 - protein, 11 aa, BK virus
LTEIINCRNSM

SEQ ID NO: 4075 - protein, 11 aa, BK virus
TEIINCRNSMS

SEQ ID NO: 4076 - protein, 11 aa, BK virus
EIINCRNSMSM

SEQ ID NO: 4077 - protein, 11 aa, BK virus
IINCRNSMSMW

SEQ ID NO: 4078 - protein, 11 aa, BK virus
INCRNSMSMWS

SEQ ID NO: 4079 - protein, 11 aa, BK virus
KEYNIMPSTHV

SEQ ID NO: 4080 - protein, 11 aa, BK virus
EYNIMPSTHVS

SEQ ID NO: 4081 - protein, 11 aa, BK virus
YNIMPSTHVST

SEQ ID NO: 4082 - protein, 11 aa, BK virus
NIMPSTHVSTN

SEQ ID NO: 4083 - protein, 11 aa, BK virus
IMPSTHVSTNK

SEQ ID NO: 4084 - protein, 11 aa, BK virus
MPSTHVSTNKS

SEQ ID NO: 4085 - protein, 11 aa, BK virus
PSTHVSTNKSY

SEQ ID NO: 4086 - protein, 11 aa, BK virus
STHVSTNKSYR

SEQ ID NO: 4087 - protein, 11 aa, BK virus
THVSTNKSYRI

SEQ ID NO: 4088 - protein, 11 aa, BK virus
HVSTNKSYRIF

SEQ ID NO: 4089 - protein, 11 aa, BK virus
VSTNKSYRIFF

SEQ ID NO: 4090 - protein, 11 aa, BK virus
STNKSYRIFFH

SEQ ID NO: 4091 - protein, 11 aa, BK virus
TNKSYRIFFHK

SEQ ID NO: 4092 - protein, 11 aa, BK virus
NKSYRIFFHKF

SEQ ID NO: 4093 - protein, 11 aa, BK virus
KSYRIFFHKFF

SEQ ID NO: 4094 - protein, 11 aa, BK virus
SYRIFFHKFFI

SEQ ID NO: 4095 - protein, 11 aa, BK virus
YRIFFHKFFIQ

SEQ ID NO: 4096 - protein, 11 aa, BK virus
RIFFHKFFIQN

SEQ ID NO: 4097 - protein, 11 aa, BK virus
IFFHKFFIQNL

SEQ ID NO: 4098 - protein, 11 aa, BK virus
FFHKFFIQNLS

SEQ ID NO: 4099 - protein, 11 aa, BK virus
FHKFFIQNLSF

SEQ ID NO: 4100 - protein, 11 aa, BK virus
HKFFIQNLSFF

SEQ ID NO: 4101 - protein, 11 aa, BK virus
KFFIQNLSFFF

SEQ ID NO: 4102 - protein, 11 aa, BK virus
FFIQNLSFFFS

SEQ ID NO: 4103 - protein, 11 aa, BK virus
FIQNLSFFFSS

SEQ ID NO: 4104 - protein, 11 aa, BK virus
IQNLSFFFSSI

SEQ ID NO: 4105 - protein, 11 aa, BK virus
QNLSFFFSSIH

SEQ ID NO: 4106 - protein, 11 aa, BK virus
NLSFFFSSIHS

SEQ ID NO: 4107 - protein, 11 aa, BK virus
LSFFFSSIHSK

SEQ ID NO: 4108 - protein, 11 aa, BK virus
SFFFSSIHSKA

SEQ ID NO: 4109 - protein, 11 aa, BK virus
FFFSSIHSKAG

SEQ ID NO: 4110 - protein, 11 aa, BK virus
FFSSIHSKAGK

SEQ ID NO: 4111 - protein, 11 aa, BK virus
FSSIHSKAGKG

SEQ ID NO: 4112 - protein, 11 aa, BK virus
SSIHSKAGKGS

SEQ ID NO: 4113 - protein, 11 aa, BK virus
SIHSKAGKGSI

SEQ ID NO: 4114 - protein, 11 aa, BK virus
IHSKAGKGSIT

SEQ ID NO: 4115 - protein, 11 aa, BK virus
HSKAGKGSITK

SEQ ID NO: 4116 - protein, 11 aa, BK virus
SKAGKGSITKY

SEQ ID NO: 4117 - protein, 11 aa, BK virus
KAGKGSITKYS

SEQ ID NO: 4118 - protein, 11 aa, BK virus
AGKGSITKYSL

SEQ ID NO: 4119 - protein, 11 aa, BK virus
GKGSITKYSLT

SEQ ID NO: 4120 - protein, 11 aa, BK virus
KGSITKYSLTK

SEQ ID NO: 4121 - protein, 11 aa, BK virus
GSITKYSLTKK

SEQ ID NO: 4122 - protein, 11 aa, BK virus
SITKYSLTKKL

SEQ ID NO: 4123 - protein, 11 aa, BK virus
ITKYSLTKKLV

SEQ ID NO: 4124 - protein, 11 aa, BK virus
IRGKVFRVFYL

SEQ ID NO: 4125 - protein, 11 aa, BK virus
RGKVFRVFYLS

SEQ ID NO: 4126 - protein, 11 aa, BK virus
GKVFRVFYLSF

SEQ ID NO: 4127 - protein, 11 aa, BK virus
KVFRVFYLSFF

SEQ ID NO: 4128 - protein, 11 aa, BK virus
VFRVFYLSFFF

SEQ ID NO: 4129 - protein, 11 aa, BK virus
FRVFYLSFFFG

SEQ ID NO: 4130 - protein, 11 aa, BK virus
RVFYLSFFFGW

SEQ ID NO: 4131 - protein, 11 aa, BK virus
VFYLSFFFGWC

SEQ ID NO: 4132 - protein, 11 aa, BK virus
VLRICCCFFIT

SEQ ID NO: 4133 - protein, 11 aa, BK virus
LRICCCFFITG

SEQ ID NO: 4134 - protein, 11 aa, BK virus
RICCCFFITGK

SEQ ID NO: 4135 - protein, 11 aa, BK virus
ICCCFFITGKH

SEQ ID NO: 4136 - protein, 11 aa, BK virus
CCCFFITGKHI

SEQ ID NO: 4137 - protein, 11 aa, BK virus
CCFFITGKHIF

SEQ ID NO: 4138 - protein, 11 aa, BK virus
CFFITGKHIFM

SEQ ID NO: 4139 - protein, 11 aa, BK virus
FFITGKHIFMA

SEQ ID NO: 4140 - protein, 11 aa, BK virus
FITGKHIFMAK

SEQ ID NO: 4141 - protein, 11 aa, BK virus
IFIPFFIKGTP

SEQ ID NO: 4142 - protein, 11 aa, BK virus
FIPFFIKGTPP

SEQ ID NO: 4143 - protein, 11 aa, BK virus
IPFFIKGTPPG

SEQ ID NO: 4144 - protein, 11 aa, BK virus
PFFIKGTPPGL

SEQ ID NO: 4145 - protein, 11 aa, BK virus
FFIKGTPPGLP

SEQ ID NO: 4146 - protein, 11 aa, BK virus
FIKGTPPGLPL

SEQ ID NO: 4147 - protein, 11 aa, BK virus
IKGTPPGLPLF

SEQ ID NO: 4148 - protein, 11 aa, BK virus
KGTPPGLPLFC

SEQ ID NO: 4149 - protein, 11 aa, BK virus
GTPPGLPLFCS

SEQ ID NO: 4150 - protein, 11 aa, BK virus
TPPGLPLFCSI

SEQ ID NO: 4151 - protein, 11 aa, BK virus
PPGLPLFCSIG

SEQ ID NO: 4152 - protein, 11 aa, BK virus
PGLPLFCSIGW

SEQ ID NO: 4153 - protein, 11 aa, BK virus
GLPLFCSIGWH

SEQ ID NO: 4154 - protein, 11 aa, BK virus
LPLFCSIGWHL

SEQ ID NO: 4155 - protein, 11 aa, BK virus
SFRSLKGVSPI

SEQ ID NO: 4156 - protein, 11 aa, BK virus
FRSLKGVSPII

SEQ ID NO: 4157 - protein, 11 aa, BK virus
RSLKGVSPIIW

SEQ ID NO: 4158 - protein, 11 aa, BK virus
SLKGVSPIIWT

SEQ ID NO: 4159 - protein, 11 aa, BK virus
LKGVSPIIWTH

SEQ ID NO: 4160 - protein, 11 aa, BK virus
KGVSPIIWTHH

SEQ ID NO: 4161 - protein, 11 aa, BK virus
GVSPIIWTHHC

SEQ ID NO: 4162 - protein, 11 aa, BK virus
VSPIIWTHHCR

SEQ ID NO: 4163 - protein, 11 aa, BK virus
SPIIWTHHCRV

SEQ ID NO: 4164 - protein, 11 aa, BK virus
PIIWTHHCRVS

SEQ ID NO: 4165 - protein, 11 aa, BK virus
IIWTHHCRVSS

SEQ ID NO: 4166 - protein, 11 aa, BK virus
IWTHHCRVSSV

SEQ ID NO: 4167 - protein, 11 aa, BK virus
WTHHCRVSSVR

SEQ ID NO: 4168 - protein, 11 aa, BK virus
THHCRVSSVRS

SEQ ID NO: 4169 - protein, 11 aa, BK virus
HHCRVSSVRSK

SEQ ID NO: 4170 - protein, 11 aa, BK virus
HCRVSSVRSKP

SEQ ID NO: 4171 - protein, 11 aa, BK virus
CRVSSVRSKPN

SEQ ID NO: 4172 - protein, 11 aa, BK virus
RVSSVRSKPNH

SEQ ID NO: 4173 - protein, 11 aa, BK virus
VSSVRSKPNHC

SEQ ID NO: 4174 - protein, 11 aa, BK virus
SSVRSKPNHCV

SEQ ID NO: 4175 - protein, 11 aa, BK virus
SVRSKPNHCVK

SEQ ID NO: 4176 - protein, 11 aa, BK virus
VRSKPNHCVKQ

SEQ ID NO: 4177 - protein, 11 aa, BK virus
RSKPNHCVKQS

SEQ ID NO: 4178 - protein, 11 aa, BK virus
SKPNHCVKQSM

SEQ ID NO: 4179 - protein, 11 aa, BK virus
KPNHCVKQSMQ

SEQ ID NO: 4180 - protein, 11 aa, BK virus
QSIQTKGSFLK

SEQ ID NO: 4181 - protein, 11 aa, BK virus
SIQTKGSFLKN

SEQ ID NO: 4182 - protein, 11 aa, BK virus
IQTKGSFLKNF

SEQ ID NO: 4183 - protein, 11 aa, BK virus
QTKGSFLKNFL

SEQ ID NO: 4184 - protein, 11 aa, BK virus
TKGSFLKNFLF

SEQ ID NO: 4185 - protein, 11 aa, BK virus
KGSFLKNFLFK

SEQ ID NO: 4186 - protein, 11 aa, BK virus
GSFLKNFLFKC

SEQ ID NO: 4187 - protein, 11 aa, BK virus
SFLKNFLFKCL

SEQ ID NO: 4188 - protein, 11 aa, BK virus
FLKNFLFKCLN

SEQ ID NO: 4189 - protein, 11 aa, BK virus
LKNFLFKCLNL

SEQ ID NO: 4190 - protein, 11 aa, BK virus
KNFLFKCLNLS

SEQ ID NO: 4191 - protein, 11 aa, BK virus
HSMQGQCTEGF

SEQ ID NO: 4192 - protein, 11 aa, BK virus
SMQGQCTEGFL

SEQ ID NO: 4193 - protein, 11 aa, BK virus
MQGQCTEGFLE

SEQ ID NO: 4194 - protein, 11 aa, BK virus
QGQCTEGFLEQ

SEQ ID NO: 4195 - protein, 11 aa, BK virus
GQCTEGFLEQI

SEQ ID NO: 4196 - protein, 11 aa, BK virus
QCTEGFLEQIG

SEQ ID NO: 4197 - protein, 11 aa, BK virus
CTEGFLEQIGH

SEQ ID NO: 4198 - protein, 11 aa, BK virus
TEGFLEQIGHS

SEQ ID NO: 4199 - protein, 11 aa, BK virus
EGFLEQIGHSL

SEQ ID NO: 4200 - protein, 11 aa, BK virus
GFLEQIGHSLQ

SEQ ID NO: 4201 - protein, 11 aa, BK virus
FLEQIGHSLQY

SEQ ID NO: 4202 - protein, 11 aa, BK virus
LEQIGHSLQYR

SEQ ID NO: 4203 - protein, 11 aa, BK virus
EQIGHSLQYRV

SEQ ID NO: 4204 - protein, 11 aa, BK virus
QIGHSLQYRVS

SEQ ID NO: 4205 - protein, 11 aa, BK virus
IGHSLQYRVSG

SEQ ID NO: 4206 - protein, 11 aa, BK virus
GHSLQYRVSGQ

SEQ ID NO: 4207 - protein, 11 aa, BK virus
HSLQYRVSGQR

SEQ ID NO: 4208 - protein, 11 aa, BK virus
SLQYRVSGQRG

SEQ ID NO: 4209 - protein, 11 aa, BK virus
LQYRVSGQRGK

SEQ ID NO: 4210 - protein, 11 aa, BK virus
QYRVSGQRGKS

SEQ ID NO: 4211 - protein, 11 aa, BK virus
YRVSGQRGKSA

SEQ ID NO: 4212 - protein, 11 aa, BK virus
RVSGQRGKSAQ

SEQ ID NO: 4213 - protein, 11 aa, BK virus
VSGQRGKSAQT

SEQ ID NO: 4214 - protein, 11 aa, BK virus
SGQRGKSAQTS

SEQ ID NO: 4215 - protein, 11 aa, BK virus
GQRGKSAQTSE

SEQ ID NO: 4216 - protein, 11 aa, BK virus
QRGKSAQTSEL

SEQ ID NO: 4217 - protein, 11 aa, BK virus
RGKSAQTSELL

SEQ ID NO: 4218 - protein, 11 aa, BK virus
GKSAQTSELLQ

SEQ ID NO: 4219 - protein, 11 aa, BK virus
KSAQTSELLQV

SEQ ID NO: 4220 - protein, 11 aa, BK virus
SAQTSELLQVP

SEQ ID NO: 4221 - protein, 11 aa, BK virus
AQTSELLQVPK

SEQ ID NO: 4222 - protein, 11 aa, BK virus
QTSELLQVPKS

SEQ ID NO: 4223 - protein, 11 aa, BK virus
TSELLQVPKSG

SEQ ID NO: 4224 - protein, 11 aa, BK virus
ATFTSCSIFLY

SEQ ID NO: 4225 - protein, 11 aa, BK virus
TFTSCSIFLYK

SEQ ID NO: 4226 - protein, 11 aa, BK virus
FTSCSIFLYKV

SEQ ID NO: 4227 - protein, 11 aa, BK virus
TSCSIFLYKVF

SEQ ID NO: 4228 - protein, 11 aa, BK virus
SCSIFLYKVFI

SEQ ID NO: 4229 - protein, 11 aa, BK virus
CSIFLYKVFIL

SEQ ID NO: 4230 - protein, 11 aa, BK virus
SIFLYKVFILF

SEQ ID NO: 4231 - protein, 11 aa, BK virus
IFLYKVFILFI

SEQ ID NO: 4232 - protein, 11 aa, BK virus
FLYKVFILFIL

SEQ ID NO: 4233 - protein, 11 aa, BK virus
LYKVFILFILS

SEQ ID NO: 4234 - protein, 11 aa, BK virus
YKVFILFILSS

SEQ ID NO: 4235 - protein, 11 aa, BK virus
KVFILFILSSS

SEQ ID NO: 4236 - protein, 11 aa, BK virus
VFILFILSSSP

SEQ ID NO: 4237 - protein, 11 aa, BK virus
FILFILSSSPP

SEQ ID NO: 4238 - protein, 11 aa, BK virus
ILFILSSSPPL

SEQ ID NO: 4239 - protein, 11 aa, BK virus
LFILSSSPPLS

SEQ ID NO: 4240 - protein, 11 aa, BK virus
FILSSSPPLSG

SEQ ID NO: 4241 - protein, 11 aa, BK virus
AFLIKGRFPQA

SEQ ID NO: 4242 - protein, 11 aa, BK virus
FLIKGRFPQAA

SEQ ID NO: 4243 - protein, 11 aa, BK virus
LIKGRFPQAAL

SEQ ID NO: 4244 - protein, 11 aa, BK virus
IKGRFPQAALS

SEQ ID NO: 4245 - protein, 11 aa, BK virus
KGRFPQAALSR

SEQ ID NO: 4246 - protein, 11 aa, BK virus
GRFPQAALSRP

SEQ ID NO: 4247 - protein, 11 aa, BK virus
RFPQAALSRPK

SEQ ID NO: 4248 - protein, 11 aa, BK virus
FPQAALSRPKR

SEQ ID NO: 4249 - protein, 11 aa, BK virus
PQAALSRPKRS

SEQ ID NO: 4250 - protein, 11 aa, BK virus
QAALSRPKRSM

SEQ ID NO: 4251 - protein, 11 aa, BK virus
AALSRPKRSMS

SEQ ID NO: 4252 - protein, 11 aa, BK virus
ALSRPKRSMSS

SEQ ID NO: 4253 - protein, 11 aa, BK virus
LSRPKRSMSSM

SEQ ID NO: 4254 - protein, 11 aa, BK virus
SRPKRSMSSMD

SEQ ID NO: 4255 - protein, 11 aa, BK virus
RPKRSMSSMDS

SEQ ID NO: 4256 - protein, 11 aa, BK virus
PKRSMSSMDSS

SEQ ID NO: 4257 - protein, 11 aa, BK virus
KRSMSSMDSSL

SEQ ID NO: 4258 - protein, 11 aa, BK virus
RSMSSMDSSLL

SEQ ID NO: 4259 - protein, 11 aa, BK virus
SMSSMDSSLLR

SEQ ID NO: 4260 - protein, 11 aa, BK virus
MSSMDSSLLRT

SEQ ID NO: 4261 - protein, 11 aa, BK virus
SSMDSSLLRTL

SEQ ID NO: 4262 - protein, 11 aa, BK virus
SMDSSLLRTLS

SEQ ID NO: 4263 - protein, 8 aa, BK virus
GFPQIVLL

SEQ ID NO: 4264 - protein, 8 aa, BK virus
FPQIVLLG

SEQ ID NO: 4265 - protein, 8 aa, BK virus
PQIVLLGL

SEQ ID NO: 4266 - protein, 8 aa, BK virus
QIVLLGLR

SEQ ID NO: 4267 - protein, 8 aa, BK virus
IVLLGLRK

SEQ ID NO: 4268 - protein, 8 aa, BK virus
VLLGLRKS

SEQ ID NO: 4269 - protein, 8 aa, BK virus
LLGLRKSL

SEQ ID NO: 4270 - protein, 8 aa, BK virus
LGLRKSLH

SEQ ID NO: 4271 - protein, 8 aa, BK virus
GLRKSLHT

SEQ ID NO: 4272 - protein, 8 aa, BK virus
LRKSLHTL

SEQ ID NO: 4273 - protein, 8 aa, BK virus
RKSLHTLT

SEQ ID NO: 4274 - protein, 8 aa, BK virus
KSLHTLTT

SEQ ID NO: 4275 - protein, 8 aa, BK virus
EKGWRQRR

SEQ ID NO: 4276 - protein, 8 aa, BK virus
KGWRQRRP

SEQ ID NO: 4277 - protein, 8 aa, BK virus
GWRQRRPR

SEQ ID NO: 4278 - protein, 8 aa, BK virus
WRQRRPRP

SEQ ID NO: 4279 - protein, 8 aa, BK virus
RQRRPRPL

SEQ ID NO: 4280 - protein, 8 aa, BK virus
QRRPRPLI

SEQ ID NO: 4281 - protein, 8 aa, BK virus
RRPRPLIY

SEQ ID NO: 4282 - protein, 8 aa, BK virus
RPRPLIYY

SEQ ID NO: 4283 - protein, 8 aa, BK virus
PRPLIYYK

SEQ ID NO: 4284 - protein, 8 aa, BK virus
RPLIYYKK

SEQ ID NO: 4285 - protein, 8 aa, BK virus
PLIYYKKK

SEQ ID NO: 4286 - protein, 8 aa, BK virus
LIYYKKKG

SEQ ID NO: 4287 - protein, 8 aa, BK virus
IYYKKKGH

SEQ ID NO: 4288 - protein, 8 aa, BK virus
YYKKKGHR

SEQ ID NO: 4289 - protein, 8 aa, BK virus
YKKKGHRE

SEQ ID NO: 4290 - protein, 8 aa, BK virus
KKKGHREE

SEQ ID NO: 4291 - protein, 8 aa, BK virus
KKGHREEL

SEQ ID NO: 4292 - protein, 8 aa, BK virus
KGHREELL

SEQ ID NO: 4293 - protein, 8 aa, BK virus
GHREELLT

SEQ ID NO: 4294 - protein, 8 aa, BK virus
HREELLTH

SEQ ID NO: 4295 - protein, 8 aa, BK virus
REELLTHG

SEQ ID NO: 4296 - protein, 8 aa, BK virus
EELLTHGM

SEQ ID NO: 4297 - protein, 8 aa, BK virus
ELLTHGMQ

SEQ ID NO: 4298 - protein, 8 aa, BK virus
LLTHGMQP

SEQ ID NO: 4299 - protein, 8 aa, BK virus
LTHGMQPN

SEQ ID NO: 4300 - protein, 8 aa, BK virus
THGMQPNH

SEQ ID NO: 4301 - protein, 8 aa, BK virus
HGMQPNHD

SEQ ID NO: 4302 - protein, 8 aa, BK virus
GMQPNHDL

SEQ ID NO: 4303 - protein, 8 aa, BK virus
MQPNHDLR

SEQ ID NO: 4304 - protein, 8 aa, BK virus
QPNHDLRK

SEQ ID NO: 4305 - protein, 8 aa, BK virus
PNHDLRKE

SEQ ID NO: 4306 - protein, 8 aa, BK virus
NHDLRKES

SEQ ID NO: 4307 - protein, 8 aa, BK virus
HDLRKESA

SEQ ID NO: 4308 - protein, 8 aa, BK virus
LTGECSQT

SEQ ID NO: 4309 - protein, 8 aa, BK virus
TGECSQTM

SEQ ID NO: 4310 - protein, 8 aa, BK virus
GECSQTMT

SEQ ID NO: 4311 - protein, 8 aa, BK virus
ECSQTMTS

SEQ ID NO: 4312 - protein, 8 aa, BK virus
CSQTMTSG

SEQ ID NO: 4313 - protein, 8 aa, BK virus
SQTMTSGR

SEQ ID NO: 4314 - protein, 8 aa, BK virus
QTMTSGRK

SEQ ID NO: 4315 - protein, 8 aa, BK virus
TMTSGRKV

SEQ ID NO: 4316 - protein, 8 aa, BK virus
MTSGRKVH

SEQ ID NO: 4317 - protein, 8 aa, BK virus
TSGRKVHD

SEQ ID NO: 4318 - protein, 8 aa, BK virus
SGRKVHDS

SEQ ID NO: 4319 - protein, 8 aa, BK virus
GRKVHDSQ

SEQ ID NO: 4320 - protein, 8 aa, BK virus
RKVHDSQG

SEQ ID NO: 4321 - protein, 8 aa, BK virus
KVHDSQGG

SEQ ID NO: 4322 - protein, 8 aa, BK virus
VHDSQGGA

SEQ ID NO: 4323 - protein, 8 aa, BK virus
HDSQGGAA

SEQ ID NO: 4324 - protein, 8 aa, BK virus
DSQGGAAY

SEQ ID NO: 4325 - protein, 8 aa, BK virus
SQGGAAYP

SEQ ID NO: 4326 - protein, 8 aa, BK virus
QGGAAYPW

SEQ ID NO: 4327 - protein, 8 aa, BK virus
GGAAYPWN

SEQ ID NO: 4328 - protein, 8 aa, BK virus
GAAYPWNA

SEQ ID NO: 4329 - protein, 8 aa, BK virus
AAYPWNAA

SEQ ID NO: 4330 - protein, 8 aa, BK virus
AYPWNAAK

SEQ ID NO: 4331 - protein, 8 aa, BK virus
YPWNAAKP

SEQ ID NO: 4332 - protein, 8 aa, BK virus
PQEGKCMT

SEQ ID NO: 4333 - protein, 8 aa, BK virus
QEGKCMTD

SEQ ID NO: 4334 - protein, 8 aa, BK virus
EGKCMTDM

SEQ ID NO: 4335 - protein, 8 aa, BK virus
GKCMTDMF

SEQ ID NO: 4336 - protein, 8 aa, BK virus
KCMTDMFC

SEQ ID NO: 4337 - protein, 8 aa, BK virus
CMTDMFCE

SEQ ID NO: 4338 - protein, 8 aa, BK virus
MTDMFCEP

SEQ ID NO: 4339 - protein, 8 aa, BK virus
TDMFCEPR

SEQ ID NO: 4340 - protein, 8 aa, BK virus
DMFCEPRN

SEQ ID NO: 4341 - protein, 8 aa, BK virus
MFCEPRNL

SEQ ID NO: 4342 - protein, 8 aa, BK virus
FCEPRNLG

SEQ ID NO: 4343 - protein, 8 aa, BK virus
CEPRNLGL

SEQ ID NO: 4344 - protein, 8 aa, BK virus
EPRNLGLV

SEQ ID NO: 4345 - protein, 8 aa, BK virus
PRNLGLVP

SEQ ID NO: 4346 - protein, 8 aa, BK virus
RNLGLVPS

SEQ ID NO: 4347 - protein, 8 aa, BK virus
TGQRPWFC

SEQ ID NO: 4348 - protein, 8 aa, BK virus
GQRPWFCA

SEQ ID NO: 4349 - protein, 8 aa, BK virus
QRPWFCAS

SEQ ID NO: 4350 - protein, 8 aa, BK virus
RPWFCASC

SEQ ID NO: 4351 - protein, 8 aa, BK virus
PWFCASCH

SEQ ID NO: 4352 - protein, 8 aa, BK virus
WFCASCHD

SEQ ID NO: 4353 - protein, 8 aa, BK virus
FCASCHDK

SEQ ID NO: 4354 - protein, 8 aa, BK virus
CASCHDKL

SEQ ID NO: 4355 - protein, 8 aa, BK virus
ASCHDKLQ

SEQ ID NO: 4356 - protein, 8 aa, BK virus
KLVKPGLE

SEQ ID NO: 4357 - protein, 8 aa, BK virus
LVKPGLEQ

SEQ ID NO: 4358 - protein, 8 aa, BK virus
VKPGLEQK

SEQ ID NO: 4359 - protein, 8 aa, BK virus
KPGLEQKK

SEQ ID NO: 4360 - protein, 8 aa, BK virus
PGLEQKKE

SEQ ID NO: 4361 - protein, 8 aa, BK virus
GLEQKKEL

SEQ ID NO: 4362 - protein, 8 aa, BK virus
LEQKKELR

SEQ ID NO: 4363 - protein, 8 aa, BK virus
EQKKELRG

SEQ ID NO: 4364 - protein, 8 aa, BK virus
QKKELRGF

SEQ ID NO: 4365 - protein, 8 aa, BK virus
KKELRGFL

SEQ ID NO: 4366 - protein, 8 aa, BK virus
KELRGFLF

SEQ ID NO: 4367 - protein, 8 aa, BK virus
ELRGFLFL

SEQ ID NO: 4368 - protein, 8 aa, BK virus
LRGFLFLF

SEQ ID NO: 4369 - protein, 8 aa, BK virus
SFCWNFVE

SEQ ID NO: 4370 - protein, 8 aa, BK virus
FCWNFVEV

SEQ ID NO: 4371 - protein, 8 aa, BK virus
CWNFVEVK

SEQ ID NO: 4372 - protein, 8 aa, BK virus
WNFVEVKT

SEQ ID NO: 4373 - protein, 8 aa, BK virus
NFVEVKTV

SEQ ID NO: 4374 - protein, 8 aa, BK virus
TGKTKVPL

SEQ ID NO: 4375 - protein, 8 aa, BK virus
GKTKVPLL

SEQ ID NO: 4376 - protein, 8 aa, BK virus
KTKVPLLY

SEQ ID NO: 4377 - protein, 8 aa, BK virus
TKVPLLYL

SEQ ID NO: 4378 - protein, 8 aa, BK virus
KVPLLYLL

SEQ ID NO: 4379 - protein, 8 aa, BK virus
VIPFFLYF

SEQ ID NO: 4380 - protein, 8 aa, BK virus
IPFFLYFQ

SEQ ID NO: 4381 - protein, 8 aa, BK virus
PFFLYFQV

SEQ ID NO: 4382 - protein, 8 aa, BK virus
FFLYFQVH

SEQ ID NO: 4383 - protein, 8 aa, BK virus
FLYFQVHG

SEQ ID NO: 4384 - protein, 8 aa, BK virus
LYFQVHGC

SEQ ID NO: 4385 - protein, 8 aa, BK virus
YFQVHGCC

SEQ ID NO: 4386 - protein, 8 aa, BK virus
FQVHGCCS

SEQ ID NO: 4387 - protein, 8 aa, BK virus
QVHGCCSS

SEQ ID NO: 4388 - protein, 8 aa, BK virus
VHGCCSST

SEQ ID NO: 4389 - protein, 8 aa, BK virus
HGCCSSTF

SEQ ID NO: 4390 - protein, 8 aa, BK virus
GCCSSTFG

SEQ ID NO: 4391 - protein, 8 aa, BK virus
CCSSTFGG

SEQ ID NO: 4392 - protein, 8 aa, BK virus
CSSTFGGP

SEQ ID NO: 4393 - protein, 8 aa, BK virus
SSTFGGPS

SEQ ID NO: 4394 - protein, 8 aa, BK virus
STFGGPSC

SEQ ID NO: 4395 - protein, 8 aa, BK virus
TFGGPSCQ

SEQ ID NO: 4396 - protein, 8 aa, BK virus
FGGPSCQC

SEQ ID NO: 4397 - protein, 8 aa, BK virus
GGPSCQCI

SEQ ID NO: 4398 - protein, 8 aa, BK virus
GCCCHRIF

SEQ ID NO: 4399 - protein, 8 aa, BK virus
CCCHRIFS

SEQ ID NO: 4400 - protein, 8 aa, BK virus
CCHRIFSG

SEQ ID NO: 4401 - protein, 8 aa, BK virus
NCCWGGCC

SEQ ID NO: 4402 - protein, 8 aa, BK virus
CCWGGCCC

SEQ ID NO: 4403 - protein, 8 aa, BK virus
CWGGCCCY

SEQ ID NO: 4404 - protein, 8 aa, BK virus
WGGCCCYR

SEQ ID NO: 4405 - protein, 8 aa, BK virus
GGCCCYRS

SEQ ID NO: 4406 - protein, 8 aa, BK virus
GCCCYRSS

SEQ ID NO: 4407 - protein, 8 aa, BK virus
CCCYRSSN

SEQ ID NO: 4408 - protein, 8 aa, BK virus
CCYRSSNC

SEQ ID NO: 4409 - protein, 8 aa, BK virus
CYRSSNCI

SEQ ID NO: 4410 - protein, 8 aa, BK virus
YRSSNCIP

SEQ ID NO: 4411 - protein, 8 aa, BK virus
RSSNCIPC

SEQ ID NO: 4412 - protein, 8 aa, BK virus
SSNCIPCY

SEQ ID NO: 4413 - protein, 8 aa, BK virus
SNCIPCYC

SEQ ID NO: 4414 - protein, 8 aa, BK virus
NCIPCYCR

SEQ ID NO: 4415 - protein, 8 aa, BK virus
CIPCYCRG

SEQ ID NO: 4416 - protein, 8 aa, BK virus
IPCYCRGH

SEQ ID NO: 4417 - protein, 8 aa, BK virus
PCYCRGHN

SEQ ID NO: 4418 - protein, 8 aa, BK virus
CYCRGHNK

SEQ ID NO: 4419 - protein, 8 aa, BK virus
YCRGHNKY

SEQ ID NO: 4420 - protein, 8 aa, BK virus
CRGHNKYL

SEQ ID NO: 4421 - protein, 8 aa, BK virus
RGHNKYLR

SEQ ID NO: 4422 - protein, 8 aa, BK virus
GHNKYLRG

SEQ ID NO: 4423 - protein, 8 aa, BK virus
HNKYLRGY

SEQ ID NO: 4424 - protein, 8 aa, BK virus
NKYLRGYS

SEQ ID NO: 4425 - protein, 8 aa, BK virus
KYLRGYSC

SEQ ID NO: 4426 - protein, 8 aa, BK virus
YLRGYSCY

SEQ ID NO: 4427 - protein, 8 aa, BK virus
LRGYSCYR

SEQ ID NO: 4428 - protein, 8 aa, BK virus
RGYSCYRP

SEQ ID NO: 4429 - protein, 8 aa, BK virus
GYSCYRPN

SEQ ID NO: 4430 - protein, 8 aa, BK virus
YSCYRPNS

SEQ ID NO: 4431 - protein, 8 aa, BK virus
SCYRPNSS

SEQ ID NO: 4432 - protein, 8 aa, BK virus
CYRPNSSN

SEQ ID NO: 4433 - protein, 8 aa, BK virus
YRPNSSNI

SEQ ID NO: 4434 - protein, 8 aa, BK virus
RPNSSNIC

SEQ ID NO: 4435 - protein, 8 aa, BK virus
PNSSNICC

SEQ ID NO: 4436 - protein, 8 aa, BK virus
NSSNICCN

SEQ ID NO: 4437 - protein, 8 aa, BK virus
SSNICCNC

SEQ ID NO: 4438 - protein, 8 aa, BK virus
SNICCNCW

SEQ ID NO: 4439 - protein, 8 aa, BK virus
NICCNCWC

SEQ ID NO: 4440 - protein, 8 aa, BK virus
ICCNCWCS

SEQ ID NO: 4441 - protein, 8 aa, BK virus
CCNCWCSW

SEQ ID NO: 4442 - protein, 8 aa, BK virus
CNCWCSWG

SEQ ID NO: 4443 - protein, 8 aa, BK virus
NCWCSWGY

SEQ ID NO: 4444 - protein, 8 aa, BK virus
CWCSWGYC

SEQ ID NO: 4445 - protein, 8 aa, BK virus
WCSWGYCW

SEQ ID NO: 4446 - protein, 8 aa, BK virus
CSWGYCWV

SEQ ID NO: 4447 - protein, 8 aa, BK virus
SWGYCWVC

SEQ ID NO: 4448 - protein, 8 aa, BK virus
WGYCWVCC

SEQ ID NO: 4449 - protein, 8 aa, BK virus
GYCWVCCF

SEQ ID NO: 4450 - protein, 8 aa, BK virus
YCWVCCFN

SEQ ID NO: 4451 - protein, 8 aa, BK virus
CWVCCFNS

SEQ ID NO: 4452 - protein, 8 aa, BK virus
WVCCFNSN

SEQ ID NO: 4453 - protein, 8 aa, BK virus
VCCFNSNC

SEQ ID NO: 4454 - protein, 8 aa, BK virus
LGSQSFHC

SEQ ID NO: 4455 - protein, 8 aa, BK virus
GSQSFHCR

SEQ ID NO: 4456 - protein, 8 aa, BK virus
SQSFHCRP

SEQ ID NO: 4457 - protein, 8 aa, BK virus
QSFHCRPL

SEQ ID NO: 4458 - protein, 8 aa, BK virus
SFHCRPLS

SEQ ID NO: 4459 - protein, 8 aa, BK virus
FHCRPLSA

SEQ ID NO: 4460 - protein, 8 aa, BK virus
HCRPLSAI

SEQ ID NO: 4461 - protein, 8 aa, BK virus
CRPLSAIR

SEQ ID NO: 4462 - protein, 8 aa, BK virus
RPLSAIRH

SEQ ID NO: 4463 - protein, 8 aa, BK virus
PLSAIRHG

SEQ ID NO: 4464 - protein, 8 aa, BK virus
LSAIRHGF

SEQ ID NO: 4465 - protein, 8 aa, BK virus
SAIRHGFG

SEQ ID NO: 4466 - protein, 8 aa, BK virus
AIRHGFGI

SEQ ID NO: 4467 - protein, 8 aa, BK virus
IRHGFGIV

SEQ ID NO: 4468 - protein, 8 aa, BK virus
YSVSWCKY

SEQ ID NO: 4469 - protein, 8 aa, BK virus
SVSWCKYF

SEQ ID NO: 4470 - protein, 8 aa, BK virus
VSWCKYFC

SEQ ID NO: 4471 - protein, 8 aa, BK virus
ALGSFFVC

SEQ ID NO: 4472 - protein, 8 aa, BK virus
LGSFFVCY

SEQ ID NO: 4473 - protein, 8 aa, BK virus
GSFFVCYY

SEQ ID NO: 4474 - protein, 8 aa, BK virus
SFFVCYYF

SEQ ID NO: 4475 - protein, 8 aa, BK virus
FFVCYYFP

SEQ ID NO: 4476 - protein, 8 aa, BK virus
FVCYYFPG

SEQ ID NO: 4477 - protein, 8 aa, BK virus
VCYYFPGF

SEQ ID NO: 4478 - protein, 8 aa, BK virus
CYYFPGFV

SEQ ID NO: 4479 - protein, 8 aa, BK virus
YYFPGFVA

SEQ ID NO: 4480 - protein, 8 aa, BK virus
YFPGFVAC

SEQ ID NO: 4481 - protein, 8 aa, BK virus
FPGFVACY

SEQ ID NO: 4482 - protein, 8 aa, BK virus
YTFYNLTG

SEQ ID NO: 4483 - protein, 8 aa, BK virus
TFYNLTGI

SEQ ID NO: 4484 - protein, 8 aa, BK virus
FYNLTGIA

SEQ ID NO: 4485 - protein, 8 aa, BK virus
YNLTGIAE

SEQ ID NO: 4486 - protein, 8 aa, BK virus
NLTGIAEK

SEQ ID NO: 4487 - protein, 8 aa, BK virus
LTGIAEKN

SEQ ID NO: 4488 - protein, 8 aa, BK virus
TGIAEKNR

SEQ ID NO: 4489 - protein, 8 aa, BK virus
GIAEKNRK

SEQ ID NO: 4490 - protein, 8 aa, BK virus
IAEKNRKI

SEQ ID NO: 4491 - protein, 8 aa, BK virus
AEKNRKIF

SEQ ID NO: 4492 - protein, 8 aa, BK virus
IFGGNYLD

SEQ ID NO: 4493 - protein, 8 aa, BK virus
FGGNYLDN

SEQ ID NO: 4494 - protein, 8 aa, BK virus
GGNYLDNC

SEQ ID NO: 4495 - protein, 8 aa, BK virus
GNYLDNCK

SEQ ID NO: 4496 - protein, 8 aa, BK virus
NYLDNCKC

SEQ ID NO: 4497 - protein, 8 aa, BK virus
YLDNCKCP

SEQ ID NO: 4498 - protein, 8 aa, BK virus
LDNCKCPY

SEQ ID NO: 4499 - protein, 8 aa, BK virus
DNCKCPYK

SEQ ID NO: 4500 - protein, 8 aa, BK virus
NCKCPYKL

SEQ ID NO: 4501 - protein, 8 aa, BK virus
CKCPYKLL

SEQ ID NO: 4502 - protein, 8 aa, BK virus
KGRYPCTF

SEQ ID NO: 4503 - protein, 8 aa, BK virus
GRYPCTFW

SEQ ID NO: 4504 - protein, 8 aa, BK virus
RYPCTFWP

SEQ ID NO: 4505 - protein, 8 aa, BK virus
YPCTFWPY

SEQ ID NO: 4506 - protein, 8 aa, BK virus
PCTFWPYL

SEQ ID NO: 4507 - protein, 8 aa, BK virus
QYRRSYTK

SEQ ID NO: 4508 - protein, 8 aa, BK virus
YRRSYTKN

SEQ ID NO: 4509 - protein, 8 aa, BK virus
RRSYTKNG

SEQ ID NO: 4510 - protein, 8 aa, BK virus
RSYTKNGL

SEQ ID NO: 4511 - protein, 8 aa, BK virus
SYTKNGLK

SEQ ID NO: 4512 - protein, 8 aa, BK virus
YTKNGLKK

SEQ ID NO: 4513 - protein, 8 aa, BK virus
TKNGLKKS

SEQ ID NO: 4514 - protein, 8 aa, BK virus
KNGLKKST

SEQ ID NO: 4515 - protein, 8 aa, BK virus
NGLKKSTK

SEQ ID NO: 4516 - protein, 8 aa, BK virus
GLKKSTKC

SEQ ID NO: 4517 - protein, 8 aa, BK virus
LKKSTKCT

SEQ ID NO: 4518 - protein, 8 aa, BK virus
KKSTKCTF

SEQ ID NO: 4519 - protein, 8 aa, BK virus
KSTKCTFR

SEQ ID NO: 4520 - protein, 8 aa, BK virus
STKCTFRR

SEQ ID NO: 4521 - protein, 8 aa, BK virus
TKCTFRRV

SEQ ID NO: 4522 - protein, 8 aa, BK virus
KCTFRRVY

SEQ ID NO: 4523 - protein, 8 aa, BK virus
CTFRRVYR

SEQ ID NO: 4524 - protein, 8 aa, BK virus
TFRRVYRK

SEQ ID NO: 4525 - protein, 8 aa, BK virus
FRRVYRKN

SEQ ID NO: 4526 - protein, 8 aa, BK virus
RRVYRKNY

SEQ ID NO: 4527 - protein, 8 aa, BK virus
RVYRKNYC

SEQ ID NO: 4528 - protein, 8 aa, BK virus
VYRKNYCP

SEQ ID NO: 4529 - protein, 8 aa, BK virus
YRKNYCPR

SEQ ID NO: 4530 - protein, 8 aa, BK virus
RKNYCPRR

SEQ ID NO: 4531 - protein, 8 aa, BK virus
KNYCPRRC

SEQ ID NO: 4532 - protein, 8 aa, BK virus
SKNCSSMD

SEQ ID NO: 4533 - protein, 8 aa, BK virus
KNCSSMDV

SEQ ID NO: 4534 - protein, 8 aa, BK virus
NCSSMDVA

SEQ ID NO: 4535 - protein, 8 aa, BK virus
CSSMDVAF

SEQ ID NO: 4536 - protein, 8 aa, BK virus
SSMDVAFT

SEQ ID NO: 4537 - protein, 8 aa, BK virus
SMDVAFTS

SEQ ID NO: 4538 - protein, 8 aa, BK virus
MDVAFTSR

SEQ ID NO: 4539 - protein, 8 aa, BK virus
DVAFTSRP

SEQ ID NO: 4540 - protein, 8 aa, BK virus
VAFTSRPV

SEQ ID NO: 4541 - protein, 8 aa, BK virus
AFTSRPVR

SEQ ID NO: 4542 - protein, 8 aa, BK virus
FTSRPVRD

SEQ ID NO: 4543 - protein, 8 aa, BK virus
TSRPVRDC

SEQ ID NO: 4544 - protein, 8 aa, BK virus
SRPVRDCN

SEQ ID NO: 4545 - protein, 8 aa, BK virus
RPVRDCNT

SEQ ID NO: 4546 - protein, 8 aa, BK virus
PVRDCNTC

SEQ ID NO: 4547 - protein, 8 aa, BK virus
VRDCNTCS

SEQ ID NO: 4548 - protein, 8 aa, BK virus
RWPQPKEK

SEQ ID NO: 4549 - protein, 8 aa, BK virus
WPQPKEKE

SEQ ID NO: 4550 - protein, 8 aa, BK virus
PQPKEKES

SEQ ID NO: 4551 - protein, 8 aa, BK virus
QPKEKESV

SEQ ID NO: 4552 - protein, 8 aa, BK virus
PKEKESVQ

SEQ ID NO: 4553 - protein, 8 aa, BK virus
KEKESVQG

SEQ ID NO: 4554 - protein, 8 aa, BK virus
EKESVQGQ

SEQ ID NO: 4555 - protein, 8 aa, BK virus
KESVQGQL

SEQ ID NO: 4556 - protein, 8 aa, BK virus
ESVQGQLP

SEQ ID NO: 4557 - protein, 8 aa, BK virus
SVQGQLPK

SEQ ID NO: 4558 - protein, 8 aa, BK virus
VQGQLPKS

SEQ ID NO: 4559 - protein, 8 aa, BK virus
QGQLPKSQ

SEQ ID NO: 4560 - protein, 8 aa, BK virus
GQLPKSQR

SEQ ID NO: 4561 - protein, 8 aa, BK virus
QLPKSQRN

SEQ ID NO: 4562 - protein, 8 aa, BK virus
LPKSQRNP

SEQ ID NO: 4563 - protein, 8 aa, BK virus
PKSQRNPC

SEQ ID NO: 4564 - protein, 8 aa, BK virus
KSQRNPCK

SEQ ID NO: 4565 - protein, 8 aa, BK virus
SQRNPCKC

SEQ ID NO: 4566 - protein, 8 aa, BK virus
QRNPCKCQ

SEQ ID NO: 4567 - protein, 8 aa, BK virus
RNPCKCQN

SEQ ID NO: 4568 - protein, 8 aa, BK virus
NPCKCQNY

SEQ ID NO: 4569 - protein, 8 aa, BK virus
TQKWGIQM

SEQ ID NO: 4570 - protein, 8 aa, BK virus
QKWGIQMK

SEQ ID NO: 4571 - protein, 8 aa, BK virus
KWGIQMKT

SEQ ID NO: 4572 - protein, 8 aa, BK virus
WGIQMKTL

SEQ ID NO: 4573 - protein, 8 aa, BK virus
GIQMKTLG

SEQ ID NO: 4574 - protein, 8 aa, BK virus
IQMKTLGA

SEQ ID NO: 4575 - protein, 8 aa, BK virus
QMKTLGAL

SEQ ID NO: 4576 - protein, 8 aa, BK virus
MKTLGALV

SEQ ID NO: 4577 - protein, 8 aa, BK virus
VLKMTLAV

SEQ ID NO: 4578 - protein, 8 aa, BK virus
LKMTLAVI

SEQ ID NO: 4579 - protein, 8 aa, BK virus
KMTLAVIA

SEQ ID NO: 4580 - protein, 8 aa, BK virus
MTLAVIAQ

SEQ ID NO: 4581 - protein, 8 aa, BK virus
TLAVIAQR

SEQ ID NO: 4582 - protein, 8 aa, BK virus
LAVIAQRE

SEQ ID NO: 4583 - protein, 8 aa, BK virus
AVIAQREK

SEQ ID NO: 4584 - protein, 8 aa, BK virus
VIAQREKC

SEQ ID NO: 4585 - protein, 8 aa, BK virus
IAQREKCF

SEQ ID NO: 4586 - protein, 8 aa, BK virus
AQREKCFP

SEQ ID NO: 4587 - protein, 8 aa, BK virus
QREKCFPV

SEQ ID NO: 4588 - protein, 8 aa, BK virus
REKCFPVT

SEQ ID NO: 4589 - protein, 8 aa, BK virus
EKCFPVTA

SEQ ID NO: 4590 - protein, 8 aa, BK virus
KCFPVTAQ

SEQ ID NO: 4591 - protein, 8 aa, BK virus
CFPVTAQQ

SEQ ID NO: 4592 - protein, 8 aa, BK virus
FPVTAQQE

SEQ ID NO: 4593 - protein, 8 aa, BK virus
PVTAQQEF

SEQ ID NO: 4594 - protein, 8 aa, BK virus
VTAQQEFP

SEQ ID NO: 4595 - protein, 8 aa, BK virus
TAQQEFPS

SEQ ID NO: 4596 - protein, 8 aa, BK virus
AQQEFPSP

SEQ ID NO: 4597 - protein, 8 aa, BK virus
QQEFPSPI

SEQ ID NO: 4598 - protein, 8 aa, BK virus
LYKQRLLE

SEQ ID NO: 4599 - protein, 8 aa, BK virus
LACLTFMQ

SEQ ID NO: 4600 - protein, 8 aa, BK virus
ACLTFMQG

SEQ ID NO: 4601 - protein, 8 aa, BK virus
CLTFMQGH

SEQ ID NO: 4602 - protein, 8 aa, BK virus
LTFMQGHK

SEQ ID NO: 4603 - protein, 8 aa, BK virus
TFMQGHKK

SEQ ID NO: 4604 - protein, 8 aa, BK virus
FMQGHKKC

SEQ ID NO: 4605 - protein, 8 aa, BK virus
MQGHKKCM

SEQ ID NO: 4606 - protein, 8 aa, BK virus
QGHKKCMS

SEQ ID NO: 4607 - protein, 8 aa, BK virus
GHKKCMSM

SEQ ID NO: 4608 - protein, 8 aa, BK virus
HKKCMSMV

SEQ ID NO: 4609 - protein, 8 aa, BK virus
KKCMSMVE

SEQ ID NO: 4610 - protein, 8 aa, BK virus
KCMSMVEE

SEQ ID NO: 4611 - protein, 8 aa, BK virus
CMSMVEEN

SEQ ID NO: 4612 - protein, 8 aa, BK virus
MSMVEENL

SEQ ID NO: 4613 - protein, 8 aa, BK virus
SMVEENLF

SEQ ID NO: 4614 - protein, 8 aa, BK virus
MVEENLFK

SEQ ID NO: 4615 - protein, 8 aa, BK virus
VEENLFKA

SEQ ID NO: 4616 - protein, 8 aa, BK virus
EENLFKAV

SEQ ID NO: 4617 - protein, 8 aa, BK virus
ENLFKAVI

SEQ ID NO: 4618 - protein, 8 aa, BK virus
NLFKAVIS

SEQ ID NO: 4619 - protein, 8 aa, BK virus
LFKAVIST

SEQ ID NO: 4620 - protein, 8 aa, BK virus
FKAVISTS

SEQ ID NO: 4621 - protein, 8 aa, BK virus
KAVISTSL

SEQ ID NO: 4622 - protein, 8 aa, BK virus
AVISTSLL

SEQ ID NO: 4623 - protein, 8 aa, BK virus
VENPWKCR

SEQ ID NO: 4624 - protein, 8 aa, BK virus
ENPWKCRE

SEQ ID NO: 4625 - protein, 8 aa, BK virus
NPWKCREC

SEQ ID NO: 4626 - protein, 8 aa, BK virus
ITGQSTLM

SEQ ID NO: 4627 - protein, 8 aa, BK virus
TGQSTLMV

SEQ ID NO: 4628 - protein, 8 aa, BK virus
GQSTLMVL

SEQ ID NO: 4629 - protein, 8 aa, BK virus
PLKTQQPS

SEQ ID NO: 4630 - protein, 8 aa, BK virus
LKTQQPSP

SEQ ID NO: 4631 - protein, 8 aa, BK virus
KTQQPSPR

SEQ ID NO: 4632 - protein, 8 aa, BK virus
ILTIRPIW

SEQ ID NO: 4633 - protein, 8 aa, BK virus
LTIRPIWT

SEQ ID NO: 4634 - protein, 8 aa, BK virus
TIRPIWTK

SEQ ID NO: 4635 - protein, 8 aa, BK virus
IRPIWTKT

SEQ ID NO: 4636 - protein, 8 aa, BK virus
RPIWTKTM

SEQ ID NO: 4637 - protein, 8 aa, BK virus
PIWTKTML

SEQ ID NO: 4638 - protein, 8 aa, BK virus
IWTKTMLI

SEQ ID NO: 4639 - protein, 8 aa, BK virus
WTKTMLIQ

SEQ ID NO: 4640 - protein, 8 aa, BK virus
TKTMLIQL

SEQ ID NO: 4641 - protein, 8 aa, BK virus
KTMLIQLS

SEQ ID NO: 4642 - protein, 8 aa, BK virus
TMLIQLSA

SEQ ID NO: 4643 - protein, 8 aa, BK virus
MLIQLSAG

SEQ ID NO: 4644 - protein, 8 aa, BK virus
LIQLSAGY

SEQ ID NO: 4645 - protein, 8 aa, BK virus
IQLSAGYL

SEQ ID NO: 4646 - protein, 8 aa, BK virus
QLSAGYLI

SEQ ID NO: 4647 - protein, 8 aa, BK virus
LSAGYLIP

SEQ ID NO: 4648 - protein, 8 aa, BK virus
SAGYLIPV

SEQ ID NO: 4649 - protein, 8 aa, BK virus
AGYLIPVE

SEQ ID NO: 4650 - protein, 8 aa, BK virus
GYLIPVEM

SEQ ID NO: 4651 - protein, 8 aa, BK virus
YLIPVEMK

SEQ ID NO: 4652 - protein, 8 aa, BK virus
LIPVEMKM

SEQ ID NO: 4653 - protein, 8 aa, BK virus
IPVEMKML

SEQ ID NO: 4654 - protein, 8 aa, BK virus
PVEMKMLG

SEQ ID NO: 4655 - protein, 8 aa, BK virus
VEMKMLGI

SEQ ID NO: 4656 - protein, 8 aa, BK virus
EMKMLGIL

SEQ ID NO: 4657 - protein, 8 aa, BK virus
MKMLGILG

SEQ ID NO: 4658 - protein, 8 aa, BK virus
KMLGILGL

SEQ ID NO: 4659 - protein, 8 aa, BK virus
MLGILGLS

SEQ ID NO: 4660 - protein, 8 aa, BK virus
LGILGLSQ

SEQ ID NO: 4661 - protein, 8 aa, BK virus
GILGLSQE

SEQ ID NO: 4662 - protein, 8 aa, BK virus
ILGLSQEG

SEQ ID NO: 4663 - protein, 8 aa, BK virus
LGLSQEGK

SEQ ID NO: 4664 - protein, 8 aa, BK virus
GLSQEGKM

SEQ ID NO: 4665 - protein, 8 aa, BK virus
LSQEGKMF

SEQ ID NO: 4666 - protein, 8 aa, BK virus
SQEGKMFP

SEQ ID NO: 4667 - protein, 8 aa, BK virus
QEGKMFPQ

SEQ ID NO: 4668 - protein, 8 aa, BK virus
EGKMFPQY

SEQ ID NO: 4669 - protein, 8 aa, BK virus
GKMFPQYF

SEQ ID NO: 4670 - protein, 8 aa, BK virus
KMFPQYFM

SEQ ID NO: 4671 - protein, 8 aa, BK virus
PTQLPQCC

SEQ ID NO: 4672 - protein, 8 aa, BK virus
MNRVWGLF

SEQ ID NO: 4673 - protein, 8 aa, BK virus
NRVWGLFV

SEQ ID NO: 4674 - protein, 8 aa, BK virus
RVWGLFVK

SEQ ID NO: 4675 - protein, 8 aa, BK virus
VWGLFVKL

SEQ ID NO: 4676 - protein, 8 aa, BK virus
WGLFVKLI

SEQ ID NO: 4677 - protein, 8 aa, BK virus
GLFVKLIA

SEQ ID NO: 4678 - protein, 8 aa, BK virus
LFVKLIAC

SEQ ID NO: 4679 - protein, 8 aa, BK virus
FVKLIACM

SEQ ID NO: 4680 - protein, 8 aa, BK virus
VKLIACMF

SEQ ID NO: 4681 - protein, 8 aa, BK virus
KLIACMFQ

SEQ ID NO: 4682 - protein, 8 aa, BK virus
LIACMFQL

SEQ ID NO: 4683 - protein, 8 aa, BK virus
IACMFQLL

SEQ ID NO: 4684 - protein, 8 aa, BK virus
ACMFQLLI

SEQ ID NO: 4685 - protein, 8 aa, BK virus
CMFQLLIF

SEQ ID NO: 4686 - protein, 8 aa, BK virus
MFQLLIFV

SEQ ID NO: 4687 - protein, 8 aa, BK virus
FQLLIFVA

SEQ ID NO: 4688 - protein, 8 aa, BK virus
QLLIFVAC

SEQ ID NO: 4689 - protein, 8 aa, BK virus
LLIFVACL

SEQ ID NO: 4690 - protein, 8 aa, BK virus
LIFVACLL

SEQ ID NO: 4691 - protein, 8 aa, BK virus
IFVACLLT

SEQ ID NO: 4692 - protein, 8 aa, BK virus
FVACLLTA

SEQ ID NO: 4693 - protein, 8 aa, BK virus
VACLLTAL

SEQ ID NO: 4694 - protein, 8 aa, BK virus
ACLLTALE

SEQ ID NO: 4695 - protein, 8 aa, BK virus
CLLTALEH

SEQ ID NO: 4696 - protein, 8 aa, BK virus
LLTALEHN

SEQ ID NO: 4697 - protein, 8 aa, BK virus
LTALEHNS

SEQ ID NO: 4698 - protein, 8 aa, BK virus
TALEHNSG

SEQ ID NO: 4699 - protein, 8 aa, BK virus
ALEHNSGE

SEQ ID NO: 4700 - protein, 8 aa, BK virus
LEHNSGEA

SEQ ID NO: 4701 - protein, 8 aa, BK virus
EHNSGEAL

SEQ ID NO: 4702 - protein, 8 aa, BK virus
HNSGEALQ

SEQ ID NO: 4703 - protein, 8 aa, BK virus
NSGEALQD

SEQ ID NO: 4704 - protein, 8 aa, BK virus
SGEALQDI

SEQ ID NO: 4705 - protein, 8 aa, BK virus
GEALQDIL

SEQ ID NO: 4706 - protein, 8 aa, BK virus
EALQDILR

SEQ ID NO: 4707 - protein, 8 aa, BK virus
ALQDILRS

SEQ ID NO: 4708 - protein, 8 aa, BK virus
LQDILRSA

SEQ ID NO: 4709 - protein, 8 aa, BK virus
RILTQFPF

SEQ ID NO: 4710 - protein, 8 aa, BK virus
ILTQFPFC

SEQ ID NO: 4711 - protein, 8 aa, BK virus
TGEPREWM

SEQ ID NO: 4712 - protein, 8 aa, BK virus
GEPREWMG

SEQ ID NO: 4713 - protein, 8 aa, BK virus
EPREWMGS

SEQ ID NO: 4714 - protein, 8 aa, BK virus
PREWMGSL

SEQ ID NO: 4715 - protein, 8 aa, BK virus
REWMGSLC

SEQ ID NO: 4716 - protein, 8 aa, BK virus
EWMGSLCM

SEQ ID NO: 4717 - protein, 8 aa, BK virus
WMGSLCMV

SEQ ID NO: 4718 - protein, 8 aa, BK virus
MGSLCMVW

SEQ ID NO: 4719 - protein, 8 aa, BK virus
GSLCMVWN

SEQ ID NO: 4720 - protein, 8 aa, BK virus
SLCMVWNP

SEQ ID NO: 4721 - protein, 8 aa, BK virus
LCMVWNPR

SEQ ID NO: 4722 - protein, 8 aa, BK virus
KRLGCLMA

SEQ ID NO: 4723 - protein, 8 aa, BK virus
RLGCLMAQ

SEQ ID NO: 4724 - protein, 8 aa, BK virus
LGCLMAQK

SEQ ID NO: 4725 - protein, 8 aa, BK virus
GCLMAQKD

SEQ ID NO: 4726 - protein, 8 aa, BK virus
CLMAQKDF

SEQ ID NO: 4727 - protein, 8 aa, BK virus
LMAQKDFQ

SEQ ID NO: 4728 - protein, 8 aa, BK virus
MAQKDFQG

SEQ ID NO: 4729 - protein, 8 aa, BK virus
AQKDFQGT

SEQ ID NO: 4730 - protein, 8 aa, BK virus
QKDFQGTQ

SEQ ID NO: 4731 - protein, 8 aa, BK virus
KDFQGTQI

SEQ ID NO: 4732 - protein, 8 aa, BK virus
DILTNRDN

SEQ ID NO: 4733 - protein, 8 aa, BK virus
ILTNRDNC

SEQ ID NO: 4734 - protein, 8 aa, BK virus
LTNRDNCK

SEQ ID NO: 4735 - protein, 8 aa, BK virus
TNRDNCKP

SEQ ID NO: 4736 - protein, 8 aa, BK virus
NRDNCKPK

SEQ ID NO: 4737 - protein, 8 aa, BK virus
RDNCKPKC

SEQ ID NO: 4738 - protein, 8 aa, BK virus
DNCKPKCF

SEQ ID NO: 4739 - protein, 8 aa, BK virus
NCKPKCFK

SEQ ID NO: 4740 - protein, 8 aa, BK virus
CKPKCFKQ

SEQ ID NO: 4741 - protein, 8 aa, BK virus
KPKCFKQV

SEQ ID NO: 4742 - protein, 8 aa, BK virus
PKCFKQVL

SEQ ID NO: 4743 - protein, 8 aa, BK virus
KCFKQVLL

SEQ ID NO: 4744 - protein, 8 aa, BK virus
CFKQVLLL

SEQ ID NO: 4745 - protein, 8 aa, BK virus
FKQVLLLY

SEQ ID NO: 4746 - protein, 8 aa, BK virus
KQVLLLYI

SEQ ID NO: 4747 - protein, 8 aa, BK virus
QVLLLYIY

SEQ ID NO: 4748 - protein, 8 aa, BK virus
VLLLYIYI

SEQ ID NO: 4749 - protein, 8 aa, BK virus
MLLLYKPL

SEQ ID NO: 4750 - protein, 8 aa, BK virus
LLLYKPLL

SEQ ID NO: 4751 - protein, 8 aa, BK virus
LLYKPLLS

SEQ ID NO: 4752 - protein, 8 aa, BK virus
LYKPLLSL

SEQ ID NO: 4753 - protein, 8 aa, BK virus
YKPLLSLC

SEQ ID NO: 4754 - protein, 8 aa, BK virus
KPLLSLCY

SEQ ID NO: 4755 - protein, 8 aa, BK virus
PLLSLCYF

SEQ ID NO: 4756 - protein, 8 aa, BK virus
LLSLCYFG

SEQ ID NO: 4757 - protein, 8 aa, BK virus
LSLCYFGG

SEQ ID NO: 4758 - protein, 8 aa, BK virus
SLCYFGGG

SEQ ID NO: 4759 - protein, 8 aa, BK virus
LCYFGGGV

SEQ ID NO: 4760 - protein, 8 aa, BK virus
CYFGGGVL

SEQ ID NO: 4761 - protein, 8 aa, BK virus
YFGGGVLG

SEQ ID NO: 4762 - protein, 8 aa, BK virus
FGGGVLGL

SEQ ID NO: 4763 - protein, 8 aa, BK virus
GGGVLGLL

SEQ ID NO: 4764 - protein, 8 aa, BK virus
GGVLGLLK

SEQ ID NO: 4765 - protein, 8 aa, BK virus
GVLGLLKH

SEQ ID NO: 4766 - protein, 8 aa, BK virus
KPLHKCNS

SEQ ID NO: 4767 - protein, 8 aa, BK virus
LWGSDLWE

SEQ ID NO: 4768 - protein, 8 aa, BK virus
WGSDLWES

SEQ ID NO: 4769 - protein, 8 aa, BK virus
GSDLWESS

SEQ ID NO: 4770 - protein, 8 aa, BK virus
SDLWESSA

SEQ ID NO: 4771 - protein, 8 aa, BK virus
DLWESSAG

SEQ ID NO: 4772 - protein, 8 aa, BK virus
LWESSAGA

SEQ ID NO: 4773 - protein, 8 aa, BK virus
WESSAGAE

SEQ ID NO: 4774 - protein, 8 aa, BK virus
ESSAGAEV

SEQ ID NO: 4775 - protein, 8 aa, BK virus
SSAGAEVS

SEQ ID NO: 4776 - protein, 8 aa, BK virus
SAGAEVSE

SEQ ID NO: 4777 - protein, 8 aa, BK virus
AGAEVSET

SEQ ID NO: 4778 - protein, 8 aa, BK virus
GAEVSETW

SEQ ID NO: 4779 - protein, 8 aa, BK virus
AEVSETWE

SEQ ID NO: 4780 - protein, 8 aa, BK virus
EVSETWEE

SEQ ID NO: 4781 - protein, 8 aa, BK virus
VSETWEEH

SEQ ID NO: 4782 - protein, 8 aa, BK virus
SETWEEHC

SEQ ID NO: 4783 - protein, 8 aa, BK virus
ETWEEHCD

SEQ ID NO: 4784 - protein, 8 aa, BK virus
TWEEHCDW

SEQ ID NO: 4785 - protein, 8 aa, BK virus
WEEHCDWD

SEQ ID NO: 4786 - protein, 8 aa, BK virus
EEHCDWDS

SEQ ID NO: 4787 - protein, 8 aa, BK virus
EHCDWDSV

SEQ ID NO: 4788 - protein, 8 aa, BK virus
HCDWDSVL

SEQ ID NO: 4789 - protein, 8 aa, BK virus
CDWDSVLD

SEQ ID NO: 4790 - protein, 8 aa, BK virus
DWDSVLDP

SEQ ID NO: 4791 - protein, 8 aa, BK virus
WDSVLDPC

SEQ ID NO: 4792 - protein, 8 aa, BK virus
DSVLDPCP

SEQ ID NO: 4793 - protein, 8 aa, BK virus
SVLDPCPE

SEQ ID NO: 4794 - protein, 8 aa, BK virus
VLDPCPES

SEQ ID NO: 4795 - protein, 8 aa, BK virus
LDPCPESS

SEQ ID NO: 4796 - protein, 8 aa, BK virus
DPCPESSV

SEQ ID NO: 4797 - protein, 8 aa, BK virus
PCPESSVS

SEQ ID NO: 4798 - protein, 8 aa, BK virus
CPESSVSE

SEQ ID NO: 4799 - protein, 8 aa, BK virus
PESSVSES

SEQ ID NO: 4800 - protein, 8 aa, BK virus
ESSVSESS

SEQ ID NO: 4801 - protein, 8 aa, BK virus
SSVSESSS

SEQ ID NO: 4802 - protein, 8 aa, BK virus
SVSESSSL

SEQ ID NO: 4803 - protein, 8 aa, BK virus
VSESSSLV

SEQ ID NO: 4804 - protein, 8 aa, BK virus
SESSSLVI

SEQ ID NO: 4805 - protein, 8 aa, BK virus
ESSSLVIS

SEQ ID NO: 4806 - protein, 8 aa, BK virus
SSSLVISR

SEQ ID NO: 4807 - protein, 8 aa, BK virus
SSLVISRI

SEQ ID NO: 4808 - protein, 8 aa, BK virus
SLVISRIH

SEQ ID NO: 4809 - protein, 8 aa, BK virus
LVISRIHF

SEQ ID NO: 4810 - protein, 8 aa, BK virus
VISRIHFP

SEQ ID NO: 4811 - protein, 8 aa, BK virus
ISRIHFPM

SEQ ID NO: 4812 - protein, 8 aa, BK virus
SRIHFPMH

SEQ ID NO: 4813 - protein, 8 aa, BK virus
RIHFPMHI

SEQ ID NO: 4814 - protein, 8 aa, BK virus
IHFPMHIL

SEQ ID NO: 4815 - protein, 8 aa, BK virus
HFPMHILY

SEQ ID NO: 4816 - protein, 8 aa, BK virus
FPMHILYF

SEQ ID NO: 4817 - protein, 8 aa, BK virus
PMHILYFI

SEQ ID NO: 4818 - protein, 8 aa, BK virus
MHILYFIL

SEQ ID NO: 4819 - protein, 8 aa, BK virus
HILYFILE

SEQ ID NO: 4820 - protein, 8 aa, BK virus
ILYFILEK

SEQ ID NO: 4821 - protein, 8 aa, BK virus
LYFILEKV

SEQ ID NO: 4822 - protein, 8 aa, BK virus
YFILEKVY

SEQ ID NO: 4823 - protein, 8 aa, BK virus
FILEKVYI

SEQ ID NO: 4824 - protein, 8 aa, BK virus
ILEKVYIL

SEQ ID NO: 4825 - protein, 8 aa, BK virus
LEKVYILI

SEQ ID NO: 4826 - protein, 8 aa, BK virus
EKVYILIS

SEQ ID NO: 4827 - protein, 8 aa, BK virus
KVYILISE

SEQ ID NO: 4828 - protein, 8 aa, BK virus
VYILISES

SEQ ID NO: 4829 - protein, 8 aa, BK virus
YILISESS

SEQ ID NO: 4830 - protein, 8 aa, BK virus
ILISESSL

SEQ ID NO: 4831 - protein, 8 aa, BK virus
LISESSLS

SEQ ID NO: 4832 - protein, 8 aa, BK virus
ISESSLSF

SEQ ID NO: 4833 - protein, 8 aa, BK virus
SESSLSFH

SEQ ID NO: 4834 - protein, 8 aa, BK virus
ESSLSFHS

SEQ ID NO: 4835 - protein, 8 aa, BK virus
SSLSFHST

SEQ ID NO: 4836 - protein, 8 aa, BK virus
SLSFHSTI

SEQ ID NO: 4837 - protein, 8 aa, BK virus
LSFHSTIL

SEQ ID NO: 4838 - protein, 8 aa, BK virus
SFHSTILD

SEQ ID NO: 4839 - protein, 8 aa, BK virus
FHSTILDC

SEQ ID NO: 4840 - protein, 8 aa, BK virus
HSTILDCI

SEQ ID NO: 4841 - protein, 8 aa, BK virus
STILDCIS

SEQ ID NO: 4842 - protein, 8 aa, BK virus
TILDCISV

SEQ ID NO: 4843 - protein, 8 aa, BK virus
ILDCISVA

SEQ ID NO: 4844 - protein, 8 aa, BK virus
LDCISVAK

SEQ ID NO: 4845 - protein, 8 aa, BK virus
DCISVAKS

SEQ ID NO: 4846 - protein, 8 aa, BK virus
CISVAKSA

SEQ ID NO: 4847 - protein, 8 aa, BK virus
ISVAKSAT

SEQ ID NO: 4848 - protein, 8 aa, BK virus
SVAKSATG

SEQ ID NO: 4849 - protein, 8 aa, BK virus
VAKSATGL

SEQ ID NO: 4850 - protein, 8 aa, BK virus
AKSATGLN

SEQ ID NO: 4851 - protein, 8 aa, BK virus
KSATGLNQ

SEQ ID NO: 4852 - protein, 8 aa, BK virus
SATGLNQI

SEQ ID NO: 4853 - protein, 8 aa, BK virus
ATGLNQIS

SEQ ID NO: 4854 - protein, 8 aa, BK virus
TGLNQISS

SEQ ID NO: 4855 - protein, 8 aa, BK virus
GLNQISSS

SEQ ID NO: 4856 - protein, 8 aa, BK virus
LNQISSSN

SEQ ID NO: 4857 - protein, 8 aa, BK virus
NQISSSNK

SEQ ID NO: 4858 - protein, 8 aa, BK virus
QISSSNKV

SEQ ID NO: 4859 - protein, 8 aa, BK virus
ISSSNKVI

SEQ ID NO: 4860 - protein, 8 aa, BK virus
SSSNKVIP

SEQ ID NO: 4861 - protein, 8 aa, BK virus
SSNKVIPL

SEQ ID NO: 4862 - protein, 8 aa, BK virus
SNKVIPLC

SEQ ID NO: 4863 - protein, 8 aa, BK virus
NKVIPLCK

SEQ ID NO: 4864 - protein, 8 aa, BK virus
KVIPLCKI

SEQ ID NO: 4865 - protein, 8 aa, BK virus
VIPLCKIL

SEQ ID NO: 4866 - protein, 8 aa, BK virus
IPLCKILF

SEQ ID NO: 4867 - protein, 8 aa, BK virus
PLCKILFS

SEQ ID NO: 4868 - protein, 8 aa, BK virus
LCKILFSS

SEQ ID NO: 4869 - protein, 8 aa, BK virus
CKILFSSK

SEQ ID NO: 4870 - protein, 8 aa, BK virus
KILFSSKN

SEQ ID NO: 4871 - protein, 8 aa, BK virus
ILFSSKNS

SEQ ID NO: 4872 - protein, 8 aa, BK virus
LFSSKNSE

SEQ ID NO: 4873 - protein, 8 aa, BK virus
FSSKNSEF

SEQ ID NO: 4874 - protein, 8 aa, BK virus
SSKNSEFC

SEQ ID NO: 4875 - protein, 8 aa, BK virus
SKNSEFCK

SEQ ID NO: 4876 - protein, 8 aa, BK virus
KNSEFCKD

SEQ ID NO: 4877 - protein, 8 aa, BK virus
NSEFCKDF

SEQ ID NO: 4878 - protein, 8 aa, BK virus
SEFCKDFL

SEQ ID NO: 4879 - protein, 8 aa, BK virus
EFCKDFLK

SEQ ID NO: 4880 - protein, 8 aa, BK virus
FCKDFLKY

SEQ ID NO: 4881 - protein, 8 aa, BK virus
CKDFLKYI

SEQ ID NO: 4882 - protein, 8 aa, BK virus
KDFLKYIL

SEQ ID NO: 4883 - protein, 8 aa, BK virus
DFLKYILG

SEQ ID NO: 4884 - protein, 8 aa, BK virus
FLKYILGL

SEQ ID NO: 4885 - protein, 8 aa, BK virus
LKYILGLK

SEQ ID NO: 4886 - protein, 8 aa, BK virus
KYILGLKS

SEQ ID NO: 4887 - protein, 8 aa, BK virus
YILGLKSI

SEQ ID NO: 4888 - protein, 8 aa, BK virus
ILGLKSIC

SEQ ID NO: 4889 - protein, 8 aa, BK virus
LGLKSICL

SEQ ID NO: 4890 - protein, 8 aa, BK virus
GLKSICLT

SEQ ID NO: 4891 - protein, 8 aa, BK virus
LKSICLTN

SEQ ID NO: 4892 - protein, 8 aa, BK virus
KSICLTNL

SEQ ID NO: 4893 - protein, 8 aa, BK virus
SICLTNLA

SEQ ID NO: 4894 - protein, 8 aa, BK virus
ICLTNLAC

SEQ ID NO: 4895 - protein, 8 aa, BK virus
CLTNLACR

SEQ ID NO: 4896 - protein, 8 aa, BK virus
LTNLACRV

SEQ ID NO: 4897 - protein, 8 aa, BK virus
TNLACRVL

SEQ ID NO: 4898 - protein, 8 aa, BK virus
NLACRVLG

SEQ ID NO: 4899 - protein, 8 aa, BK virus
LACRVLGT

SEQ ID NO: 4900 - protein, 8 aa, BK virus
ACRVLGTG

SEQ ID NO: 4901 - protein, 8 aa, BK virus
CRVLGTGY

SEQ ID NO: 4902 - protein, 8 aa, BK virus
RVLGTGYS

SEQ ID NO: 4903 - protein, 8 aa, BK virus
VLGTGYSF

SEQ ID NO: 4904 - protein, 8 aa, BK virus
LGTGYSFI

SEQ ID NO: 4905 - protein, 8 aa, BK virus
GTGYSFIV

SEQ ID NO: 4906 - protein, 8 aa, BK virus
TGYSFIVT

SEQ ID NO: 4907 - protein, 8 aa, BK virus
GYSFIVTK

SEQ ID NO: 4908 - protein, 8 aa, BK virus
YSFIVTKP

SEQ ID NO: 4909 - protein, 8 aa, BK virus
SFIVTKPG

SEQ ID NO: 4910 - protein, 8 aa, BK virus
FIVTKPGG

SEQ ID NO: 4911 - protein, 8 aa, BK virus
IVTKPGGN

SEQ ID NO: 4912 - protein, 8 aa, BK virus
VTKPGGNI

SEQ ID NO: 4913 - protein, 8 aa, BK virus
TKPGGNIW

SEQ ID NO: 4914 - protein, 8 aa, BK virus
KPGGNIWV

SEQ ID NO: 4915 - protein, 8 aa, BK virus
PGGNIWVL

SEQ ID NO: 4916 - protein, 8 aa, BK virus
GGNIWVLL

SEQ ID NO: 4917 - protein, 8 aa, BK virus
GNIWVLLF

SEQ ID NO: 4918 - protein, 8 aa, BK virus
NIWVLLFK

SEQ ID NO: 4919 - protein, 8 aa, BK virus
IWVLLFKC

SEQ ID NO: 4920 - protein, 8 aa, BK virus
WVLLFKCF

SEQ ID NO: 4921 - protein, 8 aa, BK virus
VLLFKCFF

SEQ ID NO: 4922 - protein, 8 aa, BK virus
LLFKCFFS

SEQ ID NO: 4923 - protein, 8 aa, BK virus
LFKCFFSK

SEQ ID NO: 4924 - protein, 8 aa, BK virus
FKCFFSKF

SEQ ID NO: 4925 - protein, 8 aa, BK virus
KCFFSKFT

SEQ ID NO: 4926 - protein, 8 aa, BK virus
CFFSKFTL

SEQ ID NO: 4927 - protein, 8 aa, BK virus
FFSKFTLT

SEQ ID NO: 4928 - protein, 8 aa, BK virus
FSKFTLTL

SEQ ID NO: 4929 - protein, 8 aa, BK virus
SKFTLTLP

SEQ ID NO: 4930 - protein, 8 aa, BK virus
KFTLTLPS

SEQ ID NO: 4931 - protein, 8 aa, BK virus
FTLTLPSK

SEQ ID NO: 4932 - protein, 8 aa, BK virus
SLKLSKLF

SEQ ID NO: 4933 - protein, 8 aa, BK virus
LKLSKLFI

SEQ ID NO: 4934 - protein, 8 aa, BK virus
KLSKLFIP

SEQ ID NO: 4935 - protein, 8 aa, BK virus
LSKLFIPC

SEQ ID NO: 4936 - protein, 8 aa, BK virus
SKLFIPCP

SEQ ID NO: 4937 - protein, 8 aa, BK virus
KLFIPCPE

SEQ ID NO: 4938 - protein, 8 aa, BK virus
LFIPCPEG

SEQ ID NO: 4939 - protein, 8 aa, BK virus
FIPCPEGK

SEQ ID NO: 4940 - protein, 8 aa, BK virus
IPCPEGKS

SEQ ID NO: 4941 - protein, 8 aa, BK virus
PCPEGKSF

SEQ ID NO: 4942 - protein, 8 aa, BK virus
CPEGKSFD

SEQ ID NO: 4943 - protein, 8 aa, BK virus
PEGKSFDS

SEQ ID NO: 4944 - protein, 8 aa, BK virus
EGKSFDSA

SEQ ID NO: 4945 - protein, 8 aa, BK virus
GKSFDSAP

SEQ ID NO: 4946 - protein, 8 aa, BK virus
KSFDSAPV

SEQ ID NO: 4947 - protein, 8 aa, BK virus
SFDSAPVP

SEQ ID NO: 4948 - protein, 8 aa, BK virus
FDSAPVPF

SEQ ID NO: 4949 - protein, 8 aa, BK virus
DSAPVPFT

SEQ ID NO: 4950 - protein, 8 aa, BK virus
SAPVPFTS

SEQ ID NO: 4951 - protein, 8 aa, BK virus
APVPFTSS

SEQ ID NO: 4952 - protein, 8 aa, BK virus
PVPFTSSK

SEQ ID NO: 4953 - protein, 8 aa, BK virus
VPFTSSKT

SEQ ID NO: 4954 - protein, 8 aa, BK virus
PFTSSKTT

SEQ ID NO: 4955 - protein, 8 aa, BK virus
FTSSKTTM

SEQ ID NO: 4956 - protein, 8 aa, BK virus
TSSKTTMY

SEQ ID NO: 4957 - protein, 8 aa, BK virus
SIATPSSK

SEQ ID NO: 4958 - protein, 8 aa, BK virus
IATPSSKV

SEQ ID NO: 4959 - protein, 8 aa, BK virus
ATPSSKVS

SEQ ID NO: 4960 - protein, 8 aa, BK virus
TPSSKVSL

SEQ ID NO: 4961 - protein, 8 aa, BK virus
PSSKVSLS

SEQ ID NO: 4962 - protein, 8 aa, BK virus
SSKVSLSM

SEQ ID NO: 4963 - protein, 8 aa, BK virus
SKVSLSMG

SEQ ID NO: 4964 - protein, 8 aa, BK virus
KVSLSMGR

SEQ ID NO: 4965 - protein, 8 aa, BK virus
VSLSMGRF

SEQ ID NO: 4966 - protein, 8 aa, BK virus
SLSMGRFT

SEQ ID NO: 4967 - protein, 8 aa, BK virus
LSMGRFTF

SEQ ID NO: 4968 - protein, 8 aa, BK virus
SMGRFTFK

SEQ ID NO: 4969 - protein, 8 aa, BK virus
MGRFTFKA

SEQ ID NO: 4970 - protein, 8 aa, BK virus
GRFTFKAL

SEQ ID NO: 4971 - protein, 8 aa, BK virus
RFTFKALP

SEQ ID NO: 4972 - protein, 8 aa, BK virus
FTFKALPP

SEQ ID NO: 4973 - protein, 8 aa, BK virus
TFKALPPH

SEQ ID NO: 4974 - protein, 8 aa, BK virus
FKALPPHK

SEQ ID NO: 4975 - protein, 8 aa, BK virus
KALPPHKS

SEQ ID NO: 4976 - protein, 8 aa, BK virus
ALPPHKSN

SEQ ID NO: 4977 - protein, 8 aa, BK virus
LPPHKSNN

SEQ ID NO: 4978 - protein, 8 aa, BK virus
PPHKSNNP

SEQ ID NO: 4979 - protein, 8 aa, BK virus
PHKSNNPA

SEQ ID NO: 4980 - protein, 8 aa, BK virus
HKSNNPAA

SEQ ID NO: 4981 - protein, 8 aa, BK virus
KSNNPAAS

SEQ ID NO: 4982 - protein, 8 aa, BK virus
SNNPAASV

SEQ ID NO: 4983 - protein, 8 aa, BK virus
NNPAASVV

SEQ ID NO: 4984 - protein, 8 aa, BK virus
NPAASVVF

SEQ ID NO: 4985 - protein, 8 aa, BK virus
PAASVVFP

SEQ ID NO: 4986 - protein, 8 aa, BK virus
AASVVFPL

SEQ ID NO: 4987 - protein, 8 aa, BK virus
ASVVFPLS

SEQ ID NO: 4988 - protein, 8 aa, BK virus
SVVFPLSM

SEQ ID NO: 4989 - protein, 8 aa, BK virus
VVFPLSMG

SEQ ID NO: 4990 - protein, 8 aa, BK virus
VFPLSMGP

SEQ ID NO: 4991 - protein, 8 aa, BK virus
FPLSMGPL

SEQ ID NO: 4992 - protein, 8 aa, BK virus
PLSMGPLN

SEQ ID NO: 4993 - protein, 8 aa, BK virus
LSMGPLNN

SEQ ID NO: 4994 - protein, 8 aa, BK virus
SMGPLNNQ

SEQ ID NO: 4995 - protein, 8 aa, BK virus
MGPLNNQY

SEQ ID NO: 4996 - protein, 8 aa, BK virus
GPLNNQYL

SEQ ID NO: 4997 - protein, 8 aa, BK virus
PLNNQYLL

SEQ ID NO: 4998 - protein, 8 aa, BK virus
LNNQYLLL

SEQ ID NO: 4999 - protein, 8 aa, BK virus
NNQYLLLG

SEQ ID NO: 5000 - protein, 8 aa, BK virus
NQYLLLGT

SEQ ID NO: 5001 - protein, 8 aa, BK virus
QYLLLGTL

SEQ ID NO: 5002 - protein, 8 aa, BK virus
YLLLGTLK

SEQ ID NO: 5003 - protein, 8 aa, BK virus
LLLGTLKT

SEQ ID NO: 5004 - protein, 8 aa, BK virus
LLGTLKTI

SEQ ID NO: 5005 - protein, 8 aa, BK virus
LGTLKTIQ

SEQ ID NO: 5006 - protein, 8 aa, BK virus
GTLKTIQC

SEQ ID NO: 5007 - protein, 8 aa, BK virus
TLKTIQCK

SEQ ID NO: 5008 - protein, 8 aa, BK virus
LKTIQCKK

SEQ ID NO: 5009 - protein, 8 aa, BK virus
KTIQCKKS

SEQ ID NO: 5010 - protein, 8 aa, BK virus
TIQCKKSN

SEQ ID NO: 5011 - protein, 8 aa, BK virus
IQCKKSNI

SEQ ID NO: 5012 - protein, 8 aa, BK virus
QCKKSNIT

SEQ ID NO: 5013 - protein, 8 aa, BK virus
CKKSNITE

SEQ ID NO: 5014 - protein, 8 aa, BK virus
KKSNITES

SEQ ID NO: 5015 - protein, 8 aa, BK virus
KSNITESI

SEQ ID NO: 5016 - protein, 8 aa, BK virus
SNITESIL

SEQ ID NO: 5017 - protein, 8 aa, BK virus
NITESILG

SEQ ID NO: 5018 - protein, 8 aa, BK virus
ITESILGS

SEQ ID NO: 5019 - protein, 8 aa, BK virus
TESILGSK

SEQ ID NO: 5020 - protein, 8 aa, BK virus
ESILGSKQ

SEQ ID NO: 5021 - protein, 8 aa, BK virus
SILGSKQC

SEQ ID NO: 5022 - protein, 8 aa, BK virus
ILGSKQCS

SEQ ID NO: 5023 - protein, 8 aa, BK virus
LGSKQCSQ

SEQ ID NO: 5024 - protein, 8 aa, BK virus
GSKQCSQA

SEQ ID NO: 5025 - protein, 8 aa, BK virus
SKQCSQAT

SEQ ID NO: 5026 - protein, 8 aa, BK virus
KQCSQATP

SEQ ID NO: 5027 - protein, 8 aa, BK virus
QCSQATPA

SEQ ID NO: 5028 - protein, 8 aa, BK virus
CSQATPAI

SEQ ID NO: 5029 - protein, 8 aa, BK virus
SQATPAIY

SEQ ID NO: 5030 - protein, 8 aa, BK virus
QATPAIYC

SEQ ID NO: 5031 - protein, 8 aa, BK virus
ATPAIYCS

SEQ ID NO: 5032 - protein, 8 aa, BK virus
TPAIYCSS

SEQ ID NO: 5033 - protein, 8 aa, BK virus
PAIYCSST

SEQ ID NO: 5034 - protein, 8 aa, BK virus
AIYCSSTA

SEQ ID NO: 5035 - protein, 8 aa, BK virus
IYCSSTAF

SEQ ID NO: 5036 - protein, 8 aa, BK virus
YCSSTAFP

SEQ ID NO: 5037 - protein, 8 aa, BK virus
APNIKSIL

SEQ ID NO: 5038 - protein, 8 aa, BK virus
PNIKSILS

SEQ ID NO: 5039 - protein, 8 aa, BK virus
NIKSILSN

SEQ ID NO: 5040 - protein, 8 aa, BK virus
IKSILSNI

SEQ ID NO: 5041 - protein, 8 aa, BK virus
LNLSVSIS

SEQ ID NO: 5042 - protein, 8 aa, BK virus
NLSVSISS

SEQ ID NO: 5043 - protein, 8 aa, BK virus
LSVSISSL

SEQ ID NO: 5044 - protein, 8 aa, BK virus
SVSISSLV

SEQ ID NO: 5045 - protein, 8 aa, BK virus
VSISSLVI

SEQ ID NO: 5046 - protein, 8 aa, BK virus
RVSTLFLA

SEQ ID NO: 5047 - protein, 8 aa, BK virus
VSTLFLAK

SEQ ID NO: 5048 - protein, 8 aa, BK virus
STLFLAKT

SEQ ID NO: 5049 - protein, 8 aa, BK virus
TLFLAKTV

SEQ ID NO: 5050 - protein, 8 aa, BK virus
LFLAKTVS

SEQ ID NO: 5051 - protein, 8 aa, BK virus
FLAKTVST

SEQ ID NO: 5052 - protein, 8 aa, BK virus
LAKTVSTA

SEQ ID NO: 5053 - protein, 8 aa, BK virus
AKTVSTAC

SEQ ID NO: 5054 - protein, 8 aa, BK virus
FLLSAKII

SEQ ID NO: 5055 - protein, 8 aa, BK virus
LLSAKIIA

SEQ ID NO: 5056 - protein, 8 aa, BK virus
LSAKIIAF

SEQ ID NO: 5057 - protein, 8 aa, BK virus
SAKIIAFA

SEQ ID NO: 5058 - protein, 8 aa, BK virus
AKIIAFAK

SEQ ID NO: 5059 - protein, 8 aa, BK virus
KIIAFAKC

SEQ ID NO: 5060 - protein, 8 aa, BK virus
IIAFAKCF

SEQ ID NO: 5061 - protein, 8 aa, BK virus
IAFAKCFS

SEQ ID NO: 5062 - protein, 8 aa, BK virus
HFLHSSTL

SEQ ID NO: 5063 - protein, 8 aa, BK virus
FLHSSTLY

SEQ ID NO: 5064 - protein, 8 aa, BK virus
NSKYIPNN

SEQ ID NO: 5065 - protein, 8 aa, BK virus
SKYIPNNK

SEQ ID NO: 5066 - protein, 8 aa, BK virus
KYIPNNKN

SEQ ID NO: 5067 - protein, 8 aa, BK virus
YIPNNKNT

SEQ ID NO: 5068 - protein, 8 aa, BK virus
IPNNKNTS

SEQ ID NO: 5069 - protein, 8 aa, BK virus
PNNKNTSS

SEQ ID NO: 5070 - protein, 8 aa, BK virus
NNKNTSSH

SEQ ID NO: 5071 - protein, 8 aa, BK virus
NKNTSSHF

SEQ ID NO: 5072 - protein, 8 aa, BK virus
KNTSSHFV

SEQ ID NO: 5073 - protein, 8 aa, BK virus
NTSSHFVS

SEQ ID NO: 5074 - protein, 8 aa, BK virus
TSSHFVST

SEQ ID NO: 5075 - protein, 8 aa, BK virus
SSHFVSTA

SEQ ID NO: 5076 - protein, 8 aa, BK virus
SHFVSTAY

SEQ ID NO: 5077 - protein, 8 aa, BK virus
HFVSTAYS

SEQ ID NO: 5078 - protein, 8 aa, BK virus
FVSTAYSV

SEQ ID NO: 5079 - protein, 8 aa, BK virus
VSTAYSVI

SEQ ID NO: 5080 - protein, 8 aa, BK virus
STAYSVIN

SEQ ID NO: 5081 - protein, 8 aa, BK virus
TAYSVINF

SEQ ID NO: 5082 - protein, 8 aa, BK virus
AYSVINFQ

SEQ ID NO: 5083 - protein, 8 aa, BK virus
YSVINFQD

SEQ ID NO: 5084 - protein, 8 aa, BK virus
SVINFQDT

SEQ ID NO: 5085 - protein, 8 aa, BK virus
VINFQDTC

SEQ ID NO: 5086 - protein, 8 aa, BK virus
INFQDTCF

SEQ ID NO: 5087 - protein, 8 aa, BK virus
NFQDTCFV

SEQ ID NO: 5088 - protein, 8 aa, BK virus
FQDTCFVS

SEQ ID NO: 5089 - protein, 8 aa, BK virus
QDTCFVSS

SEQ ID NO: 5090 - protein, 8 aa, BK virus
DTCFVSSG

SEQ ID NO: 5091 - protein, 8 aa, BK virus
TCFVSSGS

SEQ ID NO: 5092 - protein, 8 aa, BK virus
CFVSSGSS

SEQ ID NO: 5093 - protein, 8 aa, BK virus
FVSSGSSG

SEQ ID NO: 5094 - protein, 8 aa, BK virus
VSSGSSGL

SEQ ID NO: 5095 - protein, 8 aa, BK virus
SSGSSGLK

SEQ ID NO: 5096 - protein, 8 aa, BK virus
SGSSGLKS

SEQ ID NO: 5097 - protein, 8 aa, BK virus
GSSGLKSC

SEQ ID NO: 5098 - protein, 8 aa, BK virus
SSGLKSCS

SEQ ID NO: 5099 - protein, 8 aa, BK virus
SGLKSCSF

SEQ ID NO: 5100 - protein, 8 aa, BK virus
GLKSCSFK

SEQ ID NO: 5101 - protein, 8 aa, BK virus
LKSCSFKP

SEQ ID NO: 5102 - protein, 8 aa, BK virus
KSCSFKPP

SEQ ID NO: 5103 - protein, 8 aa, BK virus
MLSSIVWY

SEQ ID NO: 5104 - protein, 8 aa, BK virus
LSSIVWYG

SEQ ID NO: 5105 - protein, 8 aa, BK virus
SSIVWYGS

SEQ ID NO: 5106 - protein, 8 aa, BK virus
SIVWYGSL

SEQ ID NO: 5107 - protein, 8 aa, BK virus
IVWYGSLV

SEQ ID NO: 5108 - protein, 8 aa, BK virus
VWYGSLVK

SEQ ID NO: 5109 - protein, 8 aa, BK virus
WYGSLVKA

SEQ ID NO: 5110 - protein, 8 aa, BK virus
YGSLVKAL

SEQ ID NO: 5111 - protein, 8 aa, BK virus
GSLVKALY

SEQ ID NO: 5112 - protein, 8 aa, BK virus
SLVKALYS

SEQ ID NO: 5113 - protein, 8 aa, BK virus
LVKALYSK

SEQ ID NO: 5114 - protein, 8 aa, BK virus
VKALYSKY

SEQ ID NO: 5115 - protein, 8 aa, BK virus
KALYSKYS

SEQ ID NO: 5116 - protein, 8 aa, BK virus
ALYSKYSL

SEQ ID NO: 5117 - protein, 8 aa, BK virus
LYSKYSLL

SEQ ID NO: 5118 - protein, 8 aa, BK virus
YSKYSLLT

SEQ ID NO: 5119 - protein, 8 aa, BK virus
SKYSLLTP

SEQ ID NO: 5120 - protein, 8 aa, BK virus
KYSLLTPL

SEQ ID NO: 5121 - protein, 8 aa, BK virus
YSLLTPLQ

SEQ ID NO: 5122 - protein, 8 aa, BK virus
SLLTPLQI

SEQ ID NO: 5123 - protein, 8 aa, BK virus
LLTPLQIK

SEQ ID NO: 5124 - protein, 8 aa, BK virus
LTPLQIKK

SEQ ID NO: 5125 - protein, 8 aa, BK virus
TPLQIKKL

SEQ ID NO: 5126 - protein, 8 aa, BK virus
PLQIKKLK

SEQ ID NO: 5127 - protein, 8 aa, BK virus
LQIKKLKV

SEQ ID NO: 5128 - protein, 8 aa, BK virus
QIKKLKVH

SEQ ID NO: 5129 - protein, 8 aa, BK virus
IKKLKVHS

SEQ ID NO: 5130 - protein, 8 aa, BK virus
KKLKVHSF

SEQ ID NO: 5131 - protein, 8 aa, BK virus
QKLLIAET

SEQ ID NO: 5132 - protein, 8 aa, BK virus
KLLIAETL

SEQ ID NO: 5133 - protein, 8 aa, BK virus
LLIAETLC

SEQ ID NO: 5134 - protein, 8 aa, BK virus
LIAETLCL

SEQ ID NO: 5135 - protein, 8 aa, BK virus
IAETLCLC

SEQ ID NO: 5136 - protein, 8 aa, BK virus
AETLCLCG

SEQ ID NO: 5137 - protein, 8 aa, BK virus
ETLCLCGV

SEQ ID NO: 5138 - protein, 8 aa, BK virus
TLCLCGVK

SEQ ID NO: 5139 - protein, 8 aa, BK virus
LCLCGVKK

SEQ ID NO: 5140 - protein, 8 aa, BK virus
CLCGVKKN

SEQ ID NO: 5141 - protein, 8 aa, BK virus
LCGVKKNI

SEQ ID NO: 5142 - protein, 8 aa, BK virus
CGVKKNII

SEQ ID NO: 5143 - protein, 8 aa, BK virus
GVKKNIIL

SEQ ID NO: 5144 - protein, 8 aa, BK virus
VKKNIILC

SEQ ID NO: 5145 - protein, 8 aa, BK virus
KKNIILCP

SEQ ID NO: 5146 - protein, 8 aa, BK virus
KNIILCPA

SEQ ID NO: 5147 - protein, 8 aa, BK virus
NIILCPAH

SEQ ID NO: 5148 - protein, 8 aa, BK virus
IILCPAHM

SEQ ID NO: 5149 - protein, 8 aa, BK virus
ILCPAHMC

SEQ ID NO: 5150 - protein, 8 aa, BK virus
LCPAHMCL

SEQ ID NO: 5151 - protein, 8 aa, BK virus
CPAHMCLL

SEQ ID NO: 5152 - protein, 8 aa, BK virus
PAHMCLLI

SEQ ID NO: 5153 - protein, 8 aa, BK virus
AHMCLLIK

SEQ ID NO: 5154 - protein, 8 aa, BK virus
HMCLLIKV

SEQ ID NO: 5155 - protein, 8 aa, BK virus
MCLLIKVT

SEQ ID NO: 5156 - protein, 8 aa, BK virus
CLLIKVTE

SEQ ID NO: 5157 - protein, 8 aa, BK virus
LLIKVTEY

SEQ ID NO: 5158 - protein, 8 aa, BK virus
LIKVTEYF

SEQ ID NO: 5159 - protein, 8 aa, BK virus
IKVTEYFS

SEQ ID NO: 5160 - protein, 8 aa, BK virus
KVTEYFSI

SEQ ID NO: 5161 - protein, 8 aa, BK virus
VTEYFSIS

SEQ ID NO: 5162 - protein, 8 aa, BK virus
TEYFSISF

SEQ ID NO: 5163 - protein, 8 aa, BK virus
EYFSISFL

SEQ ID NO: 5164 - protein, 8 aa, BK virus
YFSISFLY

SEQ ID NO: 5165 - protein, 8 aa, BK virus
FSISFLYR

SEQ ID NO: 5166 - protein, 8 aa, BK virus
SISFLYRI

SEQ ID NO: 5167 - protein, 8 aa, BK virus
AFSLVVYT

SEQ ID NO: 5168 - protein, 8 aa, BK virus
FSLVVYTA

SEQ ID NO: 5169 - protein, 8 aa, BK virus
SLVVYTAK

SEQ ID NO: 5170 - protein, 8 aa, BK virus
LVVYTAKQ

SEQ ID NO: 5171 - protein, 8 aa, BK virus
VVYTAKQA

SEQ ID NO: 5172 - protein, 8 aa, BK virus
VYTAKQAR

SEQ ID NO: 5173 - protein, 8 aa, BK virus
YTAKQARV

SEQ ID NO: 5174 - protein, 8 aa, BK virus
TAKQARVL

SEQ ID NO: 5175 - protein, 8 aa, BK virus
AKQARVLL

SEQ ID NO: 5176 - protein, 8 aa, BK virus
KQARVLLL

SEQ ID NO: 5177 - protein, 8 aa, BK virus
QARVLLLN

SEQ ID NO: 5178 - protein, 8 aa, BK virus
ARVLLLNT

SEQ ID NO: 5179 - protein, 8 aa, BK virus
RVLLLNTA

SEQ ID NO: 5180 - protein, 8 aa, BK virus
LRNWCRSE

SEQ ID NO: 5181 - protein, 8 aa, BK virus
RNWCRSEG

SEQ ID NO: 5182 - protein, 8 aa, BK virus
NWCRSEGK

SEQ ID NO: 5183 - protein, 8 aa, BK virus
WCRSEGKS

SEQ ID NO: 5184 - protein, 8 aa, BK virus
CRSEGKSL

SEQ ID NO: 5185 - protein, 8 aa, BK virus
RSEGKSLG

SEQ ID NO: 5186 - protein, 8 aa, BK virus
SEGKSLGS

SEQ ID NO: 5187 - protein, 8 aa, BK virus
EGKSLGSS

SEQ ID NO: 5188 - protein, 8 aa, BK virus
GKSLGSST

SEQ ID NO: 5189 - protein, 8 aa, BK virus
KSLGSSTF

SEQ ID NO: 5190 - protein, 8 aa, BK virus
SLGSSTFL

SEQ ID NO: 5191 - protein, 8 aa, BK virus
LGSSTFLF

SEQ ID NO: 5192 - protein, 8 aa, BK virus
GSSTFLFF

SEQ ID NO: 5193 - protein, 8 aa, BK virus
SSTFLFFL

SEQ ID NO: 5194 - protein, 8 aa, BK virus
STFLFFLG

SEQ ID NO: 5195 - protein, 8 aa, BK virus
TFLFFLGG

SEQ ID NO: 5196 - protein, 8 aa, BK virus
FLFFLGGV

SEQ ID NO: 5197 - protein, 8 aa, BK virus
LFFLGGVE

SEQ ID NO: 5198 - protein, 8 aa, BK virus
FFLGGVEC

SEQ ID NO: 5199 - protein, 8 aa, BK virus
ESAVASSS

SEQ ID NO: 5200 - protein, 8 aa, BK virus
SAVASSSL

SEQ ID NO: 5201 - protein, 8 aa, BK virus
AVASSSLA

SEQ ID NO: 5202 - protein, 8 aa, BK virus
VASSSLAN

SEQ ID NO: 5203 - protein, 8 aa, BK virus
ASSSLANI

SEQ ID NO: 5204 - protein, 8 aa, BK virus
SSSLANIS

SEQ ID NO: 5205 - protein, 8 aa, BK virus
SSLANISS

SEQ ID NO: 5206 - protein, 8 aa, BK virus
SLANISSW

SEQ ID NO: 5207 - protein, 8 aa, BK virus
LANISSWQ

SEQ ID NO: 5208 - protein, 8 aa, BK virus
ANISSWQN

SEQ ID NO: 5209 - protein, 8 aa, BK virus
NISSWQNK

SEQ ID NO: 5210 - protein, 8 aa, BK virus
ISSWQNKS

SEQ ID NO: 5211 - protein, 8 aa, BK virus
SSWQNKSS

SEQ ID NO: 5212 - protein, 8 aa, BK virus
SWQNKSSS

SEQ ID NO: 5213 - protein, 8 aa, BK virus
WQNKSSSH

SEQ ID NO: 5214 - protein, 8 aa, BK virus
QNKSSSHF

SEQ ID NO: 5215 - protein, 8 aa, BK virus
NKSSSHFS

SEQ ID NO: 5216 - protein, 8 aa, BK virus
KSSSHFSL

SEQ ID NO: 5217 - protein, 8 aa, BK virus
SSSHFSLK

SEQ ID NO: 5218 - protein, 8 aa, BK virus
SSHFSLKE

SEQ ID NO: 5219 - protein, 8 aa, BK virus
SHFSLKEL

SEQ ID NO: 5220 - protein, 8 aa, BK virus
HFSLKELH

SEQ ID NO: 5221 - protein, 8 aa, BK virus
FSLKELHQ

SEQ ID NO: 5222 - protein, 8 aa, BK virus
SLKELHQD

SEQ ID NO: 5223 - protein, 8 aa, BK virus
LKELHQDS

SEQ ID NO: 5224 - protein, 8 aa, BK virus
KELHQDSH

SEQ ID NO: 5225 - protein, 8 aa, BK virus
ELHQDSHS

SEQ ID NO: 5226 - protein, 8 aa, BK virus
LHQDSHSS

SEQ ID NO: 5227 - protein, 8 aa, BK virus
HQDSHSSV

SEQ ID NO: 5228 - protein, 8 aa, BK virus
QDSHSSVP

SEQ ID NO: 5229 - protein, 8 aa, BK virus
VGTYKKNN

SEQ ID NO: 5230 - protein, 8 aa, BK virus
GTYKKNNY

SEQ ID NO: 5231 - protein, 8 aa, BK virus
TYKKNNYL

SEQ ID NO: 5232 - protein, 8 aa, BK virus
YKKNNYLG

SEQ ID NO: 5233 - protein, 8 aa, BK virus
KKNNYLGP

SEQ ID NO: 5234 - protein, 8 aa, BK virus
KNNYLGPF

SEQ ID NO: 5235 - protein, 8 aa, BK virus
NNYLGPFN

SEQ ID NO: 5236 - protein, 8 aa, BK virus
NYLGPFNI

SEQ ID NO: 5237 - protein, 8 aa, BK virus
YLGPFNIL

SEQ ID NO: 5238 - protein, 8 aa, BK virus
LGPFNILL

SEQ ID NO: 5239 - protein, 8 aa, BK virus
GPFNILLF

SEQ ID NO: 5240 - protein, 8 aa, BK virus
PFNILLFI

SEQ ID NO: 5241 - protein, 8 aa, BK virus
VSYLKALD

SEQ ID NO: 5242 - protein, 8 aa, BK virus
SYLKALDL

SEQ ID NO: 5243 - protein, 8 aa, BK virus
REFLQLFG

SEQ ID NO: 5244 - protein, 8 aa, BK virus
EFLQLFGP

SEQ ID NO: 5245 - protein, 8 aa, BK virus
FLQLFGPT

SEQ ID NO: 5246 - protein, 8 aa, BK virus
LQLFGPTI

SEQ ID NO: 5247 - protein, 8 aa, BK virus
QLFGPTIA

SEQ ID NO: 5248 - protein, 8 aa, BK virus
LFGPTIAE

SEQ ID NO: 5249 - protein, 8 aa, BK virus
FGPTIAEF

SEQ ID NO: 5250 - protein, 8 aa, BK virus
GPTIAEFL

SEQ ID NO: 5251 - protein, 8 aa, BK virus
PTIAEFLQ

SEQ ID NO: 5252 - protein, 8 aa, BK virus
TIAEFLQL

SEQ ID NO: 5253 - protein, 8 aa, BK virus
IAEFLQLG

SEQ ID NO: 5254 - protein, 8 aa, BK virus
AEFLQLGL

SEQ ID NO: 5255 - protein, 8 aa, BK virus
EFLQLGLS

SEQ ID NO: 5256 - protein, 8 aa, BK virus
FLQLGLSQ

SEQ ID NO: 5257 - protein, 8 aa, BK virus
LQLGLSQT

SEQ ID NO: 5258 - protein, 8 aa, BK virus
QLGLSQTT

SEQ ID NO: 5259 - protein, 8 aa, BK virus
LGLSQTTV

SEQ ID NO: 5260 - protein, 8 aa, BK virus
SSQCSSNL

SEQ ID NO: 5261 - protein, 8 aa, BK virus
SQCSSNLS

SEQ ID NO: 5262 - protein, 8 aa, BK virus
QCSSNLSK

SEQ ID NO: 5263 - protein, 8 aa, BK virus
CSSNLSKP

SEQ ID NO: 5264 - protein, 8 aa, BK virus
SSNLSKPR

SEQ ID NO: 5265 - protein, 8 aa, BK virus
SNLSKPRA

SEQ ID NO: 5266 - protein, 8 aa, BK virus
NLSKPRAL

SEQ ID NO: 5267 - protein, 8 aa, BK virus
LSKPRALF

SEQ ID NO: 5268 - protein, 8 aa, BK virus
SKPRALFL

SEQ ID NO: 5269 - protein, 8 aa, BK virus
KPRALFLK

SEQ ID NO: 5270 - protein, 8 aa, BK virus
PRALFLKI

SEQ ID NO: 5271 - protein, 8 aa, BK virus
RALFLKIF

SEQ ID NO: 5272 - protein, 8 aa, BK virus
ALFLKIFY

SEQ ID NO: 5273 - protein, 8 aa, BK virus
LFLKIFYL

SEQ ID NO: 5274 - protein, 8 aa, BK virus
FLKIFYLN

SEQ ID NO: 5275 - protein, 8 aa, BK virus
LKIFYLNA

SEQ ID NO: 5276 - protein, 8 aa, BK virus
KIFYLNAL

SEQ ID NO: 5277 - protein, 8 aa, BK virus
IFYLNALI

SEQ ID NO: 5278 - protein, 8 aa, BK virus
ADIACKGS

SEQ ID NO: 5279 - protein, 8 aa, BK virus
DIACKGSA

SEQ ID NO: 5280 - protein, 8 aa, BK virus
IACKGSAQ

SEQ ID NO: 5281 - protein, 8 aa, BK virus
ACKGSAQK

SEQ ID NO: 5282 - protein, 8 aa, BK virus
CKGSAQKA

SEQ ID NO: 5283 - protein, 8 aa, BK virus
KGSAQKAF

SEQ ID NO: 5284 - protein, 8 aa, BK virus
GSAQKAFW

SEQ ID NO: 5285 - protein, 8 aa, BK virus
SAQKAFWN

SEQ ID NO: 5286 - protein, 8 aa, BK virus
AQKAFWNK

SEQ ID NO: 5287 - protein, 8 aa, BK virus
AIPCSTGY

SEQ ID NO: 5288 - protein, 8 aa, BK virus
IPCSTGYL

SEQ ID NO: 5289 - protein, 8 aa, BK virus
PCSTGYLG

SEQ ID NO: 5290 - protein, 8 aa, BK virus
CSTGYLGK

SEQ ID NO: 5291 - protein, 8 aa, BK virus
STGYLGKE

SEQ ID NO: 5292 - protein, 8 aa, BK virus
TGYLGKEE

SEQ ID NO: 5293 - protein, 8 aa, BK virus
GYLGKEEN

SEQ ID NO: 5294 - protein, 8 aa, BK virus
YLGKEENQ

SEQ ID NO: 5295 - protein, 8 aa, BK virus
LGKEENQH

SEQ ID NO: 5296 - protein, 8 aa, BK virus
GKEENQHK

SEQ ID NO: 5297 - protein, 8 aa, BK virus
KEENQHKP

SEQ ID NO: 5298 - protein, 8 aa, BK virus
EENQHKPL

SEQ ID NO: 5299 - protein, 8 aa, BK virus
ENQHKPLS

SEQ ID NO: 5300 - protein, 8 aa, BK virus
NQHKPLSY

SEQ ID NO: 5301 - protein, 8 aa, BK virus
QHKPLSYS

SEQ ID NO: 5302 - protein, 8 aa, BK virus
HKPLSYSR

SEQ ID NO: 5303 - protein, 8 aa, BK virus
KPLSYSRF

SEQ ID NO: 5304 - protein, 8 aa, BK virus
PLSYSRFQ

SEQ ID NO: 5305 - protein, 8 aa, BK virus
LSYSRFQN

SEQ ID NO: 5306 - protein, 8 aa, BK virus
SYSRFQNQ

SEQ ID NO: 5307 - protein, 8 aa, BK virus
YSRFQNQA

SEQ ID NO: 5308 - protein, 8 aa, BK virus
SRFQNQAD

SEQ ID NO: 5309 - protein, 8 aa, BK virus
RFQNQADE

SEQ ID NO: 5310 - protein, 8 aa, BK virus
FQNQADEL

SEQ ID NO: 5311 - protein, 8 aa, BK virus
QNQADELP

SEQ ID NO: 5312 - protein, 8 aa, BK virus
NQADELPL

SEQ ID NO: 5313 - protein, 8 aa, BK virus
QADELPLH

SEQ ID NO: 5314 - protein, 8 aa, BK virus
ADELPLHP

SEQ ID NO: 5315 - protein, 8 aa, BK virus
DELPLHPA

SEQ ID NO: 5316 - protein, 8 aa, BK virus
ELPLHPAP

SEQ ID NO: 5317 - protein, 8 aa, BK virus
LPLHPAPF

SEQ ID NO: 5318 - protein, 8 aa, BK virus
PLHPAPFF

SEQ ID NO: 5319 - protein, 8 aa, BK virus
LHPAPFFY

SEQ ID NO: 5320 - protein, 8 aa, BK virus
HPAPFFYT

SEQ ID NO: 5321 - protein, 8 aa, BK virus
PAPFFYTK

SEQ ID NO: 5322 - protein, 8 aa, BK virus
APFFYTKY

SEQ ID NO: 5323 - protein, 8 aa, BK virus
PFFYTKYS

SEQ ID NO: 5324 - protein, 8 aa, BK virus
FFYTKYSF

SEQ ID NO: 5325 - protein, 8 aa, BK virus
FYTKYSFS

SEQ ID NO: 5326 - protein, 8 aa, BK virus
YTKYSFSS

SEQ ID NO: 5327 - protein, 8 aa, BK virus
TKYSFSSF

SEQ ID NO: 5328 - protein, 8 aa, BK virus
KYSFSSFY

SEQ ID NO: 5329 - protein, 8 aa, BK virus
YSFSSFYP

SEQ ID NO: 5330 - protein, 8 aa, BK virus
SFSSFYPR

SEQ ID NO: 5331 - protein, 8 aa, BK virus
FSSFYPRR

SEQ ID NO: 5332 - protein, 8 aa, BK virus
SSFYPRRP

SEQ ID NO: 5333 - protein, 8 aa, BK virus
SFYPRRPL

SEQ ID NO: 5334 - protein, 8 aa, BK virus
FYPRRPLC

SEQ ID NO: 5335 - protein, 8 aa, BK virus
YPRRPLCQ

SEQ ID NO: 5336 - protein, 8 aa, BK virus
PRRPLCQG

SEQ ID NO: 5337 - protein, 8 aa, BK virus
RRPLCQGE

SEQ ID NO: 5338 - protein, 8 aa, BK virus
RPLCQGEI

SEQ ID NO: 5339 - protein, 8 aa, BK virus
PLCQGEIP

SEQ ID NO: 5340 - protein, 8 aa, BK virus
LCQGEIPY

SEQ ID NO: 5341 - protein, 8 aa, BK virus
CQGEIPYT

SEQ ID NO: 5342 - protein, 8 aa, BK virus
QGEIPYTS

SEQ ID NO: 5343 - protein, 8 aa, BK virus
GEIPYTSL

SEQ ID NO: 5344 - protein, 8 aa, BK virus
EIPYTSLN

SEQ ID NO: 5345 - protein, 8 aa, BK virus
IPYTSLNK

SEQ ID NO: 5346 - protein, 8 aa, BK virus
PYTSLNKL

SEQ ID NO: 5347 - protein, 8 aa, BK virus
YTSLNKLF

SEQ ID NO: 5348 - protein, 8 aa, BK virus
TSLNKLFS

SEQ ID NO: 5349 - protein, 8 aa, BK virus
SLNKLFSL

SEQ ID NO: 5350 - protein, 8 aa, BK virus
LNKLFSLR

SEQ ID NO: 5351 - protein, 8 aa, BK virus
NKLFSLRE

SEQ ID NO: 5352 - protein, 8 aa, BK virus
KLFSLRED

SEQ ID NO: 5353 - protein, 8 aa, BK virus
LFSLREDF

SEQ ID NO: 5354 - protein, 8 aa, BK virus
FSLREDFP

SEQ ID NO: 5355 - protein, 8 aa, BK virus
SLREDFPR

SEQ ID NO: 5356 - protein, 8 aa, BK virus
LREDFPRQ

SEQ ID NO: 5357 - protein, 8 aa, BK virus
REDFPRQL

SEQ ID NO: 5358 - protein, 8 aa, BK virus
EDFPRQLF

SEQ ID NO: 5359 - protein, 8 aa, BK virus
DFPRQLFQ

SEQ ID NO: 5360 - protein, 8 aa, BK virus
FPRQLFQG

SEQ ID NO: 5361 - protein, 8 aa, BK virus
PRQLFQGL

SEQ ID NO: 5362 - protein, 8 aa, BK virus
RQLFQGLK

SEQ ID NO: 5363 - protein, 8 aa, BK virus
QLFQGLKG

SEQ ID NO: 5364 - protein, 8 aa, BK virus
LFQGLKGP

SEQ ID NO: 5365 - protein, 9 aa, BK virus
GFPQIVLLG

SEQ ID NO: 5366 - protein, 9 aa, BK virus
FPQIVLLGL

SEQ ID NO: 5367 - protein, 9 aa, BK virus
PQIVLLGLR

SEQ ID NO: 5368 - protein, 9 aa, BK virus
QIVLLGLRK

SEQ ID NO: 5369 - protein, 9 aa, BK virus
IVLLGLRKS

SEQ ID NO: 5370 - protein, 9 aa, BK virus
VLLGLRKSL

SEQ ID NO: 5371 - protein, 9 aa, BK virus
LLGLRKSLH

SEQ ID NO: 5372 - protein, 9 aa, BK virus
LGLRKSLHT

SEQ ID NO: 5373 - protein, 9 aa, BK virus
GLRKSLHTL

SEQ ID NO: 5374 - protein, 9 aa, BK virus
LRKSLHTLT

SEQ ID NO: 5375 - protein, 9 aa, BK virus
RKSLHTLTT

SEQ ID NO: 5376 - protein, 9 aa, BK virus
EKGWRQRRP

SEQ ID NO: 5377 - protein, 9 aa, BK virus
KGWRQRRPR

SEQ ID NO: 5378 - protein, 9 aa, BK virus
GWRQRRPRP

SEQ ID NO: 5379 - protein, 9 aa, BK virus
WRQRRPRPL

SEQ ID NO: 5380 - protein, 9 aa, BK virus
RQRRPRPLI

SEQ ID NO: 5381 - protein, 9 aa, BK virus
QRRPRPLIY

SEQ ID NO: 5382 - protein, 9 aa, BK virus
RRPRPLIYY

SEQ ID NO: 5383 - protein, 9 aa, BK virus
RPRPLIYYK

SEQ ID NO: 5384 - protein, 9 aa, BK virus
PRPLIYYKK

SEQ ID NO: 5385 - protein, 9 aa, BK virus
RPLIYYKKK

SEQ ID NO: 5386 - protein, 9 aa, BK virus
PLIYYKKKG

SEQ ID NO: 5387 - protein, 9 aa, BK virus
LIYYKKKGH

SEQ ID NO: 5388 - protein, 9 aa, BK virus
IYYKKKGHR

SEQ ID NO: 5389 - protein, 9 aa, BK virus
YYKKKGHRE

SEQ ID NO: 5390 - protein, 9 aa, BK virus
YKKKGHREE

SEQ ID NO: 5391 - protein, 9 aa, BK virus
KKKGHREEL

SEQ ID NO: 5392 - protein, 9 aa, BK virus
KKGHREELL

SEQ ID NO: 5393 - protein, 9 aa, BK virus
KGHREELLT

SEQ ID NO: 5394 - protein, 9 aa, BK virus
GHREELLTH

SEQ ID NO: 5395 - protein, 9 aa, BK virus
HREELLTHG

SEQ ID NO: 5396 - protein, 9 aa, BK virus
REELLTHGM

SEQ ID NO: 5397 - protein, 9 aa, BK virus
EELLTHGMQ

SEQ ID NO: 5398 - protein, 9 aa, BK virus
ELLTHGMQP

SEQ ID NO: 5399 - protein, 9 aa, BK virus
LLTHGMQPN

SEQ ID NO: 5400 - protein, 9 aa, BK virus
LTHGMQPNH

SEQ ID NO: 5401 - protein, 9 aa, BK virus
THGMQPNHD

SEQ ID NO: 5402 - protein, 9 aa, BK virus
HGMQPNHDL

SEQ ID NO: 5403 - protein, 9 aa, BK virus
GMQPNHDLR

SEQ ID NO: 5404 - protein, 9 aa, BK virus
MQPNHDLRK

SEQ ID NO: 5405 - protein, 9 aa, BK virus
QPNHDLRKE

SEQ ID NO: 5406 - protein, 9 aa, BK virus
PNHDLRKES

SEQ ID NO: 5407 - protein, 9 aa, BK virus
NHDLRKESA

SEQ ID NO: 5408 - protein, 9 aa, BK virus
LTGECSQTM

SEQ ID NO: 5409 - protein, 9 aa, BK virus
TGECSQTMT

SEQ ID NO: 5410 - protein, 9 aa, BK virus
GECSQTMTS

SEQ ID NO: 5411 - protein, 9 aa, BK virus
ECSQTMTSG

SEQ ID NO: 5412 - protein, 9 aa, BK virus
CSQTMTSGR

SEQ ID NO: 5413 - protein, 9 aa, BK virus
SQTMTSGRK

SEQ ID NO: 5414 - protein, 9 aa, BK virus
QTMTSGRKV

SEQ ID NO: 5415 - protein, 9 aa, BK virus
TMTSGRKVH

SEQ ID NO: 5416 - protein, 9 aa, BK virus
MTSGRKVHD

SEQ ID NO: 5417 - protein, 9 aa, BK virus
TSGRKVHDS

SEQ ID NO: 5418 - protein, 9 aa, BK virus
SGRKVHDSQ

SEQ ID NO: 5419 - protein, 9 aa, BK virus
GRKVHDSQG

SEQ ID NO: 5420 - protein, 9 aa, BK virus
RKVHDSQGG

SEQ ID NO: 5421 - protein, 9 aa, BK virus
KVHDSQGGA

SEQ ID NO: 5422 - protein, 9 aa, BK virus
VHDSQGGAA

SEQ ID NO: 5423 - protein, 9 aa, BK virus
HDSQGGAAY

SEQ ID NO: 5424 - protein, 9 aa, BK virus
DSQGGAAYP

SEQ ID NO: 5425 - protein, 9 aa, BK virus
SQGGAAYPW

SEQ ID NO: 5426 - protein, 9 aa, BK virus
QGGAAYPWN

SEQ ID NO: 5427 - protein, 9 aa, BK virus
GGAAYPWNA

SEQ ID NO: 5428 - protein, 9 aa, BK virus
GAAYPWNAA

SEQ ID NO: 5429 - protein, 9 aa, BK virus
AAYPWNAAK

SEQ ID NO: 5430 - protein, 9 aa, BK virus
AYPWNAAKP

SEQ ID NO: 5431 - protein, 9 aa, BK virus
PQEGKCMTD

SEQ ID NO: 5432 - protein, 9 aa, BK virus
QEGKCMTDM

SEQ ID NO: 5433 - protein, 9 aa, BK virus
EGKCMTDMF

SEQ ID NO: 5434 - protein, 9 aa, BK virus
GKCMTDMFC

SEQ ID NO: 5435 - protein, 9 aa, BK virus
KCMTDMFCE

SEQ ID NO: 5436 - protein, 9 aa, BK virus
CMTDMFCEP

SEQ ID NO: 5437 - protein, 9 aa, BK virus
MTDMFCEPR

SEQ ID NO: 5438 - protein, 9 aa, BK virus
TDMFCEPRN

SEQ ID NO: 5439 - protein, 9 aa, BK virus
DMFCEPRNL

SEQ ID NO: 5440 - protein, 9 aa, BK virus
MFCEPRNLG

SEQ ID NO: 5441 - protein, 9 aa, BK virus
FCEPRNLGL

SEQ ID NO: 5442 - protein, 9 aa, BK virus
CEPRNLGLV

SEQ ID NO: 5443 - protein, 9 aa, BK virus
EPRNLGLVP

SEQ ID NO: 5444 - protein, 9 aa, BK virus
PRNLGLVPS

SEQ ID NO: 5445 - protein, 9 aa, BK virus
TGQRPWFCA

SEQ ID NO: 5446 - protein, 9 aa, BK virus
GQRPWFCAS

SEQ ID NO: 5447 - protein, 9 aa, BK virus
QRPWFCASC

SEQ ID NO: 5448 - protein, 9 aa, BK virus
RPWFCASCH

SEQ ID NO: 5449 - protein, 9 aa, BK virus
PWFCASCHD

SEQ ID NO: 5450 - protein, 9 aa, BK virus
WFCASCHDK

SEQ ID NO: 5451 - protein, 9 aa, BK virus
FCASCHDKL

SEQ ID NO: 5452 - protein, 9 aa, BK virus
CASCHDKLQ

SEQ ID NO: 5453 - protein, 9 aa, BK virus
KLVKPGLEQ

SEQ ID NO: 5454 - protein, 9 aa, BK virus
LVKPGLEQK

SEQ ID NO: 5455 - protein, 9 aa, BK virus
VKPGLEQKK

SEQ ID NO: 5456 - protein, 9 aa, BK virus
KPGLEQKKE

SEQ ID NO: 5457 - protein, 9 aa, BK virus
PGLEQKKEL

SEQ ID NO: 5458 - protein, 9 aa, BK virus
GLEQKKELR

SEQ ID NO: 5459 - protein, 9 aa, BK virus
LEQKKELRG

SEQ ID NO: 5460 - protein, 9 aa, BK virus
EQKKELRGF

SEQ ID NO: 5461 - protein, 9 aa, BK virus
QKKELRGFL

SEQ ID NO: 5462 - protein, 9 aa, BK virus
KKELRGFLF

SEQ ID NO: 5463 - protein, 9 aa, BK virus
KELRGFLFL

SEQ ID NO: 5464 - protein, 9 aa, BK virus
ELRGFLFLF

SEQ ID NO: 5465 - protein, 9 aa, BK virus
SFCWNFVEV

SEQ ID NO: 5466 - protein, 9 aa, BK virus
FCWNFVEVK

SEQ ID NO: 5467 - protein, 9 aa, BK virus
CWNFVEVKT

SEQ ID NO: 5468 - protein, 9 aa, BK virus
WNFVEVKTV

SEQ ID NO: 5469 - protein, 9 aa, BK virus
TGKTKVPLL

SEQ ID NO: 5470 - protein, 9 aa, BK virus
GKTKVPLLY

SEQ ID NO: 5471 - protein, 9 aa, BK virus
KTKVPLLYL

SEQ ID NO: 5472 - protein, 9 aa, BK virus
TKVPLLYLL

SEQ ID NO: 5473 - protein, 9 aa, BK virus
VIPFFLYFQ

SEQ ID NO: 5474 - protein, 9 aa, BK virus
IPFFLYFQV

SEQ ID NO: 5475 - protein, 9 aa, BK virus
PFFLYFQVH

SEQ ID NO: 5476 - protein, 9 aa, BK virus
FFLYFQVHG

SEQ ID NO: 5477 - protein, 9 aa, BK virus
FLYFQVHGC

SEQ ID NO: 5478 - protein, 9 aa, BK virus
LYFQVHGCC

SEQ ID NO: 5479 - protein, 9 aa, BK virus
YFQVHGCCS

SEQ ID NO: 5480 - protein, 9 aa, BK virus
FQVHGCCSS

SEQ ID NO: 5481 - protein, 9 aa, BK virus
QVHGCCSST

SEQ ID NO: 5482 - protein, 9 aa, BK virus
VHGCCSSTF

SEQ ID NO: 5483 - protein, 9 aa, BK virus
HGCCSSTFG

SEQ ID NO: 5484 - protein, 9 aa, BK virus
GCCSSTFGG

SEQ ID NO: 5485 - protein, 9 aa, BK virus
CCSSTFGGP

SEQ ID NO: 5486 - protein, 9 aa, BK virus
CSSTFGGPS

SEQ ID NO: 5487 - protein, 9 aa, BK virus
SSTFGGPSC

SEQ ID NO: 5488 - protein, 9 aa, BK virus
STFGGPSCQ

SEQ ID NO: 5489 - protein, 9 aa, BK virus
TFGGPSCQC

SEQ ID NO: 5490 - protein, 9 aa, BK virus
FGGPSCQCI

SEQ ID NO: 5491 - protein, 9 aa, BK virus
GCCCHRIFS

SEQ ID NO: 5492 - protein, 9 aa, BK virus
CCCHRIFSG

SEQ ID NO: 5493 - protein, 9 aa, BK virus
NCCWGGCCC

SEQ ID NO: 5494 - protein, 9 aa, BK virus
CCWGGCCCY

SEQ ID NO: 5495 - protein, 9 aa, BK virus
CWGGCCCYR

SEQ ID NO: 5496 - protein, 9 aa, BK virus
WGGCCCYRS

SEQ ID NO: 5497 - protein, 9 aa, BK virus
GGCCCYRSS

SEQ ID NO: 5498 - protein, 9 aa, BK virus
GCCCYRSSN

SEQ ID NO: 5499 - protein, 9 aa, BK virus
CCCYRSSNC

SEQ ID NO: 5500 - protein, 9 aa, BK virus
CCYRSSNCI

SEQ ID NO: 5501 - protein, 9 aa, BK virus
CYRSSNCIP

SEQ ID NO: 5502 - protein, 9 aa, BK virus
YRSSNCIPC

SEQ ID NO: 5503 - protein, 9 aa, BK virus
RSSNCIPCY

SEQ ID NO: 5504 - protein, 9 aa, BK virus
SSNCIPCYC

SEQ ID NO: 5505 - protein, 9 aa, BK virus
SNCIPCYCR

SEQ ID NO: 5506 - protein, 9 aa, BK virus
NCIPCYCRG

SEQ ID NO: 5507 - protein, 9 aa, BK virus
CIPCYCRGH

SEQ ID NO: 5508 - protein, 9 aa, BK virus
IPCYCRGHN

SEQ ID NO: 5509 - protein, 9 aa, BK virus
PCYCRGHNK

SEQ ID NO: 5510 - protein, 9 aa, BK virus
CYCRGHNKY

SEQ ID NO: 5511 - protein, 9 aa, BK virus
YCRGHNKYL

SEQ ID NO: 5512 - protein, 9 aa, BK virus
CRGHNKYLR

SEQ ID NO: 5513 - protein, 9 aa, BK virus
RGHNKYLRG

SEQ ID NO: 5514 - protein, 9 aa, BK virus
GHNKYLRGY

SEQ ID NO: 5515 - protein, 9 aa, BK virus
HNKYLRGYS

SEQ ID NO: 5516 - protein, 9 aa, BK virus
NKYLRGYSC

SEQ ID NO: 5517 - protein, 9 aa, BK virus
KYLRGYSCY

SEQ ID NO: 5518 - protein, 9 aa, BK virus
YLRGYSCYR

SEQ ID NO: 5519 - protein, 9 aa, BK virus
LRGYSCYRP

SEQ ID NO: 5520 - protein, 9 aa, BK virus
RGYSCYRPN

SEQ ID NO: 5521 - protein, 9 aa, BK virus
GYSCYRPNS

SEQ ID NO: 5522 - protein, 9 aa, BK virus
YSCYRPNSS

SEQ ID NO: 5523 - protein, 9 aa, BK virus
SCYRPNSSN

SEQ ID NO: 5524 - protein, 9 aa, BK virus
CYRPNSSNI

SEQ ID NO: 5525 - protein, 9 aa, BK virus
YRPNSSNIC

SEQ ID NO: 5526 - protein, 9 aa, BK virus
RPNSSNICC

SEQ ID NO: 5527 - protein, 9 aa, BK virus
PNSSNICCN

SEQ ID NO: 5528 - protein, 9 aa, BK virus
NSSNICCNC

SEQ ID NO: 5529 - protein, 9 aa, BK virus
SSNICCNCW

SEQ ID NO: 5530 - protein, 9 aa, BK virus
SNICCNCWC

SEQ ID NO: 5531 - protein, 9 aa, BK virus
NICCNCWCS

SEQ ID NO: 5532 - protein, 9 aa, BK virus
ICCNCWCSW

SEQ ID NO: 5533 - protein, 9 aa, BK virus
CCNCWCSWG

SEQ ID NO: 5534 - protein, 9 aa, BK virus
CNCWCSWGY

SEQ ID NO: 5535 - protein, 9 aa, BK virus
NCWCSWGYC

SEQ ID NO: 5536 - protein, 9 aa, BK virus
CWCSWGYCW

SEQ ID NO: 5537 - protein, 9 aa, BK virus
WCSWGYCWV

SEQ ID NO: 5538 - protein, 9 aa, BK virus
CSWGYCWVC

SEQ ID NO: 5539 - protein, 9 aa, BK virus
SWGYCWVCC

SEQ ID NO: 5540 - protein, 9 aa, BK virus
WGYCWVCCF

SEQ ID NO: 5541 - protein, 9 aa, BK virus
GYCWVCCFN

SEQ ID NO: 5542 - protein, 9 aa, BK virus
YCWVCCFNS

SEQ ID NO: 5543 - protein, 9 aa, BK virus
CWVCCFNSN

SEQ ID NO: 5544 - protein, 9 aa, BK virus
WVCCFNSNC

SEQ ID NO: 5545 - protein, 9 aa, BK virus
LGSQSFHCR

SEQ ID NO: 5546 - protein, 9 aa, BK virus
GSQSFHCRP

SEQ ID NO: 5547 - protein, 9 aa, BK virus
SQSFHCRPL

SEQ ID NO: 5548 - protein, 9 aa, BK virus
QSFHCRPLS

SEQ ID NO: 5549 - protein, 9 aa, BK virus
SFHCRPLSA

SEQ ID NO: 5550 - protein, 9 aa, BK virus
FHCRPLSAI

SEQ ID NO: 5551 - protein, 9 aa, BK virus
HCRPLSAIR

SEQ ID NO: 5552 - protein, 9 aa, BK virus
CRPLSAIRH

SEQ ID NO: 5553 - protein, 9 aa, BK virus
RPLSAIRHG

SEQ ID NO: 5554 - protein, 9 aa, BK virus
PLSAIRHGF

SEQ ID NO: 5555 - protein, 9 aa, BK virus
LSAIRHGFG

SEQ ID NO: 5556 - protein, 9 aa, BK virus
SAIRHGFGI

SEQ ID NO: 5557 - protein, 9 aa, BK virus
AIRHGFGIV

SEQ ID NO: 5558 - protein, 9 aa, BK virus
YSVSWCKYF

SEQ ID NO: 5559 - protein, 9 aa, BK virus
SVSWCKYFC

SEQ ID NO: 5560 - protein, 9 aa, BK virus
ALGSFFVCY

SEQ ID NO: 5561 - protein, 9 aa, BK virus
LGSFFVCYY

SEQ ID NO: 5562 - protein, 9 aa, BK virus
GSFFVCYYF

SEQ ID NO: 5563 - protein, 9 aa, BK virus
SFFVCYYFP

SEQ ID NO: 5564 - protein, 9 aa, BK virus
FFVCYYFPG

SEQ ID NO: 5565 - protein, 9 aa, BK virus
FVCYYFPGF

SEQ ID NO: 5566 - protein, 9 aa, BK virus
VCYYFPGFV

SEQ ID NO: 5567 - protein, 9 aa, BK virus
CYYFPGFVA

SEQ ID NO: 5568 - protein, 9 aa, BK virus
YYFPGFVAC

SEQ ID NO: 5569 - protein, 9 aa, BK virus
YFPGFVACY

SEQ ID NO: 5570 - protein, 9 aa, BK virus
YTFYNLTGI

SEQ ID NO: 5571 - protein, 9 aa, BK virus
TFYNLTGIA

SEQ ID NO: 5572 - protein, 9 aa, BK virus
FYNLTGIAE

SEQ ID NO: 5573 - protein, 9 aa, BK virus
YNLTGIAEK

SEQ ID NO: 5574 - protein, 9 aa, BK virus
NLTGIAEKN

SEQ ID NO: 5575 - protein, 9 aa, BK virus
LTGIAEKNR

SEQ ID NO: 5576 - protein, 9 aa, BK virus
TGIAEKNRK

SEQ ID NO: 5577 - protein, 9 aa, BK virus
GIAEKNRKI

SEQ ID NO: 5578 - protein, 9 aa, BK virus
IAEKNRKIF

SEQ ID NO: 5579 - protein, 9 aa, BK virus
IFGGNYLDN

SEQ ID NO: 5580 - protein, 9 aa, BK virus
FGGNYLDNC

SEQ ID NO: 5581 - protein, 9 aa, BK virus
GGNYLDNCK

SEQ ID NO: 5582 - protein, 9 aa, BK virus
GNYLDNCKC

SEQ ID NO: 5583 - protein, 9 aa, BK virus
NYLDNCKCP

SEQ ID NO: 5584 - protein, 9 aa, BK virus
YLDNCKCPY

SEQ ID NO: 5585 - protein, 9 aa, BK virus
LDNCKCPYK

SEQ ID NO: 5586 - protein, 9 aa, BK virus
DNCKCPYKL

SEQ ID NO: 5587 - protein, 9 aa, BK virus
NCKCPYKLL

SEQ ID NO: 5588 - protein, 9 aa, BK virus
KGRYPCTFW

SEQ ID NO: 5589 - protein, 9 aa, BK virus
GRYPCTFWP

SEQ ID NO: 5590 - protein, 9 aa, BK virus
RYPCTFWPY

SEQ ID NO: 5591 - protein, 9 aa, BK virus
YPCTFWPYL

SEQ ID NO: 5592 - protein, 9 aa, BK virus
QYRRSYTKN

SEQ ID NO: 5593 - protein, 9 aa, BK virus
YRRSYTKNG

SEQ ID NO: 5594 - protein, 9 aa, BK virus
RRSYTKNGL

SEQ ID NO: 5595 - protein, 9 aa, BK virus
RSYTKNGLK

SEQ ID NO: 5596 - protein, 9 aa, BK virus
SYTKNGLKK

SEQ ID NO: 5597 - protein, 9 aa, BK virus
YTKNGLKKS

SEQ ID NO: 5598 - protein, 9 aa, BK virus
TKNGLKKST

SEQ ID NO: 5599 - protein, 9 aa, BK virus
KNGLKKSTK

SEQ ID NO: 5600 - protein, 9 aa, BK virus
NGLKKSTKC

SEQ ID NO: 5601 - protein, 9 aa, BK virus
GLKKSTKCT

SEQ ID NO: 5602 - protein, 9 aa, BK virus
LKKSTKCTF

SEQ ID NO: 5603 - protein, 9 aa, BK virus
KKSTKCTFR

SEQ ID NO: 5604 - protein, 9 aa, BK virus
KSTKCTFRR

SEQ ID NO: 5605 - protein, 9 aa, BK virus
STKCTFRRV

SEQ ID NO: 5606 - protein, 9 aa, BK virus
TKCTFRRVY

SEQ ID NO: 5607 - protein, 9 aa, BK virus
KCTFRRVYR

SEQ ID NO: 5608 - protein, 9 aa, BK virus
CTFRRVYRK

SEQ ID NO: 5609 - protein, 9 aa, BK virus
TFRRVYRKN

SEQ ID NO: 5610 - protein, 9 aa, BK virus
FRRVYRKNY

SEQ ID NO: 5611 - protein, 9 aa, BK virus
RRVYRKNYC

SEQ ID NO: 5612 - protein, 9 aa, BK virus
RVYRKNYCP

SEQ ID NO: 5613 - protein, 9 aa, BK virus
VYRKNYCPR

SEQ ID NO: 5614 - protein, 9 aa, BK virus
YRKNYCPRR

SEQ ID NO: 5615 - protein, 9 aa, BK virus
RKNYCPRRC

SEQ ID NO: 5616 - protein, 9 aa, BK virus
SKNCSSMDV

SEQ ID NO: 5617 - protein, 9 aa, BK virus
KNCSSMDVA

SEQ ID NO: 5618 - protein, 9 aa, BK virus
NCSSMDVAF

SEQ ID NO: 5619 - protein, 9 aa, BK virus
CSSMDVAFT

SEQ ID NO: 5620 - protein, 9 aa, BK virus
SSMDVAFTS

SEQ ID NO: 5621 - protein, 9 aa, BK virus
SMDVAFTSR

SEQ ID NO: 5622 - protein, 9 aa, BK virus
MDVAFTSRP

SEQ ID NO: 5623 - protein, 9 aa, BK virus
DVAFTSRPV

SEQ ID NO: 5624 - protein, 9 aa, BK virus
VAFTSRPVR

SEQ ID NO: 5625 - protein, 9 aa, BK virus
AFTSRPVRD

SEQ ID NO: 5626 - protein, 9 aa, BK virus
FTSRPVRDC

SEQ ID NO: 5627 - protein, 9 aa, BK virus
TSRPVRDCN

SEQ ID NO: 5628 - protein, 9 aa, BK virus
SRPVRDCNT

SEQ ID NO: 5629 - protein, 9 aa, BK virus
RPVRDCNTC

SEQ ID NO: 5630 - protein, 9 aa, BK virus
PVRDCNTCS

SEQ ID NO: 5631 - protein, 9 aa, BK virus
RWPQPKEKE

SEQ ID NO: 5632 - protein, 9 aa, BK virus
WPQPKEKES

SEQ ID NO: 5633 - protein, 9 aa, BK virus
PQPKEKESV

SEQ ID NO: 5634 - protein, 9 aa, BK virus
QPKEKESVQ

SEQ ID NO: 5635 - protein, 9 aa, BK virus
PKEKESVQG

SEQ ID NO: 5636 - protein, 9 aa, BK virus
KEKESVQGQ

SEQ ID NO: 5637 - protein, 9 aa, BK virus
EKESVQGQL

SEQ ID NO: 5638 - protein, 9 aa, BK virus
KESVQGQLP

SEQ ID NO: 5639 - protein, 9 aa, BK virus
ESVQGQLPK

SEQ ID NO: 5640 - protein, 9 aa, BK virus
SVQGQLPKS

SEQ ID NO: 5641 - protein, 9 aa, BK virus
VQGQLPKSQ

SEQ ID NO: 5642 - protein, 9 aa, BK virus
QGQLPKSQR

SEQ ID NO: 5643 - protein, 9 aa, BK virus
GQLPKSQRN

SEQ ID NO: 5644 - protein, 9 aa, BK virus
QLPKSQRNP

SEQ ID NO: 5645 - protein, 9 aa, BK virus
LPKSQRNPC

SEQ ID NO: 5646 - protein, 9 aa, BK virus
PKSQRNPCK

SEQ ID NO: 5647 - protein, 9 aa, BK virus
KSQRNPCKC

SEQ ID NO: 5648 - protein, 9 aa, BK virus
SQRNPCKCQ

SEQ ID NO: 5649 - protein, 9 aa, BK virus
QRNPCKCQN

SEQ ID NO: 5650 - protein, 9 aa, BK virus
RNPCKCQNY

SEQ ID NO: 5651 - protein, 9 aa, BK virus
TQKWGIQMK

SEQ ID NO: 5652 - protein, 9 aa, BK virus
QKWGIQMKT

SEQ ID NO: 5653 - protein, 9 aa, BK virus
KWGIQMKTL

SEQ ID NO: 5654 - protein, 9 aa, BK virus
WGIQMKTLG

SEQ ID NO: 5655 - protein, 9 aa, BK virus
GIQMKTLGA

SEQ ID NO: 5656 - protein, 9 aa, BK virus
IQMKTLGAL

SEQ ID NO: 5657 - protein, 9 aa, BK virus
QMKTLGALV

SEQ ID NO: 5658 - protein, 9 aa, BK virus
VLKMTLAVI

SEQ ID NO: 5659 - protein, 9 aa, BK virus
LKMTLAVIA

SEQ ID NO: 5660 - protein, 9 aa, BK virus
KMTLAVIAQ

SEQ ID NO: 5661 - protein, 9 aa, BK virus
MTLAVIAQR

SEQ ID NO: 5662 - protein, 9 aa, BK virus
TLAVIAQRE

SEQ ID NO: 5663 - protein, 9 aa, BK virus
LAVIAQREK

SEQ ID NO: 5664 - protein, 9 aa, BK virus
AVIAQREKC

SEQ ID NO: 5665 - protein, 9 aa, BK virus
VIAQREKCF

SEQ ID NO: 5666 - protein, 9 aa, BK virus
IAQREKCFP

SEQ ID NO: 5667 - protein, 9 aa, BK virus
AQREKCFPV

SEQ ID NO: 5668 - protein, 9 aa, BK virus
QREKCFPVT

SEQ ID NO: 5669 - protein, 9 aa, BK virus
REKCFPVTA

SEQ ID NO: 5670 - protein, 9 aa, BK virus
EKCFPVTAQ

SEQ ID NO: 5671 - protein, 9 aa, BK virus
KCFPVTAQQ

SEQ ID NO: 5672 - protein, 9 aa, BK virus
CFPVTAQQE

SEQ ID NO: 5673 - protein, 9 aa, BK virus
FPVTAQQEF

SEQ ID NO: 5674 - protein, 9 aa, BK virus
PVTAQQEFP

SEQ ID NO: 5675 - protein, 9 aa, BK virus
VTAQQEFPS

SEQ ID NO: 5676 - protein, 9 aa, BK virus
TAQQEFPSP

SEQ ID NO: 5677 - protein, 9 aa, BK virus
AQQEFPSPI

SEQ ID NO: 5678 - protein, 9 aa, BK virus
LACLTFMQG

SEQ ID NO: 5679 - protein, 9 aa, BK virus
ACLTFMQGH

SEQ ID NO: 5680 - protein, 9 aa, BK virus
CLTFMQGHK

SEQ ID NO: 5681 - protein, 9 aa, BK virus
LTFMQGHKK

SEQ ID NO: 5682 - protein, 9 aa, BK virus
TFMQGHKKC

SEQ ID NO: 5683 - protein, 9 aa, BK virus
FMQGHKKCM

SEQ ID NO: 5684 - protein, 9 aa, BK virus
MQGHKKCMS

SEQ ID NO: 5685 - protein, 9 aa, BK virus
QGHKKCMSM

SEQ ID NO: 5686 - protein, 9 aa, BK virus
GHKKCMSMV

SEQ ID NO: 5687 - protein, 9 aa, BK virus
HKKCMSMVE

SEQ ID NO: 5688 - protein, 9 aa, BK virus
KKCMSMVEE

SEQ ID NO: 5689 - protein, 9 aa, BK virus
KCMSMVEEN

SEQ ID NO: 5690 - protein, 9 aa, BK virus
CMSMVEENL

SEQ ID NO: 5691 - protein, 9 aa, BK virus
MSMVEENLF

SEQ ID NO: 5692 - protein, 9 aa, BK virus
SMVEENLFK

SEQ ID NO: 5693 - protein, 9 aa, BK virus
MVEENLFKA

SEQ ID NO: 5694 - protein, 9 aa, BK virus
VEENLFKAV

SEQ ID NO: 5695 - protein, 9 aa, BK virus
EENLFKAVI

SEQ ID NO: 5696 - protein, 9 aa, BK virus
ENLFKAVIS

SEQ ID NO: 5697 - protein, 9 aa, BK virus
NLFKAVIST

SEQ ID NO: 5698 - protein, 9 aa, BK virus
LFKAVISTS

SEQ ID NO: 5699 - protein, 9 aa, BK virus
FKAVISTSL

SEQ ID NO: 5700 - protein, 9 aa, BK virus
KAVISTSLL

SEQ ID NO: 5701 - protein, 9 aa, BK virus
VENPWKCRE

SEQ ID NO: 5702 - protein, 9 aa, BK virus
ENPWKCREC

SEQ ID NO: 5703 - protein, 9 aa, BK virus
ITGQSTLMV

SEQ ID NO: 5704 - protein, 9 aa, BK virus
TGQSTLMVL

SEQ ID NO: 5705 - protein, 9 aa, BK virus
PLKTQQPSP

SEQ ID NO: 5706 - protein, 9 aa, BK virus
LKTQQPSPR

SEQ ID NO: 5707 - protein, 9 aa, BK virus
ILTIRPIWT

SEQ ID NO: 5708 - protein, 9 aa, BK virus
LTIRPIWTK

SEQ ID NO: 5709 - protein, 9 aa, BK virus
TIRPIWTKT

SEQ ID NO: 5710 - protein, 9 aa, BK virus
IRPIWTKTM

SEQ ID NO: 5711 - protein, 9 aa, BK virus
RPIWTKTML

SEQ ID NO: 5712 - protein, 9 aa, BK virus
PIWTKTMLI

SEQ ID NO: 5713 - protein, 9 aa, BK virus
IWTKTMLIQ

SEQ ID NO: 5714 - protein, 9 aa, BK virus
WTKTMLIQL

SEQ ID NO: 5715 - protein, 9 aa, BK virus
TKTMLIQLS

SEQ ID NO: 5716 - protein, 9 aa, BK virus
KTMLIQLSA

SEQ ID NO: 5717 - protein, 9 aa, BK virus
TMLIQLSAG

SEQ ID NO: 5718 - protein, 9 aa, BK virus
MLIQLSAGY

SEQ ID NO: 5719 - protein, 9 aa, BK virus
LIQLSAGYL

SEQ ID NO: 5720 - protein, 9 aa, BK virus
IQLSAGYLI

SEQ ID NO: 5721 - protein, 9 aa, BK virus
QLSAGYLIP

SEQ ID NO: 5722 - protein, 9 aa, BK virus
LSAGYLIPV

SEQ ID NO: 5723 - protein, 9 aa, BK virus
SAGYLIPVE

SEQ ID NO: 5724 - protein, 9 aa, BK virus
AGYLIPVEM

SEQ ID NO: 5725 - protein, 9 aa, BK virus
GYLIPVEMK

SEQ ID NO: 5726 - protein, 9 aa, BK virus
YLIPVEMKM

SEQ ID NO: 5727 - protein, 9 aa, BK virus
LIPVEMKML

SEQ ID NO: 5728 - protein, 9 aa, BK virus
IPVEMKMLG

SEQ ID NO: 5729 - protein, 9 aa, BK virus
PVEMKMLGI

SEQ ID NO: 5730 - protein, 9 aa, BK virus
VEMKMLGIL

SEQ ID NO: 5731 - protein, 9 aa, BK virus
EMKMLGILG

SEQ ID NO: 5732 - protein, 9 aa, BK virus
MKMLGILGL

SEQ ID NO: 5733 - protein, 9 aa, BK virus
KMLGILGLS

SEQ ID NO: 5734 - protein, 9 aa, BK virus
MLGILGLSQ

SEQ ID NO: 5735 - protein, 9 aa, BK virus
LGILGLSQE

SEQ ID NO: 5736 - protein, 9 aa, BK virus
GILGLSQEG

SEQ ID NO: 5737 - protein, 9 aa, BK virus
ILGLSQEGK

SEQ ID NO: 5738 - protein, 9 aa, BK virus
LGLSQEGKM

SEQ ID NO: 5739 - protein, 9 aa, BK virus
GLSQEGKMF

SEQ ID NO: 5740 - protein, 9 aa, BK virus
LSQEGKMFP

SEQ ID NO: 5741 - protein, 9 aa, BK virus
SQEGKMFPQ

SEQ ID NO: 5742 - protein, 9 aa, BK virus
QEGKMFPQY

SEQ ID NO: 5743 - protein, 9 aa, BK virus
EGKMFPQYF

SEQ ID NO: 5744 - protein, 9 aa, BK virus
GKMFPQYFM

SEQ ID NO: 5745 - protein, 9 aa, BK virus
MNRVWGLFV

SEQ ID NO: 5746 - protein, 9 aa, BK virus
NRVWGLFVK

SEQ ID NO: 5747 - protein, 9 aa, BK virus
RVWGLFVKL

SEQ ID NO: 5748 - protein, 9 aa, BK virus
VWGLFVKLI

SEQ ID NO: 5749 - protein, 9 aa, BK virus
WGLFVKLIA

SEQ ID NO: 5750 - protein, 9 aa, BK virus
GLFVKLIAC

SEQ ID NO: 5751 - protein, 9 aa, BK virus
LFVKLIACM

SEQ ID NO: 5752 - protein, 9 aa, BK virus
FVKLIACMF

SEQ ID NO: 5753 - protein, 9 aa, BK virus
VKLIACMFQ

SEQ ID NO: 5754 - protein, 9 aa, BK virus
KLIACMFQL

SEQ ID NO: 5755 - protein, 9 aa, BK virus
LIACMFQLL

SEQ ID NO: 5756 - protein, 9 aa, BK virus
IACMFQLLI

SEQ ID NO: 5757 - protein, 9 aa, BK virus
ACMFQLLIF

SEQ ID NO: 5758 - protein, 9 aa, BK virus
CMFQLLIFV

SEQ ID NO: 5759 - protein, 9 aa, BK virus
MFQLLIFVA

SEQ ID NO: 5760 - protein, 9 aa, BK virus
FQLLIFVAC

SEQ ID NO: 5761 - protein, 9 aa, BK virus
QLLIFVACL

SEQ ID NO: 5762 - protein, 9 aa, BK virus
LLIFVACLL

SEQ ID NO: 5763 - protein, 9 aa, BK virus
LIFVACLLT

SEQ ID NO: 5764 - protein, 9 aa, BK virus
IFVACLLTA

SEQ ID NO: 5765 - protein, 9 aa, BK virus
FVACLLTAL

SEQ ID NO: 5766 - protein, 9 aa, BK virus
VACLLTALE

SEQ ID NO: 5767 - protein, 9 aa, BK virus
ACLLTALEH

SEQ ID NO: 5768 - protein, 9 aa, BK virus
CLLTALEHN

SEQ ID NO: 5769 - protein, 9 aa, BK virus
LLTALEHNS

SEQ ID NO: 5770 - protein, 9 aa, BK virus
LTALEHNSG

SEQ ID NO: 5771 - protein, 9 aa, BK virus
TALEHNSGE

SEQ ID NO: 5772 - protein, 9 aa, BK virus
ALEHNSGEA

SEQ ID NO: 5773 - protein, 9 aa, BK virus
LEHNSGEAL

SEQ ID NO: 5774 - protein, 9 aa, BK virus
EHNSGEALQ

SEQ ID NO: 5775 - protein, 9 aa, BK virus
HNSGEALQD

SEQ ID NO: 5776 - protein, 9 aa, BK virus
NSGEALQDI

SEQ ID NO: 5777 - protein, 9 aa, BK virus
SGEALQDIL

SEQ ID NO: 5778 - protein, 9 aa, BK virus
GEALQDILR

SEQ ID NO: 5779 - protein, 9 aa, BK virus
EALQDILRS

SEQ ID NO: 5780 - protein, 9 aa, BK virus
ALQDILRSA

SEQ ID NO: 5781 - protein, 9 aa, BK virus
RILTQFPFC

SEQ ID NO: 5782 - protein, 9 aa, BK virus
TGEPREWMG

SEQ ID NO: 5783 - protein, 9 aa, BK virus
GEPREWMGS

SEQ ID NO: 5784 - protein, 9 aa, BK virus
EPREWMGSL

SEQ ID NO: 5785 - protein, 9 aa, BK virus
PREWMGSLC

SEQ ID NO: 5786 - protein, 9 aa, BK virus
REWMGSLCM

SEQ ID NO: 5787 - protein, 9 aa, BK virus
EWMGSLCMV

SEQ ID NO: 5788 - protein, 9 aa, BK virus
WMGSLCMVW

SEQ ID NO: 5789 - protein, 9 aa, BK virus
MGSLCMVWN

SEQ ID NO: 5790 - protein, 9 aa, BK virus
GSLCMVWNP

SEQ ID NO: 5791 - protein, 9 aa, BK virus
SLCMVWNPR

SEQ ID NO: 5792 - protein, 9 aa, BK virus
KRLGCLMAQ

SEQ ID NO: 5793 - protein, 9 aa, BK virus
RLGCLMAQK

SEQ ID NO: 5794 - protein, 9 aa, BK virus
LGCLMAQKD

SEQ ID NO: 5795 - protein, 9 aa, BK virus
GCLMAQKDF

SEQ ID NO: 5796 - protein, 9 aa, BK virus
CLMAQKDFQ

SEQ ID NO: 5797 - protein, 9 aa, BK virus
LMAQKDFQG

SEQ ID NO: 5798 - protein, 9 aa, BK virus
MAQKDFQGT

SEQ ID NO: 5799 - protein, 9 aa, BK virus
AQKDFQGTQ

SEQ ID NO: 5800 - protein, 9 aa, BK virus
QKDFQGTQI

SEQ ID NO: 5801 - protein, 9 aa, BK virus
DILTNRDNC

SEQ ID NO: 5802 - protein, 9 aa, BK virus
ILTNRDNCK

SEQ ID NO: 5803 - protein, 9 aa, BK virus
LTNRDNCKP

SEQ ID NO: 5804 - protein, 9 aa, BK virus
TNRDNCKPK

SEQ ID NO: 5805 - protein, 9 aa, BK virus
NRDNCKPKC

SEQ ID NO: 5806 - protein, 9 aa, BK virus
RDNCKPKCF

SEQ ID NO: 5807 - protein, 9 aa, BK virus
DNCKPKCFK

SEQ ID NO: 5808 - protein, 9 aa, BK virus
NCKPKCFKQ

SEQ ID NO: 5809 - protein, 9 aa, BK virus
CKPKCFKQV

SEQ ID NO: 5810 - protein, 9 aa, BK virus
KPKCFKQVL

SEQ ID NO: 5811 - protein, 9 aa, BK virus
PKCFKQVLL

SEQ ID NO: 5812 - protein, 9 aa, BK virus
KCFKQVLLL

SEQ ID NO: 5813 - protein, 9 aa, BK virus
CFKQVLLLY

SEQ ID NO: 5814 - protein, 9 aa, BK virus
FKQVLLLYI

SEQ ID NO: 5815 - protein, 9 aa, BK virus
KQVLLLYIY

SEQ ID NO: 5816 - protein, 9 aa, BK virus
QVLLLYIYI

SEQ ID NO: 5817 - protein, 9 aa, BK virus
MLLLYKPLL

SEQ ID NO: 5818 - protein, 9 aa, BK virus
LLLYKPLLS

SEQ ID NO: 5819 - protein, 9 aa, BK virus
LLYKPLLSL

SEQ ID NO: 5820 - protein, 9 aa, BK virus
LYKPLLSLC

SEQ ID NO: 5821 - protein, 9 aa, BK virus
YKPLLSLCY

SEQ ID NO: 5822 - protein, 9 aa, BK virus
KPLLSLCYF

SEQ ID NO: 5823 - protein, 9 aa, BK virus
PLLSLCYFG

SEQ ID NO: 5824 - protein, 9 aa, BK virus
LLSLCYFGG

SEQ ID NO: 5825 - protein, 9 aa, BK virus
LSLCYFGGG

SEQ ID NO: 5826 - protein, 9 aa, BK virus
SLCYFGGGV

SEQ ID NO: 5827 - protein, 9 aa, BK virus
LCYFGGGVL

SEQ ID NO: 5828 - protein, 9 aa, BK virus
CYFGGGVLG

SEQ ID NO: 5829 - protein, 9 aa, BK virus
YFGGGVLGL

SEQ ID NO: 5830 - protein, 9 aa, BK virus
FGGGVLGLL

SEQ ID NO: 5831 - protein, 9 aa, BK virus
GGGVLGLLK

SEQ ID NO: 5832 - protein, 9 aa, BK virus
GGVLGLLKH

SEQ ID NO: 5833 - protein, 9 aa, BK virus
LWGSDLWES

SEQ ID NO: 5834 - protein, 9 aa, BK virus
WGSDLWESS

SEQ ID NO: 5835 - protein, 9 aa, BK virus
GSDLWESSA

SEQ ID NO: 5836 - protein, 9 aa, BK virus
SDLWESSAG

SEQ ID NO: 5837 - protein, 9 aa, BK virus
DLWESSAGA

SEQ ID NO: 5838 - protein, 9 aa, BK virus
LWESSAGAE

SEQ ID NO: 5839 - protein, 9 aa, BK virus
WESSAGAEV

SEQ ID NO: 5840 - protein, 9 aa, BK virus
ESSAGAEVS

SEQ ID NO: 5841 - protein, 9 aa, BK virus
SSAGAEVSE

SEQ ID NO: 5842 - protein, 9 aa, BK virus
SAGAEVSET

SEQ ID NO: 5843 - protein, 9 aa, BK virus
AGAEVSETW

SEQ ID NO: 5844 - protein, 9 aa, BK virus
GAEVSETWE

SEQ ID NO: 5845 - protein, 9 aa, BK virus
AEVSETWEE

SEQ ID NO: 5846 - protein, 9 aa, BK virus
EVSETWEEH

SEQ ID NO: 5847 - protein, 9 aa, BK virus
VSETWEEHC

SEQ ID NO: 5848 - protein, 9 aa, BK virus
SETWEEHCD

SEQ ID NO: 5849 - protein, 9 aa, BK virus
ETWEEHCDW

SEQ ID NO: 5850 - protein, 9 aa, BK virus
TWEEHCDWD

SEQ ID NO: 5851 - protein, 9 aa, BK virus
WEEHCDWDS

SEQ ID NO: 5852 - protein, 9 aa, BK virus
EEHCDWDSV

SEQ ID NO: 5853 - protein, 9 aa, BK virus
EHCDWDSVL

SEQ ID NO: 5854 - protein, 9 aa, BK virus
HCDWDSVLD

SEQ ID NO: 5855 - protein, 9 aa, BK virus
CDWDSVLDP

SEQ ID NO: 5856 - protein, 9 aa, BK virus
DWDSVLDPC

SEQ ID NO: 5857 - protein, 9 aa, BK virus
WDSVLDPCP

SEQ ID NO: 5858 - protein, 9 aa, BK virus
DSVLDPCPE

SEQ ID NO: 5859 - protein, 9 aa, BK virus
SVLDPCPES

SEQ ID NO: 5860 - protein, 9 aa, BK virus
VLDPCPESS

SEQ ID NO: 5861 - protein, 9 aa, BK virus
LDPCPESSV

SEQ ID NO: 5862 - protein, 9 aa, BK virus
DPCPESSVS

SEQ ID NO: 5863 - protein, 9 aa, BK virus
PCPESSVSE

SEQ ID NO: 5864 - protein, 9 aa, BK virus
CPESSVSES

SEQ ID NO: 5865 - protein, 9 aa, BK virus
PESSVSESS

SEQ ID NO: 5866 - protein, 9 aa, BK virus
ESSVSESSS

SEQ ID NO: 5867 - protein, 9 aa, BK virus
SSVSESSSL

SEQ ID NO: 5868 - protein, 9 aa, BK virus
SVSESSSLV

SEQ ID NO: 5869 - protein, 9 aa, BK virus
VSESSSLVI

SEQ ID NO: 5870 - protein, 9 aa, BK virus
SESSSLVIS

SEQ ID NO: 5871 - protein, 9 aa, BK virus
ESSSLVISR

SEQ ID NO: 5872 - protein, 9 aa, BK virus
SSSLVISRI

SEQ ID NO: 5873 - protein, 9 aa, BK virus
SSLVISRIH

SEQ ID NO: 5874 - protein, 9 aa, BK virus
SLVISRIHF

SEQ ID NO: 5875 - protein, 9 aa, BK virus
LVISRIHFP

SEQ ID NO: 5876 - protein, 9 aa, BK virus
VISRIHFPM

SEQ ID NO: 5877 - protein, 9 aa, BK virus
ISRIHFPMH

SEQ ID NO: 5878 - protein, 9 aa, BK virus
SRIHFPMHI

SEQ ID NO: 5879 - protein, 9 aa, BK virus
RIHFPMHIL

SEQ ID NO: 5880 - protein, 9 aa, BK virus
IHFPMHILY

SEQ ID NO: 5881 - protein, 9 aa, BK virus
HFPMHILYF

SEQ ID NO: 5882 - protein, 9 aa, BK virus
FPMHILYFI

SEQ ID NO: 5883 - protein, 9 aa, BK virus
PMHILYFIL

SEQ ID NO: 5884 - protein, 9 aa, BK virus
MHILYFILE

SEQ ID NO: 5885 - protein, 9 aa, BK virus
HILYFILEK

SEQ ID NO: 5886 - protein, 9 aa, BK virus
ILYFILEKV

SEQ ID NO: 5887 - protein, 9 aa, BK virus
LYFILEKVY

SEQ ID NO: 5888 - protein, 9 aa, BK virus
YFILEKVYI

SEQ ID NO: 5889 - protein, 9 aa, BK virus
FILEKVYIL

SEQ ID NO: 5890 - protein, 9 aa, BK virus
ILEKVYILI

SEQ ID NO: 5891 - protein, 9 aa, BK virus
LEKVYILIS

SEQ ID NO: 5892 - protein, 9 aa, BK virus
EKVYILISE

SEQ ID NO: 5893 - protein, 9 aa, BK virus
KVYILISES

SEQ ID NO: 5894 - protein, 9 aa, BK virus
VYILISESS

SEQ ID NO: 5895 - protein, 9 aa, BK virus
YILISESSL

SEQ ID NO: 5896 - protein, 9 aa, BK virus
ILISESSLS

SEQ ID NO: 5897 - protein, 9 aa, BK virus
LISESSLSF

SEQ ID NO: 5898 - protein, 9 aa, BK virus
ISESSLSFH

SEQ ID NO: 5899 - protein, 9 aa, BK virus
SESSLSFHS

SEQ ID NO: 5900 - protein, 9 aa, BK virus
ESSLSFHST

SEQ ID NO: 5901 - protein, 9 aa, BK virus
SSLSFHSTI

SEQ ID NO: 5902 - protein, 9 aa, BK virus
SLSFHSTIL

SEQ ID NO: 5903 - protein, 9 aa, BK virus
LSFHSTILD

SEQ ID NO: 5904 - protein, 9 aa, BK virus
SFHSTILDC

SEQ ID NO: 5905 - protein, 9 aa, BK virus
FHSTILDCI

SEQ ID NO: 5906 - protein, 9 aa, BK virus
HSTILDCIS

SEQ ID NO: 5907 - protein, 9 aa, BK virus
STILDCISV

SEQ ID NO: 5908 - protein, 9 aa, BK virus
TILDCISVA

SEQ ID NO: 5909 - protein, 9 aa, BK virus
ILDCISVAK

SEQ ID NO: 5910 - protein, 9 aa, BK virus
LDCISVAKS

SEQ ID NO: 5911 - protein, 9 aa, BK virus
DCISVAKSA

SEQ ID NO: 5912 - protein, 9 aa, BK virus
CISVAKSAT

SEQ ID NO: 5913 - protein, 9 aa, BK virus
ISVAKSATG

SEQ ID NO: 5914 - protein, 9 aa, BK virus
SVAKSATGL

SEQ ID NO: 5915 - protein, 9 aa, BK virus
VAKSATGLN

SEQ ID NO: 5916 - protein, 9 aa, BK virus
AKSATGLNQ

SEQ ID NO: 5917 - protein, 9 aa, BK virus
KSATGLNQI

SEQ ID NO: 5918 - protein, 9 aa, BK virus
SATGLNQIS

SEQ ID NO: 5919 - protein, 9 aa, BK virus
ATGLNQISS

SEQ ID NO: 5920 - protein, 9 aa, BK virus
TGLNQISSS

SEQ ID NO: 5921 - protein, 9 aa, BK virus
GLNQISSSN

SEQ ID NO: 5922 - protein, 9 aa, BK virus
LNQISSSNK

SEQ ID NO: 5923 - protein, 9 aa, BK virus
NQISSSNKV

SEQ ID NO: 5924 - protein, 9 aa, BK virus
QISSSNKVI

SEQ ID NO: 5925 - protein, 9 aa, BK virus
ISSSNKVIP

SEQ ID NO: 5926 - protein, 9 aa, BK virus
SSSNKVIPL

SEQ ID NO: 5927 - protein, 9 aa, BK virus
SSNKVIPLC

SEQ ID NO: 5928 - protein, 9 aa, BK virus
SNKVIPLCK

SEQ ID NO: 5929 - protein, 9 aa, BK virus
NKVIPLCKI

SEQ ID NO: 5930 - protein, 9 aa, BK virus
KVIPLCKIL

SEQ ID NO: 5931 - protein, 9 aa, BK virus
VIPLCKILF

SEQ ID NO: 5932 - protein, 9 aa, BK virus
IPLCKILFS

SEQ ID NO: 5933 - protein, 9 aa, BK virus
PLCKILFSS

SEQ ID NO: 5934 - protein, 9 aa, BK virus
LCKILFSSK

SEQ ID NO: 5935 - protein, 9 aa, BK virus
CKILFSSKN

SEQ ID NO: 5936 - protein, 9 aa, BK virus
KILFSSKNS

SEQ ID NO: 5937 - protein, 9 aa, BK virus
ILFSSKNSE

SEQ ID NO: 5938 - protein, 9 aa, BK virus
LFSSKNSEF

SEQ ID NO: 5939 - protein, 9 aa, BK virus
FSSKNSEFC

SEQ ID NO: 5940 - protein, 9 aa, BK virus
SSKNSEFCK

SEQ ID NO: 5941 - protein, 9 aa, BK virus
SKNSEFCKD

SEQ ID NO: 5942 - protein, 9 aa, BK virus
KNSEFCKDF

SEQ ID NO: 5943 - protein, 9 aa, BK virus
NSEFCKDFL

SEQ ID NO: 5944 - protein, 9 aa, BK virus
SEFCKDFLK

SEQ ID NO: 5945 - protein, 9 aa, BK virus
EFCKDFLKY

SEQ ID NO: 5946 - protein, 9 aa, BK virus
FCKDFLKYI

SEQ ID NO: 5947 - protein, 9 aa, BK virus
CKDFLKYIL

SEQ ID NO: 5948 - protein, 9 aa, BK virus
KDFLKYILG

SEQ ID NO: 5949 - protein, 9 aa, BK virus
DFLKYILGL

SEQ ID NO: 5950 - protein, 9 aa, BK virus
FLKYILGLK

SEQ ID NO: 5951 - protein, 9 aa, BK virus
LKYILGLKS

SEQ ID NO: 5952 - protein, 9 aa, BK virus
KYILGLKSI

SEQ ID NO: 5953 - protein, 9 aa, BK virus
YILGLKSIC

SEQ ID NO: 5954 - protein, 9 aa, BK virus
ILGLKSICL

SEQ ID NO: 5955 - protein, 9 aa, BK virus
LGLKSICLT

SEQ ID NO: 5956 - protein, 9 aa, BK virus
GLKSICLTN

SEQ ID NO: 5957 - protein, 9 aa, BK virus
LKSICLTNL

SEQ ID NO: 5958 - protein, 9 aa, BK virus
KSICLTNLA

SEQ ID NO: 5959 - protein, 9 aa, BK virus
SICLTNLAC

SEQ ID NO: 5960 - protein, 9 aa, BK virus
ICLTNLACR

SEQ ID NO: 5961 - protein, 9 aa, BK virus
CLTNLACRV

SEQ ID NO: 5962 - protein, 9 aa, BK virus
LTNLACRVL

SEQ ID NO: 5963 - protein, 9 aa, BK virus
TNLACRVLG

SEQ ID NO: 5964 - protein, 9 aa, BK virus
NLACRVLGT

SEQ ID NO: 5965 - protein, 9 aa, BK virus
LACRVLGTG

SEQ ID NO: 5966 - protein, 9 aa, BK virus
ACRVLGTGY

SEQ ID NO: 5967 - protein, 9 aa, BK virus
CRVLGTGYS

SEQ ID NO: 5968 - protein, 9 aa, BK virus
RVLGTGYSF

SEQ ID NO: 5969 - protein, 9 aa, BK virus
VLGTGYSFI

SEQ ID NO: 5970 - protein, 9 aa, BK virus
LGTGYSFIV

SEQ ID NO: 5971 - protein, 9 aa, BK virus
GTGYSFIVT

SEQ ID NO: 5972 - protein, 9 aa, BK virus
TGYSFIVTK

SEQ ID NO: 5973 - protein, 9 aa, BK virus
GYSFIVTKP

SEQ ID NO: 5974 - protein, 9 aa, BK virus
YSFIVTKPG

SEQ ID NO: 5975 - protein, 9 aa, BK virus
SFIVTKPGG

SEQ ID NO: 5976 - protein, 9 aa, BK virus
FIVTKPGGN

SEQ ID NO: 5977 - protein, 9 aa, BK virus
IVTKPGGNI

SEQ ID NO: 5978 - protein, 9 aa, BK virus
VTKPGGNIW

SEQ ID NO: 5979 - protein, 9 aa, BK virus
TKPGGNIWV

SEQ ID NO: 5980 - protein, 9 aa, BK virus
KPGGNIWVL

SEQ ID NO: 5981 - protein, 9 aa, BK virus
PGGNIWVLL

SEQ ID NO: 5982 - protein, 9 aa, BK virus
GGNIWVLLF

SEQ ID NO: 5983 - protein, 9 aa, BK virus
GNIWVLLFK

SEQ ID NO: 5984 - protein, 9 aa, BK virus
NIWVLLFKC

SEQ ID NO: 5985 - protein, 9 aa, BK virus
IWVLLFKCF

SEQ ID NO: 5986 - protein, 9 aa, BK virus
WVLLFKCFF

SEQ ID NO: 5987 - protein, 9 aa, BK virus
VLLFKCFFS

SEQ ID NO: 5988 - protein, 9 aa, BK virus
LLFKCFFSK

SEQ ID NO: 5989 - protein, 9 aa, BK virus
LFKCFFSKF

SEQ ID NO: 5990 - protein, 9 aa, BK virus
FKCFFSKFT

SEQ ID NO: 5991 - protein, 9 aa, BK virus
KCFFSKFTL

SEQ ID NO: 5992 - protein, 9 aa, BK virus
CFFSKFTLT

SEQ ID NO: 5993 - protein, 9 aa, BK virus
FFSKFTLTL

SEQ ID NO: 5994 - protein, 9 aa, BK virus
FSKFTLTLP

SEQ ID NO: 5995 - protein, 9 aa, BK virus
SKFTLTLPS

SEQ ID NO: 5996 - protein, 9 aa, BK virus
KFTLTLPSK

SEQ ID NO: 5997 - protein, 9 aa, BK virus
SLKLSKLFI

SEQ ID NO: 5998 - protein, 9 aa, BK virus
LKLSKLFIP

SEQ ID NO: 5999 - protein, 9 aa, BK virus
KLSKLFIPC

SEQ ID NO: 6000 - protein, 9 aa, BK virus
LSKLFIPCP

SEQ ID NO: 6001 - protein, 9 aa, BK virus
SKLFIPCPE

SEQ ID NO: 6002 - protein, 9 aa, BK virus
KLFIPCPEG

SEQ ID NO: 6003 - protein, 9 aa, BK virus
LFIPCPEGK

SEQ ID NO: 6004 - protein, 9 aa, BK virus
FIPCPEGKS

SEQ ID NO: 6005 - protein, 9 aa, BK virus
IPCPEGKSF

SEQ ID NO: 6006 - protein, 9 aa, BK virus
PCPEGKSFD

SEQ ID NO: 6007 - protein, 9 aa, BK virus
CPEGKSFDS

SEQ ID NO: 6008 - protein, 9 aa, BK virus
PEGKSFDSA

SEQ ID NO: 6009 - protein, 9 aa, BK virus
EGKSFDSAP

SEQ ID NO: 6010 - protein, 9 aa, BK virus
GKSFDSAPV

SEQ ID NO: 6011 - protein, 9 aa, BK virus
KSFDSAPVP

SEQ ID NO: 6012 - protein, 9 aa, BK virus
SFDSAPVPF

SEQ ID NO: 6013 - protein, 9 aa, BK virus
FDSAPVPFT

SEQ ID NO: 6014 - protein, 9 aa, BK virus
DSAPVPFTS

SEQ ID NO: 6015 - protein, 9 aa, BK virus
SAPVPFTSS

SEQ ID NO: 6016 - protein, 9 aa, BK virus
APVPFTSSK

SEQ ID NO: 6017 - protein, 9 aa, BK virus
PVPFTSSKT

SEQ ID NO: 6018 - protein, 9 aa, BK virus
VPFTSSKTT

SEQ ID NO: 6019 - protein, 9 aa, BK virus
PFTSSKTTM

SEQ ID NO: 6020 - protein, 9 aa, BK virus
FTSSKTTMY

SEQ ID NO: 6021 - protein, 9 aa, BK virus
SIATPSSKV

SEQ ID NO: 6022 - protein, 9 aa, BK virus
IATPSSKVS

SEQ ID NO: 6023 - protein, 9 aa, BK virus
ATPSSKVSL

SEQ ID NO: 6024 - protein, 9 aa, BK virus
TPSSKVSLS

SEQ ID NO: 6025 - protein, 9 aa, BK virus
PSSKVSLSM

SEQ ID NO: 6026 - protein, 9 aa, BK virus
SSKVSLSMG

SEQ ID NO: 6027 - protein, 9 aa, BK virus
SKVSLSMGR

SEQ ID NO: 6028 - protein, 9 aa, BK virus
KVSLSMGRF

SEQ ID NO: 6029 - protein, 9 aa, BK virus
VSLSMGRFT

SEQ ID NO: 6030 - protein, 9 aa, BK virus
SLSMGRFTF

SEQ ID NO: 6031 - protein, 9 aa, BK virus
LSMGRFTFK

SEQ ID NO: 6032 - protein, 9 aa, BK virus
SMGRFTFKA

SEQ ID NO: 6033 - protein, 9 aa, BK virus
MGRFTFKAL

SEQ ID NO: 6034 - protein, 9 aa, BK virus
GRFTFKALP

SEQ ID NO: 6035 - protein, 9 aa, BK virus
RFTFKALPP

SEQ ID NO: 6036 - protein, 9 aa, BK virus
FTFKALPPH

SEQ ID NO: 6037 - protein, 9 aa, BK virus
TFKALPPHK

SEQ ID NO: 6038 - protein, 9 aa, BK virus
FKALPPHKS

SEQ ID NO: 6039 - protein, 9 aa, BK virus
KALPPHKSN

SEQ ID NO: 6040 - protein, 9 aa, BK virus
ALPPHKSNN

SEQ ID NO: 6041 - protein, 9 aa, BK virus
LPPHKSNNP

SEQ ID NO: 6042 - protein, 9 aa, BK virus
PPHKSNNPA

SEQ ID NO: 6043 - protein, 9 aa, BK virus
PHKSNNPAA

SEQ ID NO: 6044 - protein, 9 aa, BK virus
HKSNNPAAS

SEQ ID NO: 6045 - protein, 9 aa, BK virus
KSNNPAASV

SEQ ID NO: 6046 - protein, 9 aa, BK virus
SNNPAASVV

SEQ ID NO: 6047 - protein, 9 aa, BK virus
NNPAASVVF

SEQ ID NO: 6048 - protein, 9 aa, BK virus
NPAASVVFP

SEQ ID NO: 6049 - protein, 9 aa, BK virus
PAASVVFPL

SEQ ID NO: 6050 - protein, 9 aa, BK virus
AASVVFPLS

SEQ ID NO: 6051 - protein, 9 aa, BK virus
ASVVFPLSM

SEQ ID NO: 6052 - protein, 9 aa, BK virus
SVVFPLSMG

SEQ ID NO: 6053 - protein, 9 aa, BK virus
VVFPLSMGP

SEQ ID NO: 6054 - protein, 9 aa, BK virus
VFPLSMGPL

SEQ ID NO: 6055 - protein, 9 aa, BK virus
FPLSMGPLN

SEQ ID NO: 6056 - protein, 9 aa, BK virus
PLSMGPLNN

SEQ ID NO: 6057 - protein, 9 aa, BK virus
LSMGPLNNQ

SEQ ID NO: 6058 - protein, 9 aa, BK virus
SMGPLNNQY

SEQ ID NO: 6059 - protein, 9 aa, BK virus
MGPLNNQYL

SEQ ID NO: 6060 - protein, 9 aa, BK virus
GPLNNQYLL

SEQ ID NO: 6061 - protein, 9 aa, BK virus
PLNNQYLLL

SEQ ID NO: 6062 - protein, 9 aa, BK virus
LNNQYLLLG

SEQ ID NO: 6063 - protein, 9 aa, BK virus
NNQYLLLGT

SEQ ID NO: 6064 - protein, 9 aa, BK virus
NQYLLLGTL

SEQ ID NO: 6065 - protein, 9 aa, BK virus
QYLLLGTLK

SEQ ID NO: 6066 - protein, 9 aa, BK virus
YLLLGTLKT

SEQ ID NO: 6067 - protein, 9 aa, BK virus
LLLGTLKTI

SEQ ID NO: 6068 - protein, 9 aa, BK virus
LLGTLKTIQ

SEQ ID NO: 6069 - protein, 9 aa, BK virus
LGTLKTIQC

SEQ ID NO: 6070 - protein, 9 aa, BK virus
GTLKTIQCK

SEQ ID NO: 6071 - protein, 9 aa, BK virus
TLKTIQCKK

SEQ ID NO: 6072 - protein, 9 aa, BK virus
LKTIQCKKS

SEQ ID NO: 6073 - protein, 9 aa, BK virus
KTIQCKKSN

SEQ ID NO: 6074 - protein, 9 aa, BK virus
TIQCKKSNI

SEQ ID NO: 6075 - protein, 9 aa, BK virus
IQCKKSNIT

SEQ ID NO: 6076 - protein, 9 aa, BK virus
QCKKSNITE

SEQ ID NO: 6077 - protein, 9 aa, BK virus
CKKSNITES

SEQ ID NO: 6078 - protein, 9 aa, BK virus
KKSNITESI

SEQ ID NO: 6079 - protein, 9 aa, BK virus
KSNITESIL

SEQ ID NO: 6080 - protein, 9 aa, BK virus
SNITESILG

SEQ ID NO: 6081 - protein, 9 aa, BK virus
NITESILGS

SEQ ID NO: 6082 - protein, 9 aa, BK virus
ITESILGSK

SEQ ID NO: 6083 - protein, 9 aa, BK virus
TESILGSKQ

SEQ ID NO: 6084 - protein, 9 aa, BK virus
ESILGSKQC

SEQ ID NO: 6085 - protein, 9 aa, BK virus
SILGSKQCS

SEQ ID NO: 6086 - protein, 9 aa, BK virus
ILGSKQCSQ

SEQ ID NO: 6087 - protein, 9 aa, BK virus
LGSKQCSQA

SEQ ID NO: 6088 - protein, 9 aa, BK virus
GSKQCSQAT

SEQ ID NO: 6089 - protein, 9 aa, BK virus
SKQCSQATP

SEQ ID NO: 6090 - protein, 9 aa, BK virus
KQCSQATPA

SEQ ID NO: 6091 - protein, 9 aa, BK virus
QCSQATPAI

SEQ ID NO: 6092 - protein, 9 aa, BK virus
CSQATPAIY

SEQ ID NO: 6093 - protein, 9 aa, BK virus
SQATPAIYC

SEQ ID NO: 6094 - protein, 9 aa, BK virus
QATPAIYCS

SEQ ID NO: 6095 - protein, 9 aa, BK virus
ATPAIYCSS

SEQ ID NO: 6096 - protein, 9 aa, BK virus
TPAIYCSST

SEQ ID NO: 6097 - protein, 9 aa, BK virus
PAIYCSSTA

SEQ ID NO: 6098 - protein, 9 aa, BK virus
AIYCSSTAF

SEQ ID NO: 6099 - protein, 9 aa, BK virus
IYCSSTAFP

SEQ ID NO: 6100 - protein, 9 aa, BK virus
APNIKSILS

SEQ ID NO: 6101 - protein, 9 aa, BK virus
PNIKSILSN

SEQ ID NO: 6102 - protein, 9 aa, BK virus
NIKSILSNI

SEQ ID NO: 6103 - protein, 9 aa, BK virus
LNLSVSISS

SEQ ID NO: 6104 - protein, 9 aa, BK virus
NLSVSISSL

SEQ ID NO: 6105 - protein, 9 aa, BK virus
LSVSISSLV

SEQ ID NO: 6106 - protein, 9 aa, BK virus
SVSISSLVI

SEQ ID NO: 6107 - protein, 9 aa, BK virus
RVSTLFLAK

SEQ ID NO: 6108 - protein, 9 aa, BK virus
VSTLFLAKT

SEQ ID NO: 6109 - protein, 9 aa, BK virus
STLFLAKTV

SEQ ID NO: 6110 - protein, 9 aa, BK virus
TLFLAKTVS

SEQ ID NO: 6111 - protein, 9 aa, BK virus
LFLAKTVST

SEQ ID NO: 6112 - protein, 9 aa, BK virus
FLAKTVSTA

SEQ ID NO: 6113 - protein, 9 aa, BK virus
LAKTVSTAC

SEQ ID NO: 6114 - protein, 9 aa, BK virus
FLLSAKIIA

SEQ ID NO: 6115 - protein, 9 aa, BK virus
LLSAKIIAF

SEQ ID NO: 6116 - protein, 9 aa, BK virus
LSAKIIAFA

SEQ ID NO: 6117 - protein, 9 aa, BK virus
SAKIIAFAK

SEQ ID NO: 6118 - protein, 9 aa, BK virus
AKIIAFAKC

SEQ ID NO: 6119 - protein, 9 aa, BK virus
KIIAFAKCF

SEQ ID NO: 6120 - protein, 9 aa, BK virus
IIAFAKCFS

SEQ ID NO: 6121 - protein, 9 aa, BK virus
HFLHSSTLY

SEQ ID NO: 6122 - protein, 9 aa, BK virus
NSKYIPNNK

SEQ ID NO: 6123 - protein, 9 aa, BK virus
SKYIPNNKN

SEQ ID NO: 6124 - protein, 9 aa, BK virus
KYIPNNKNT

SEQ ID NO: 6125 - protein, 9 aa, BK virus
YIPNNKNTS

SEQ ID NO: 6126 - protein, 9 aa, BK virus
IPNNKNTSS

SEQ ID NO: 6127 - protein, 9 aa, BK virus
PNNKNTSSH

SEQ ID NO: 6128 - protein, 9 aa, BK virus
NNKNTSSHF

SEQ ID NO: 6129 - protein, 9 aa, BK virus
NKNTSSHFV

SEQ ID NO: 6130 - protein, 9 aa, BK virus
KNTSSHFVS

SEQ ID NO: 6131 - protein, 9 aa, BK virus
NTSSHFVST

SEQ ID NO: 6132 - protein, 9 aa, BK virus
TSSHFVSTA

SEQ ID NO: 6133 - protein, 9 aa, BK virus
SSHFVSTAY

SEQ ID NO: 6134 - protein, 9 aa, BK virus
SHFVSTAYS

SEQ ID NO: 6135 - protein, 9 aa, BK virus
HFVSTAYSV

SEQ ID NO: 6136 - protein, 9 aa, BK virus
FVSTAYSVI

SEQ ID NO: 6137 - protein, 9 aa, BK virus
VSTAYSVIN

SEQ ID NO: 6138 - protein, 9 aa, BK virus
STAYSVINF

SEQ ID NO: 6139 - protein, 9 aa, BK virus
TAYSVINFQ

SEQ ID NO: 6140 - protein, 9 aa, BK virus
AYSVINFQD

SEQ ID NO: 6141 - protein, 9 aa, BK virus
YSVINFQDT

SEQ ID NO: 6142 - protein, 9 aa, BK virus
SVINFQDTC

SEQ ID NO: 6143 - protein, 9 aa, BK virus
VINFQDTCF

SEQ ID NO: 6144 - protein, 9 aa, BK virus
INFQDTCFV

SEQ ID NO: 6145 - protein, 9 aa, BK virus
NFQDTCFVS

SEQ ID NO: 6146 - protein, 9 aa, BK virus
FQDTCFVSS

SEQ ID NO: 6147 - protein, 9 aa, BK virus
QDTCFVSSG

SEQ ID NO: 6148 - protein, 9 aa, BK virus
DTCFVSSGS

SEQ ID NO: 6149 - protein, 9 aa, BK virus
TCFVSSGSS

SEQ ID NO: 6150 - protein, 9 aa, BK virus
CFVSSGSSG

SEQ ID NO: 6151 - protein, 9 aa, BK virus
FVSSGSSGL

SEQ ID NO: 6152 - protein, 9 aa, BK virus
VSSGSSGLK

SEQ ID NO: 6153 - protein, 9 aa, BK virus
SSGSSGLKS

SEQ ID NO: 6154 - protein, 9 aa, BK virus
SGSSGLKSC

SEQ ID NO: 6155 - protein, 9 aa, BK virus
GSSGLKSCS

SEQ ID NO: 6156 - protein, 9 aa, BK virus
SSGLKSCSF

SEQ ID NO: 6157 - protein, 9 aa, BK virus
SGLKSCSFK

SEQ ID NO: 6158 - protein, 9 aa, BK virus
GLKSCSFKP

SEQ ID NO: 6159 - protein, 9 aa, BK virus
LKSCSFKPP

SEQ ID NO: 6160 - protein, 9 aa, BK virus
MLSSIVWYG

SEQ ID NO: 6161 - protein, 9 aa, BK virus
LSSIVWYGS

SEQ ID NO: 6162 - protein, 9 aa, BK virus
SSIVWYGSL

SEQ ID NO: 6163 - protein, 9 aa, BK virus
SIVWYGSLV

SEQ ID NO: 6164 - protein, 9 aa, BK virus
IVWYGSLVK

SEQ ID NO: 6165 - protein, 9 aa, BK virus
VWYGSLVKA

SEQ ID NO: 6166 - protein, 9 aa, BK virus
WYGSLVKAL

SEQ ID NO: 6167 - protein, 9 aa, BK virus
YGSLVKALY

SEQ ID NO: 6168 - protein, 9 aa, BK virus
GSLVKALYS

SEQ ID NO: 6169 - protein, 9 aa, BK virus
SLVKALYSK

SEQ ID NO: 6170 - protein, 9 aa, BK virus
LVKALYSKY

SEQ ID NO: 6171 - protein, 9 aa, BK virus
VKALYSKYS

SEQ ID NO: 6172 - protein, 9 aa, BK virus
KALYSKYSL

SEQ ID NO: 6173 - protein, 9 aa, BK virus
ALYSKYSLL

SEQ ID NO: 6174 - protein, 9 aa, BK virus
LYSKYSLLT

SEQ ID NO: 6175 - protein, 9 aa, BK virus
YSKYSLLTP

SEQ ID NO: 6176 - protein, 9 aa, BK virus
SKYSLLTPL

SEQ ID NO: 6177 - protein, 9 aa, BK virus
KYSLLTPLQ

SEQ ID NO: 6178 - protein, 9 aa, BK virus
YSLLTPLQI

SEQ ID NO: 6179 - protein, 9 aa, BK virus
SLLTPLQIK

SEQ ID NO: 6180 - protein, 9 aa, BK virus
LLTPLQIKK

SEQ ID NO: 6181 - protein, 9 aa, BK virus
LTPLQIKKL

SEQ ID NO: 6182 - protein, 9 aa, BK virus
TPLQIKKLK

SEQ ID NO: 6183 - protein, 9 aa, BK virus
PLQIKKLKV

SEQ ID NO: 6184 - protein, 9 aa, BK virus
LQIKKLKVH

SEQ ID NO: 6185 - protein, 9 aa, BK virus
QIKKLKVHS

SEQ ID NO: 6186 - protein, 9 aa, BK virus
IKKLKVHSF

SEQ ID NO: 6187 - protein, 9 aa, BK virus
QKLLIAETL

SEQ ID NO: 6188 - protein, 9 aa, BK virus
KLLIAETLC

SEQ ID NO: 6189 - protein, 9 aa, BK virus
LLIAETLCL

SEQ ID NO: 6190 - protein, 9 aa, BK virus
LIAETLCLC

SEQ ID NO: 6191 - protein, 9 aa, BK virus
IAETLCLCG

SEQ ID NO: 6192 - protein, 9 aa, BK virus
AETLCLCGV

SEQ ID NO: 6193 - protein, 9 aa, BK virus
ETLCLCGVK

SEQ ID NO: 6194 - protein, 9 aa, BK virus
TLCLCGVKK

SEQ ID NO: 6195 - protein, 9 aa, BK virus
LCLCGVKKN

SEQ ID NO: 6196 - protein, 9 aa, BK virus
CLCGVKKNI

SEQ ID NO: 6197 - protein, 9 aa, BK virus
LCGVKKNII

SEQ ID NO: 6198 - protein, 9 aa, BK virus
CGVKKNIIL

SEQ ID NO: 6199 - protein, 9 aa, BK virus
GVKKNIILC

SEQ ID NO: 6200 - protein, 9 aa, BK virus
VKKNIILCP

SEQ ID NO: 6201 - protein, 9 aa, BK virus
KKNIILCPA

SEQ ID NO: 6202 - protein, 9 aa, BK virus
KNIILCPAH

SEQ ID NO: 6203 - protein, 9 aa, BK virus
NIILCPAHM

SEQ ID NO: 6204 - protein, 9 aa, BK virus
IILCPAHMC

SEQ ID NO: 6205 - protein, 9 aa, BK virus
ILCPAHMCL

SEQ ID NO: 6206 - protein, 9 aa, BK virus
LCPAHMCLL

SEQ ID NO: 6207 - protein, 9 aa, BK virus
CPAHMCLLI

SEQ ID NO: 6208 - protein, 9 aa, BK virus
PAHMCLLIK

SEQ ID NO: 6209 - protein, 9 aa, BK virus
AHMCLLIKV

SEQ ID NO: 6210 - protein, 9 aa, BK virus
HMCLLIKVT

SEQ ID NO: 6211 - protein, 9 aa, BK virus
MCLLIKVTE

SEQ ID NO: 6212 - protein, 9 aa, BK virus
CLLIKVTEY

SEQ ID NO: 6213 - protein, 9 aa, BK virus
LLIKVTEYF

SEQ ID NO: 6214 - protein, 9 aa, BK virus
LIKVTEYFS

SEQ ID NO: 6215 - protein, 9 aa, BK virus
IKVTEYFSI

SEQ ID NO: 6216 - protein, 9 aa, BK virus
KVTEYFSIS

SEQ ID NO: 6217 - protein, 9 aa, BK virus
VTEYFSISF

SEQ ID NO: 6218 - protein, 9 aa, BK virus
TEYFSISFL

SEQ ID NO: 6219 - protein, 9 aa, BK virus
EYFSISFLY

SEQ ID NO: 6220 - protein, 9 aa, BK virus
YFSISFLYR

SEQ ID NO: 6221 - protein, 9 aa, BK virus
FSISFLYRI

SEQ ID NO: 6222 - protein, 9 aa, BK virus
AFSLVVYTA

SEQ ID NO: 6223 - protein, 9 aa, BK virus
FSLVVYTAK

SEQ ID NO: 6224 - protein, 9 aa, BK virus
SLVVYTAKQ

SEQ ID NO: 6225 - protein, 9 aa, BK virus
LVVYTAKQA

SEQ ID NO: 6226 - protein, 9 aa, BK virus
VVYTAKQAR

SEQ ID NO: 6227 - protein, 9 aa, BK virus
VYTAKQARV

SEQ ID NO: 6228 - protein, 9 aa, BK virus
YTAKQARVL

SEQ ID NO: 6229 - protein, 9 aa, BK virus
TAKQARVLL

SEQ ID NO: 6230 - protein, 9 aa, BK virus
AKQARVLLL

SEQ ID NO: 6231 - protein, 9 aa, BK virus
KQARVLLLN

SEQ ID NO: 6232 - protein, 9 aa, BK virus
QARVLLLNT

SEQ ID NO: 6233 - protein, 9 aa, BK virus
ARVLLLNTA

SEQ ID NO: 6234 - protein, 9 aa, BK virus
LRNWCRSEG

SEQ ID NO: 6235 - protein, 9 aa, BK virus
RNWCRSEGK

SEQ ID NO: 6236 - protein, 9 aa, BK virus
NWCRSEGKS

SEQ ID NO: 6237 - protein, 9 aa, BK virus
WCRSEGKSL

SEQ ID NO: 6238 - protein, 9 aa, BK virus
CRSEGKSLG

SEQ ID NO: 6239 - protein, 9 aa, BK virus
RSEGKSLGS

SEQ ID NO: 6240 - protein, 9 aa, BK virus
SEGKSLGSS

SEQ ID NO: 6241 - protein, 9 aa, BK virus
EGKSLGSST

SEQ ID NO: 6242 - protein, 9 aa, BK virus
GKSLGSSTF

SEQ ID NO: 6243 - protein, 9 aa, BK virus
KSLGSSTFL

SEQ ID NO: 6244 - protein, 9 aa, BK virus
SLGSSTFLF

SEQ ID NO: 6245 - protein, 9 aa, BK virus
LGSSTFLFF

SEQ ID NO: 6246 - protein, 9 aa, BK virus
GSSTFLFFL

SEQ ID NO: 6247 - protein, 9 aa, BK virus
SSTFLFFLG

SEQ ID NO: 6248 - protein, 9 aa, BK virus
STFLFFLGG

SEQ ID NO: 6249 - protein, 9 aa, BK virus
TFLFFLGGV

SEQ ID NO: 6250 - protein, 9 aa, BK virus
FLFFLGGVE

SEQ ID NO: 6251 - protein, 9 aa, BK virus
LFFLGGVEC

SEQ ID NO: 6252 - protein, 9 aa, BK virus
ESAVASSSL

SEQ ID NO: 6253 - protein, 9 aa, BK virus
SAVASSSLA

SEQ ID NO: 6254 - protein, 9 aa, BK virus
AVASSSLAN

SEQ ID NO: 6255 - protein, 9 aa, BK virus
VASSSLANI

SEQ ID NO: 6256 - protein, 9 aa, BK virus
ASSSLANIS

SEQ ID NO: 6257 - protein, 9 aa, BK virus
SSSLANISS

SEQ ID NO: 6258 - protein, 9 aa, BK virus
SSLANISSW

SEQ ID NO: 6259 - protein, 9 aa, BK virus
SLANISSWQ

SEQ ID NO: 6260 - protein, 9 aa, BK virus
LANISSWQN

SEQ ID NO: 6261 - protein, 9 aa, BK virus
ANISSWQNK

SEQ ID NO: 6262 - protein, 9 aa, BK virus
NISSWQNKS

SEQ ID NO: 6263 - protein, 9 aa, BK virus
ISSWQNKSS

SEQ ID NO: 6264 - protein, 9 aa, BK virus
SSWQNKSSS

SEQ ID NO: 6265 - protein, 9 aa, BK virus
SWQNKSSSH

SEQ ID NO: 6266 - protein, 9 aa, BK virus
WQNKSSSHF

SEQ ID NO: 6267 - protein, 9 aa, BK virus
QNKSSSHFS

SEQ ID NO: 6268 - protein, 9 aa, BK virus
NKSSSHFSL

SEQ ID NO: 6269 - protein, 9 aa, BK virus
KSSSHFSLK

SEQ ID NO: 6270 - protein, 9 aa, BK virus
SSSHFSLKE

SEQ ID NO: 6271 - protein, 9 aa, BK virus
SSHFSLKEL

SEQ ID NO: 6272 - protein, 9 aa, BK virus
SHFSLKELH

SEQ ID NO: 6273 - protein, 9 aa, BK virus
HFSLKELHQ

SEQ ID NO: 6274 - protein, 9 aa, BK virus
FSLKELHQD

SEQ ID NO: 6275 - protein, 9 aa, BK virus
SLKELHQDS

SEQ ID NO: 6276 - protein, 9 aa, BK virus
LKELHQDSH

SEQ ID NO: 6277 - protein, 9 aa, BK virus
KELHQDSHS

SEQ ID NO: 6278 - protein, 9 aa, BK virus
ELHQDSHSS

SEQ ID NO: 6279 - protein, 9 aa, BK virus
LHQDSHSSV

SEQ ID NO: 6280 - protein, 9 aa, BK virus
HQDSHSSVP

SEQ ID NO: 6281 - protein, 9 aa, BK virus
VGTYKKNNY

SEQ ID NO: 6282 - protein, 9 aa, BK virus
GTYKKNNYL

SEQ ID NO: 6283 - protein, 9 aa, BK virus
TYKKNNYLG

SEQ ID NO: 6284 - protein, 9 aa, BK virus
YKKNNYLGP

SEQ ID NO: 6285 - protein, 9 aa, BK virus
KKNNYLGPF

SEQ ID NO: 6286 - protein, 9 aa, BK virus
KNNYLGPFN

SEQ ID NO: 6287 - protein, 9 aa, BK virus
NNYLGPFNI

SEQ ID NO: 6288 - protein, 9 aa, BK virus
NYLGPFNIL

SEQ ID NO: 6289 - protein, 9 aa, BK virus
YLGPFNILL

SEQ ID NO: 6290 - protein, 9 aa, BK virus
LGPFNILLF

SEQ ID NO: 6291 - protein, 9 aa, BK virus
GPFNILLFI

SEQ ID NO: 6292 - protein, 9 aa, BK virus
VSYLKALDL

SEQ ID NO: 6293 - protein, 9 aa, BK virus
REFLQLFGP

SEQ ID NO: 6294 - protein, 9 aa, BK virus
EFLQLFGPT

SEQ ID NO: 6295 - protein, 9 aa, BK virus
FLQLFGPTI

SEQ ID NO: 6296 - protein, 9 aa, BK virus
LQLFGPTIA

SEQ ID NO: 6297 - protein, 9 aa, BK virus
QLFGPTIAE

SEQ ID NO: 6298 - protein, 9 aa, BK virus
LFGPTIAEF

SEQ ID NO: 6299 - protein, 9 aa, BK virus
FGPTIAEFL

SEQ ID NO: 6300 - protein, 9 aa, BK virus
GPTIAEFLQ

SEQ ID NO: 6301 - protein, 9 aa, BK virus
PTIAEFLQL

SEQ ID NO: 6302 - protein, 9 aa, BK virus
TIAEFLQLG

SEQ ID NO: 6303 - protein, 9 aa, BK virus
IAEFLQLGL

SEQ ID NO: 6304 - protein, 9 aa, BK virus
AEFLQLGLS

SEQ ID NO: 6305 - protein, 9 aa, BK virus
EFLQLGLSQ

SEQ ID NO: 6306 - protein, 9 aa, BK virus
FLQLGLSQT

SEQ ID NO: 6307 - protein, 9 aa, BK virus
LQLGLSQTT

SEQ ID NO: 6308 - protein, 9 aa, BK virus
QLGLSQTTV

SEQ ID NO: 6309 - protein, 9 aa, BK virus
SSQCSSNLS

SEQ ID NO: 6310 - protein, 9 aa, BK virus
SQCSSNLSK

SEQ ID NO: 6311 - protein, 9 aa, BK virus
QCSSNLSKP

SEQ ID NO: 6312 - protein, 9 aa, BK virus
CSSNLSKPR

SEQ ID NO: 6313 - protein, 9 aa, BK virus
SSNLSKPRA

SEQ ID NO: 6314 - protein, 9 aa, BK virus
SNLSKPRAL

SEQ ID NO: 6315 - protein, 9 aa, BK virus
NLSKPRALF

SEQ ID NO: 6316 - protein, 9 aa, BK virus
LSKPRALFL

SEQ ID NO: 6317 - protein, 9 aa, BK virus
SKPRALFLK

SEQ ID NO: 6318 - protein, 9 aa, BK virus
KPRALFLKI

SEQ ID NO: 6319 - protein, 9 aa, BK virus
PRALFLKIF

SEQ ID NO: 6320 - protein, 9 aa, BK virus
RALFLKIFY

SEQ ID NO: 6321 - protein, 9 aa, BK virus
ALFLKIFYL

SEQ ID NO: 6322 - protein, 9 aa, BK virus
LFLKIFYLN

SEQ ID NO: 6323 - protein, 9 aa, BK virus
FLKIFYLNA

SEQ ID NO: 6324 - protein, 9 aa, BK virus
LKIFYLNAL

SEQ ID NO: 6325 - protein, 9 aa, BK virus
KIFYLNALI

SEQ ID NO: 6326 - protein, 9 aa, BK virus
ADIACKGSA

SEQ ID NO: 6327 - protein, 9 aa, BK virus
DIACKGSAQ

SEQ ID NO: 6328 - protein, 9 aa, BK virus
IACKGSAQK

SEQ ID NO: 6329 - protein, 9 aa, BK virus
ACKGSAQKA

SEQ ID NO: 6330 - protein, 9 aa, BK virus
CKGSAQKAF

SEQ ID NO: 6331 - protein, 9 aa, BK virus
KGSAQKAFW

SEQ ID NO: 6332 - protein, 9 aa, BK virus
GSAQKAFWN

SEQ ID NO: 6333 - protein, 9 aa, BK virus
SAQKAFWNK

SEQ ID NO: 6334 - protein, 9 aa, BK virus
AIPCSTGYL

SEQ ID NO: 6335 - protein, 9 aa, BK virus
IPCSTGYLG

SEQ ID NO: 6336 - protein, 9 aa, BK virus
PCSTGYLGK

SEQ ID NO: 6337 - protein, 9 aa, BK virus
CSTGYLGKE

SEQ ID NO: 6338 - protein, 9 aa, BK virus
STGYLGKEE

SEQ ID NO: 6339 - protein, 9 aa, BK virus
TGYLGKEEN

SEQ ID NO: 6340 - protein, 9 aa, BK virus
GYLGKEENQ

SEQ ID NO: 6341 - protein, 9 aa, BK virus
YLGKEENQH

SEQ ID NO: 6342 - protein, 9 aa, BK virus
LGKEENQHK

SEQ ID NO: 6343 - protein, 9 aa, BK virus
GKEENQHKP

SEQ ID NO: 6344 - protein, 9 aa, BK virus
KEENQHKPL

SEQ ID NO: 6345 - protein, 9 aa, BK virus
EENQHKPLS

SEQ ID NO: 6346 - protein, 9 aa, BK virus
ENQHKPLSY

SEQ ID NO: 6347 - protein, 9 aa, BK virus
NQHKPLSYS

SEQ ID NO: 6348 - protein, 9 aa, BK virus
QHKPLSYSR

SEQ ID NO: 6349 - protein, 9 aa, BK virus
HKPLSYSRF

SEQ ID NO: 6350 - protein, 9 aa, BK virus
KPLSYSRFQ

SEQ ID NO: 6351 - protein, 9 aa, BK virus
PLSYSRFQN

SEQ ID NO: 6352 - protein, 9 aa, BK virus
LSYSRFQNQ

SEQ ID NO: 6353 - protein, 9 aa, BK virus
SYSRFQNQA

SEQ ID NO: 6354 - protein, 9 aa, BK virus
YSRFQNQAD

SEQ ID NO: 6355 - protein, 9 aa, BK virus
SRFQNQADE

SEQ ID NO: 6356 - protein, 9 aa, BK virus
RFQNQADEL

SEQ ID NO: 6357 - protein, 9 aa, BK virus
FQNQADELP

SEQ ID NO: 6358 - protein, 9 aa, BK virus
QNQADELPL

SEQ ID NO: 6359 - protein, 9 aa, BK virus
NQADELPLH

SEQ ID NO: 6360 - protein, 9 aa, BK virus
QADELPLHP

SEQ ID NO: 6361 - protein, 9 aa, BK virus
ADELPLHPA

SEQ ID NO: 6362 - protein, 9 aa, BK virus
DELPLHPAP

SEQ ID NO: 6363 - protein, 9 aa, BK virus
ELPLHPAPF

SEQ ID NO: 6364 - protein, 9 aa, BK virus
LPLHPAPFF

SEQ ID NO: 6365 - protein, 9 aa, BK virus
PLHPAPFFY

SEQ ID NO: 6366 - protein, 9 aa, BK virus
LHPAPFFYT

SEQ ID NO: 6367 - protein, 9 aa, BK virus
HPAPFFYTK

SEQ ID NO: 6368 - protein, 9 aa, BK virus
PAPFFYTKY

SEQ ID NO: 6369 - protein, 9 aa, BK virus
APFFYTKYS

SEQ ID NO: 6370 - protein, 9 aa, BK virus
PFFYTKYSF

SEQ ID NO: 6371 - protein, 9 aa, BK virus
FFYTKYSFS

SEQ ID NO: 6372 - protein, 9 aa, BK virus
FYTKYSFSS

SEQ ID NO: 6373 - protein, 9 aa, BK virus
YTKYSFSSF

SEQ ID NO: 6374 - protein, 9 aa, BK virus
TKYSFSSFY

SEQ ID NO: 6375 - protein, 9 aa, BK virus
KYSFSSFYP

SEQ ID NO: 6376 - protein, 9 aa, BK virus
YSFSSFYPR

SEQ ID NO: 6377 - protein, 9 aa, BK virus
SFSSFYPRR

SEQ ID NO: 6378 - protein, 9 aa, BK virus
FSSFYPRRP

SEQ ID NO: 6379 - protein, 9 aa, BK virus
SSFYPRRPL

SEQ ID NO: 6380 - protein, 9 aa, BK virus
SFYPRRPLC

SEQ ID NO: 6381 - protein, 9 aa, BK virus
FYPRRPLCQ

SEQ ID NO: 6382 - protein, 9 aa, BK virus
YPRRPLCQG

SEQ ID NO: 6383 - protein, 9 aa, BK virus
PRRPLCQGE

SEQ ID NO: 6384 - protein, 9 aa, BK virus
RRPLCQGEI

SEQ ID NO: 6385 - protein, 9 aa, BK virus
RPLCQGEIP

SEQ ID NO: 6386 - protein, 9 aa, BK virus
PLCQGEIPY

SEQ ID NO: 6387 - protein, 9 aa, BK virus
LCQGEIPYT

SEQ ID NO: 6388 - protein, 9 aa, BK virus
CQGEIPYTS

SEQ ID NO: 6389 - protein, 9 aa, BK virus
QGEIPYTSL

SEQ ID NO: 6390 - protein, 9 aa, BK virus
GEIPYTSLN

SEQ ID NO: 6391 - protein, 9 aa, BK virus
EIPYTSLNK

SEQ ID NO: 6392 - protein, 9 aa, BK virus
IPYTSLNKL

SEQ ID NO: 6393 - protein, 9 aa, BK virus
PYTSLNKLF

SEQ ID NO: 6394 - protein, 9 aa, BK virus
YTSLNKLFS

SEQ ID NO: 6395 - protein, 9 aa, BK virus
TSLNKLFSL

SEQ ID NO: 6396 - protein, 9 aa, BK virus
SLNKLFSLR

SEQ ID NO: 6397 - protein, 9 aa, BK virus
LNKLFSLRE

SEQ ID NO: 6398 - protein, 9 aa, BK virus
NKLFSLRED

SEQ ID NO: 6399 - protein, 9 aa, BK virus
KLFSLREDF

SEQ ID NO: 6400 - protein, 9 aa, BK virus
LFSLREDFP

SEQ ID NO: 6401 - protein, 9 aa, BK virus
FSLREDFPR

SEQ ID NO: 6402 - protein, 9 aa, BK virus
SLREDFPRQ

SEQ ID NO: 6403 - protein, 9 aa, BK virus
LREDFPRQL

SEQ ID NO: 6404 - protein, 9 aa, BK virus
REDFPRQLF

SEQ ID NO: 6405 - protein, 9 aa, BK virus
EDFPRQLFQ

SEQ ID NO: 6406 - protein, 9 aa, BK virus
DFPRQLFQG

SEQ ID NO: 6407 - protein, 9 aa, BK virus
FPRQLFQGL

SEQ ID NO: 6408 - protein, 9 aa, BK virus
PRQLFQGLK

SEQ ID NO: 6409 - protein, 9 aa, BK virus
RQLFQGLKG

SEQ ID NO: 6410 - protein, 9 aa, BK virus
QLFQGLKGP

SEQ ID NO: 6411 - protein, 10 aa, BK virus
GFPQIVLLGL

SEQ ID NO: 6412 - protein, 10 aa, BK virus
FPQIVLLGLR

SEQ ID NO: 6413 - protein, 10 aa, BK virus
PQIVLLGLRK

SEQ ID NO: 6414 - protein, 10 aa, BK virus
QIVLLGLRKS

SEQ ID NO: 6415 - protein, 10 aa, BK virus
IVLLGLRKSL

SEQ ID NO: 6416 - protein, 10 aa, BK virus
VLLGLRKSLH

SEQ ID NO: 6417 - protein, 10 aa, BK virus
LLGLRKSLHT

SEQ ID NO: 6418 - protein, 10 aa, BK virus
LGLRKSLHTL

SEQ ID NO: 6419 - protein, 10 aa, BK virus
GLRKSLHTLT

SEQ ID NO: 6420 - protein, 10 aa, BK virus
LRKSLHTLTT

SEQ ID NO: 6421 - protein, 10 aa, BK virus
EKGWRQRRPR

SEQ ID NO: 6422 - protein, 10 aa, BK virus
KGWRQRRPRP

SEQ ID NO: 6423 - protein, 10 aa, BK virus
GWRQRRPRPL

SEQ ID NO: 6424 - protein, 10 aa, BK virus
WRQRRPRPLI

SEQ ID NO: 6425 - protein, 10 aa, BK virus
RQRRPRPLIY

SEQ ID NO: 6426 - protein, 10 aa, BK virus
QRRPRPLIYY

SEQ ID NO: 6427 - protein, 10 aa, BK virus
RRPRPLIYYK

SEQ ID NO: 6428 - protein, 10 aa, BK virus
RPRPLIYYKK

SEQ ID NO: 6429 - protein, 10 aa, BK virus
PRPLIYYKKK

SEQ ID NO: 6430 - protein, 10 aa, BK virus
RPLIYYKKKG

SEQ ID NO: 6431 - protein, 10 aa, BK virus
PLIYYKKKGH

SEQ ID NO: 6432 - protein, 10 aa, BK virus
LIYYKKKGHR

SEQ ID NO: 6433 - protein, 10 aa, BK virus
IYYKKKGHRE

SEQ ID NO: 6434 - protein, 10 aa, BK virus
YYKKKGHREE

SEQ ID NO: 6435 - protein, 10 aa, BK virus
YKKKGHREEL

SEQ ID NO: 6436 - protein, 10 aa, BK virus
KKKGHREELL

SEQ ID NO: 6437 - protein, 10 aa, BK virus
KKGHREELLT

SEQ ID NO: 6438 - protein, 10 aa, BK virus
KGHREELLTH

SEQ ID NO: 6439 - protein, 10 aa, BK virus
GHREELLTHG

SEQ ID NO: 6440 - protein, 10 aa, BK virus
HREELLTHGM

SEQ ID NO: 6441 - protein, 10 aa, BK virus
REELLTHGMQ

SEQ ID NO: 6442 - protein, 10 aa, BK virus
EELLTHGMQP

SEQ ID NO: 6443 - protein, 10 aa, BK virus
ELLTHGMQPN

SEQ ID NO: 6444 - protein, 10 aa, BK virus
LLTHGMQPNH

SEQ ID NO: 6445 - protein, 10 aa, BK virus
LTHGMQPNHD

SEQ ID NO: 6446 - protein, 10 aa, BK virus
THGMQPNHDL

SEQ ID NO: 6447 - protein, 10 aa, BK virus
HGMQPNHDLR

SEQ ID NO: 6448 - protein, 10 aa, BK virus
GMQPNHDLRK

SEQ ID NO: 6449 - protein, 10 aa, BK virus
MQPNHDLRKE

SEQ ID NO: 6450 - protein, 10 aa, BK virus
QPNHDLRKES

SEQ ID NO: 6451 - protein, 10 aa, BK virus
PNHDLRKESA

SEQ ID NO: 6452 - protein, 10 aa, BK virus
LTGECSQTMT

SEQ ID NO: 6453 - protein, 10 aa, BK virus
TGECSQTMTS

SEQ ID NO: 6454 - protein, 10 aa, BK virus
GECSQTMTSG

SEQ ID NO: 6455 - protein, 10 aa, BK virus
ECSQTMTSGR

SEQ ID NO: 6456 - protein, 10 aa, BK virus
CSQTMTSGRK

SEQ ID NO: 6457 - protein, 10 aa, BK virus
SQTMTSGRKV

SEQ ID NO: 6458 - protein, 10 aa, BK virus
QTMTSGRKVH

SEQ ID NO: 6459 - protein, 10 aa, BK virus
TMTSGRKVHD

SEQ ID NO: 6460 - protein, 10 aa, BK virus
MTSGRKVHDS

SEQ ID NO: 6461 - protein, 10 aa, BK virus
TSGRKVHDSQ

SEQ ID NO: 6462 - protein, 10 aa, BK virus
SGRKVHDSQG

SEQ ID NO: 6463 - protein, 10 aa, BK virus
GRKVHDSQGG

SEQ ID NO: 6464 - protein, 10 aa, BK virus
RKVHDSQGGA

SEQ ID NO: 6465 - protein, 10 aa, BK virus
KVHDSQGGAA

SEQ ID NO: 6466 - protein, 10 aa, BK virus
VHDSQGGAAY

SEQ ID NO: 6467 - protein, 10 aa, BK virus
HDSQGGAAYP

SEQ ID NO: 6468 - protein, 10 aa, BK virus
DSQGGAAYPW

SEQ ID NO: 6469 - protein, 10 aa, BK virus
SQGGAAYPWN

SEQ ID NO: 6470 - protein, 10 aa, BK virus
QGGAAYPWNA

SEQ ID NO: 6471 - protein, 10 aa, BK virus
GGAAYPWNAA

SEQ ID NO: 6472 - protein, 10 aa, BK virus
GAAYPWNAAK

SEQ ID NO: 6473 - protein, 10 aa, BK virus
AAYPWNAAKP

SEQ ID NO: 6474 - protein, 10 aa, BK virus
PQEGKCMTDM

SEQ ID NO: 6475 - protein, 10 aa, BK virus
QEGKCMTDMF

SEQ ID NO: 6476 - protein, 10 aa, BK virus
EGKCMTDMFC

SEQ ID NO: 6477 - protein, 10 aa, BK virus
GKCMTDMFCE

SEQ ID NO: 6478 - protein, 10 aa, BK virus
KCMTDMFCEP

SEQ ID NO: 6479 - protein, 10 aa, BK virus
CMTDMFCEPR

SEQ ID NO: 6480 - protein, 10 aa, BK virus
MTDMFCEPRN

SEQ ID NO: 6481 - protein, 10 aa, BK virus
TDMFCEPRNL

SEQ ID NO: 6482 - protein, 10 aa, BK virus
DMFCEPRNLG

SEQ ID NO: 6483 - protein, 10 aa, BK virus
MFCEPRNLGL

SEQ ID NO: 6484 - protein, 10 aa, BK virus
FCEPRNLGLV

SEQ ID NO: 6485 - protein, 10 aa, BK virus
CEPRNLGLVP

SEQ ID NO: 6486 - protein, 10 aa, BK virus
EPRNLGLVPS

SEQ ID NO: 6487 - protein, 10 aa, BK virus
TGQRPWFCAS

SEQ ID NO: 6488 - protein, 10 aa, BK virus
GQRPWFCASC

SEQ ID NO: 6489 - protein, 10 aa, BK virus
QRPWFCASCH

SEQ ID NO: 6490 - protein, 10 aa, BK virus
RPWFCASCHD

SEQ ID NO: 6491 - protein, 10 aa, BK virus
PWFCASCHDK

SEQ ID NO: 6492 - protein, 10 aa, BK virus
WFCASCHDKL

SEQ ID NO: 6493 - protein, 10 aa, BK virus
FCASCHDKLQ

SEQ ID NO: 6494 - protein, 10 aa, BK virus
KLVKPGLEQK

SEQ ID NO: 6495 - protein, 10 aa, BK virus
LVKPGLEQKK

SEQ ID NO: 6496 - protein, 10 aa, BK virus
VKPGLEQKKE

SEQ ID NO: 6497 - protein, 10 aa, BK virus
KPGLEQKKEL

SEQ ID NO: 6498 - protein, 10 aa, BK virus
PGLEQKKELR

SEQ ID NO: 6499 - protein, 10 aa, BK virus
GLEQKKELRG

SEQ ID NO: 6500 - protein, 10 aa, BK virus
LEQKKELRGF

SEQ ID NO: 6501 - protein, 10 aa, BK virus
EQKKELRGFL

SEQ ID NO: 6502 - protein, 10 aa, BK virus
QKKELRGFLF

SEQ ID NO: 6503 - protein, 10 aa, BK virus
KKELRGFLFL

SEQ ID NO: 6504 - protein, 10 aa, BK virus
KELRGFLFLF

SEQ ID NO: 6505 - protein, 10 aa, BK virus
SFCWNFVEVK

SEQ ID NO: 6506 - protein, 10 aa, BK virus
FCWNFVEVKT

SEQ ID NO: 6507 - protein, 10 aa, BK virus
CWNFVEVKTV

SEQ ID NO: 6508 - protein, 10 aa, BK virus
TGKTKVPLLY

SEQ ID NO: 6509 - protein, 10 aa, BK virus
GKTKVPLLYL

SEQ ID NO: 6510 - protein, 10 aa, BK virus
KTKVPLLYLL

SEQ ID NO: 6511 - protein, 10 aa, BK virus
VIPFFLYFQV

SEQ ID NO: 6512 - protein, 10 aa, BK virus
IPFFLYFQVH

SEQ ID NO: 6513 - protein, 10 aa, BK virus
PFFLYFQVHG

SEQ ID NO: 6514 - protein, 10 aa, BK virus
FFLYFQVHGC

SEQ ID NO: 6515 - protein, 10 aa, BK virus
FLYFQVHGCC

SEQ ID NO: 6516 - protein, 10 aa, BK virus
LYFQVHGCCS

SEQ ID NO: 6517 - protein, 10 aa, BK virus
YFQVHGCCSS

SEQ ID NO: 6518 - protein, 10 aa, BK virus
FQVHGCCSST

SEQ ID NO: 6519 - protein, 10 aa, BK virus
QVHGCCSSTF

SEQ ID NO: 6520 - protein, 10 aa, BK virus
VHGCCSSTFG

SEQ ID NO: 6521 - protein, 10 aa, BK virus
HGCCSSTFGG

SEQ ID NO: 6522 - protein, 10 aa, BK virus
GCCSSTFGGP

SEQ ID NO: 6523 - protein, 10 aa, BK virus
CCSSTFGGPS

SEQ ID NO: 6524 - protein, 10 aa, BK virus
CSSTFGGPSC

SEQ ID NO: 6525 - protein, 10 aa, BK virus
SSTFGGPSCQ

SEQ ID NO: 6526 - protein, 10 aa, BK virus
STFGGPSCQC

SEQ ID NO: 6527 - protein, 10 aa, BK virus
TFGGPSCQCI

SEQ ID NO: 6528 - protein, 10 aa, BK virus
GCCCHRIFSG

SEQ ID NO: 6529 - protein, 10 aa, BK virus
NCCWGGCCCY

SEQ ID NO: 6530 - protein, 10 aa, BK virus
CCWGGCCCYR

SEQ ID NO: 6531 - protein, 10 aa, BK virus
CWGGCCCYRS

SEQ ID NO: 6532 - protein, 10 aa, BK virus
WGGCCCYRSS

SEQ ID NO: 6533 - protein, 10 aa, BK virus
GGCCCYRSSN

SEQ ID NO: 6534 - protein, 10 aa, BK virus
GCCCYRSSNC

SEQ ID NO: 6535 - protein, 10 aa, BK virus
CCCYRSSNCI

SEQ ID NO: 6536 - protein, 10 aa, BK virus
CCYRSSNCIP

SEQ ID NO: 6537 - protein, 10 aa, BK virus
CYRSSNCIPC

SEQ ID NO: 6538 - protein, 10 aa, BK virus
YRSSNCIPCY

SEQ ID NO: 6539 - protein, 10 aa, BK virus
RSSNCIPCYC

SEQ ID NO: 6540 - protein, 10 aa, BK virus
SSNCIPCYCR

SEQ ID NO: 6541 - protein, 10 aa, BK virus
SNCIPCYCRG

SEQ ID NO: 6542 - protein, 10 aa, BK virus
NCIPCYCRGH

SEQ ID NO: 6543 - protein, 10 aa, BK virus
CIPCYCRGHN

SEQ ID NO: 6544 - protein, 10 aa, BK virus
IPCYCRGHNK

SEQ ID NO: 6545 - protein, 10 aa, BK virus
PCYCRGHNKY

SEQ ID NO: 6546 - protein, 10 aa, BK virus
CYCRGHNKYL

SEQ ID NO: 6547 - protein, 10 aa, BK virus
YCRGHNKYLR

SEQ ID NO: 6548 - protein, 10 aa, BK virus
CRGHNKYLRG

SEQ ID NO: 6549 - protein, 10 aa, BK virus
RGHNKYLRGY

SEQ ID NO: 6550 - protein, 10 aa, BK virus
GHNKYLRGYS

SEQ ID NO: 6551 - protein, 10 aa, BK virus
HNKYLRGYSC

SEQ ID NO: 6552 - protein, 10 aa, BK virus
NKYLRGYSCY

SEQ ID NO: 6553 - protein, 10 aa, BK virus
KYLRGYSCYR

SEQ ID NO: 6554 - protein, 10 aa, BK virus
YLRGYSCYRP

SEQ ID NO: 6555 - protein, 10 aa, BK virus
LRGYSCYRPN

SEQ ID NO: 6556 - protein, 10 aa, BK virus
RGYSCYRPNS

SEQ ID NO: 6557 - protein, 10 aa, BK virus
GYSCYRPNSS

SEQ ID NO: 6558 - protein, 10 aa, BK virus
YSCYRPNSSN

SEQ ID NO: 6559 - protein, 10 aa, BK virus
SCYRPNSSNI

SEQ ID NO: 6560 - protein, 10 aa, BK virus
CYRPNSSNIC

SEQ ID NO: 6561 - protein, 10 aa, BK virus
YRPNSSNICC

SEQ ID NO: 6562 - protein, 10 aa, BK virus
RPNSSNICCN

SEQ ID NO: 6563 - protein, 10 aa, BK virus
PNSSNICCNC

SEQ ID NO: 6564 - protein, 10 aa, BK virus
NSSNICCNCW

SEQ ID NO: 6565 - protein, 10 aa, BK virus
SSNICCNCWC

SEQ ID NO: 6566 - protein, 10 aa, BK virus
SNICCNCWCS

SEQ ID NO: 6567 - protein, 10 aa, BK virus
NICCNCWCSW

SEQ ID NO: 6568 - protein, 10 aa, BK virus
ICCNCWCSWG

SEQ ID NO: 6569 - protein, 10 aa, BK virus
CCNCWCSWGY

SEQ ID NO: 6570 - protein, 10 aa, BK virus
CNCWCSWGYC

SEQ ID NO: 6571 - protein, 10 aa, BK virus
NCWCSWGYCW

SEQ ID NO: 6572 - protein, 10 aa, BK virus
CWCSWGYCWV

SEQ ID NO: 6573 - protein, 10 aa, BK virus
WCSWGYCWVC

SEQ ID NO: 6574 - protein, 10 aa, BK virus
CSWGYCWVCC

SEQ ID NO: 6575 - protein, 10 aa, BK virus
SWGYCWVCCF

SEQ ID NO: 6576 - protein, 10 aa, BK virus
WGYCWVCCFN

SEQ ID NO: 6577 - protein, 10 aa, BK virus
GYCWVCCFNS

SEQ ID NO: 6578 - protein, 10 aa, BK virus
YCWVCCFNSN

SEQ ID NO: 6579 - protein, 10 aa, BK virus
CWVCCFNSNC

SEQ ID NO: 6580 - protein, 10 aa, BK virus
LGSQSFHCRP

SEQ ID NO: 6581 - protein, 10 aa, BK virus
GSQSFHCRPL

SEQ ID NO: 6582 - protein, 10 aa, BK virus
SQSFHCRPLS

SEQ ID NO: 6583 - protein, 10 aa, BK virus
QSFHCRPLSA

SEQ ID NO: 6584 - protein, 10 aa, BK virus
SFHCRPLSAI

SEQ ID NO: 6585 - protein, 10 aa, BK virus
FHCRPLSAIR

SEQ ID NO: 6586 - protein, 10 aa, BK virus
HCRPLSAIRH

SEQ ID NO: 6587 - protein, 10 aa, BK virus
CRPLSAIRHG

SEQ ID NO: 6588 - protein, 10 aa, BK virus
RPLSAIRHGF

SEQ ID NO: 6589 - protein, 10 aa, BK virus
PLSAIRHGFG

SEQ ID NO: 6590 - protein, 10 aa, BK virus
LSAIRHGFGI

SEQ ID NO: 6591 - protein, 10 aa, BK virus
SAIRHGFGIV

SEQ ID NO: 6592 - protein, 10 aa, BK virus
YSVSWCKYFC

SEQ ID NO: 6593 - protein, 10 aa, BK virus
ALGSFFVCYY

SEQ ID NO: 6594 - protein, 10 aa, BK virus
LGSFFVCYYF

SEQ ID NO: 6595 - protein, 10 aa, BK virus
GSFFVCYYFP

SEQ ID NO: 6596 - protein, 10 aa, BK virus
SFFVCYYFPG

SEQ ID NO: 6597 - protein, 10 aa, BK virus
FFVCYYFPGF

SEQ ID NO: 6598 - protein, 10 aa, BK virus
FVCYYFPGFV

SEQ ID NO: 6599 - protein, 10 aa, BK virus
VCYYFPGFVA

SEQ ID NO: 6600 - protein, 10 aa, BK virus
CYYFPGFVAC

SEQ ID NO: 6601 - protein, 10 aa, BK virus
YYFPGFVACY

SEQ ID NO: 6602 - protein, 10 aa, BK virus
YTFYNLTGIA

SEQ ID NO: 6603 - protein, 10 aa, BK virus
TFYNLTGIAE

SEQ ID NO: 6604 - protein, 10 aa, BK virus
FYNLTGIAEK

SEQ ID NO: 6605 - protein, 10 aa, BK virus
YNLTGIAEKN

SEQ ID NO: 6606 - protein, 10 aa, BK virus
NLTGIAEKNR

SEQ ID NO: 6607 - protein, 10 aa, BK virus
LTGIAEKNRK

SEQ ID NO: 6608 - protein, 10 aa, BK virus
TGIAEKNRKI

SEQ ID NO: 6609 - protein, 10 aa, BK virus
GIAEKNRKIF

SEQ ID NO: 6610 - protein, 10 aa, BK virus
IFGGNYLDNC

SEQ ID NO: 6611 - protein, 10 aa, BK virus
FGGNYLDNCK

SEQ ID NO: 6612 - protein, 10 aa, BK virus
GGNYLDNCKC

SEQ ID NO: 6613 - protein, 10 aa, BK virus
GNYLDNCKCP

SEQ ID NO: 6614 - protein, 10 aa, BK virus
NYLDNCKCPY

SEQ ID NO: 6615 - protein, 10 aa, BK virus
YLDNCKCPYK

SEQ ID NO: 6616 - protein, 10 aa, BK virus
LDNCKCPYKL

SEQ ID NO: 6617 - protein, 10 aa, BK virus
DNCKCPYKLL

SEQ ID NO: 6618 - protein, 10 aa, BK virus
KGRYPCTFWP

SEQ ID NO: 6619 - protein, 10 aa, BK virus
GRYPCTFWPY

SEQ ID NO: 6620 - protein, 10 aa, BK virus
RYPCTFWPYL

SEQ ID NO: 6621 - protein, 10 aa, BK virus
QYRRSYTKNG

SEQ ID NO: 6622 - protein, 10 aa, BK virus
YRRSYTKNGL

SEQ ID NO: 6623 - protein, 10 aa, BK virus
RRSYTKNGLK

SEQ ID NO: 6624 - protein, 10 aa, BK virus
RSYTKNGLKK

SEQ ID NO: 6625 - protein, 10 aa, BK virus
SYTKNGLKKS

SEQ ID NO: 6626 - protein, 10 aa, BK virus
YTKNGLKKST

SEQ ID NO: 6627 - protein, 10 aa, BK virus
TKNGLKKSTK

SEQ ID NO: 6628 - protein, 10 aa, BK virus
KNGLKKSTKC

SEQ ID NO: 6629 - protein, 10 aa, BK virus
NGLKKSTKCT

SEQ ID NO: 6630 - protein, 10 aa, BK virus
GLKKSTKCTF

SEQ ID NO: 6631 - protein, 10 aa, BK virus
LKKSTKCTFR

SEQ ID NO: 6632 - protein, 10 aa, BK virus
KKSTKCTFRR

SEQ ID NO: 6633 - protein, 10 aa, BK virus
KSTKCTFRRV

SEQ ID NO: 6634 - protein, 10 aa, BK virus
STKCTFRRVY

SEQ ID NO: 6635 - protein, 10 aa, BK virus
TKCTFRRVYR

SEQ ID NO: 6636 - protein, 10 aa, BK virus
KCTFRRVYRK

SEQ ID NO: 6637 - protein, 10 aa, BK virus
CTFRRVYRKN

SEQ ID NO: 6638 - protein, 10 aa, BK virus
TFRRVYRKNY

SEQ ID NO: 6639 - protein, 10 aa, BK virus
FRRVYRKNYC

SEQ ID NO: 6640 - protein, 10 aa, BK virus
RRVYRKNYCP

SEQ ID NO: 6641 - protein, 10 aa, BK virus
RVYRKNYCPR

SEQ ID NO: 6642 - protein, 10 aa, BK virus
VYRKNYCPRR

SEQ ID NO: 6643 - protein, 10 aa, BK virus
YRKNYCPRRC

SEQ ID NO: 6644 - protein, 10 aa, BK virus
SKNCSSMDVA

SEQ ID NO: 6645 - protein, 10 aa, BK virus
KNCSSMDVAF

SEQ ID NO: 6646 - protein, 10 aa, BK virus
NCSSMDVAFT

SEQ ID NO: 6647 - protein, 10 aa, BK virus
CSSMDVAFTS

SEQ ID NO: 6648 - protein, 10 aa, BK virus
SSMDVAFTSR

SEQ ID NO: 6649 - protein, 10 aa, BK virus
SMDVAFTSRP

SEQ ID NO: 6650 - protein, 10 aa, BK virus
MDVAFTSRPV

SEQ ID NO: 6651 - protein, 10 aa, BK virus
DVAFTSRPVR

SEQ ID NO: 6652 - protein, 10 aa, BK virus
VAFTSRPVRD

SEQ ID NO: 6653 - protein, 10 aa, BK virus
AFTSRPVRDC

SEQ ID NO: 6654 - protein, 10 aa, BK virus
FTSRPVRDCN

SEQ ID NO: 6655 - protein, 10 aa, BK virus
TSRPVRDCNT

SEQ ID NO: 6656 - protein, 10 aa, BK virus
SRPVRDCNTC

SEQ ID NO: 6657 - protein, 10 aa, BK virus
RPVRDCNTCS

SEQ ID NO: 6658 - protein, 10 aa, BK virus
RWPQPKEKES

SEQ ID NO: 6659 - protein, 10 aa, BK virus
WPQPKEKESV

SEQ ID NO: 6660 - protein, 10 aa, BK virus
PQPKEKESVQ

SEQ ID NO: 6661 - protein, 10 aa, BK virus
QPKEKESVQG

SEQ ID NO: 6662 - protein, 10 aa, BK virus
PKEKESVQGQ

SEQ ID NO: 6663 - protein, 10 aa, BK virus
KEKESVQGQL

SEQ ID NO: 6664 - protein, 10 aa, BK virus
EKESVQGQLP

SEQ ID NO: 6665 - protein, 10 aa, BK virus
KESVQGQLPK

SEQ ID NO: 6666 - protein, 10 aa, BK virus
ESVQGQLPKS

SEQ ID NO: 6667 - protein, 10 aa, BK virus
SVQGQLPKSQ

SEQ ID NO: 6668 - protein, 10 aa, BK virus
VQGQLPKSQR

SEQ ID NO: 6669 - protein, 10 aa, BK virus
QGQLPKSQRN

SEQ ID NO: 6670 - protein, 10 aa, BK virus
GQLPKSQRNP

SEQ ID NO: 6671 - protein, 10 aa, BK virus
QLPKSQRNPC

SEQ ID NO: 6672 - protein, 10 aa, BK virus
LPKSQRNPCK

SEQ ID NO: 6673 - protein, 10 aa, BK virus
PKSQRNPCKC

SEQ ID NO: 6674 - protein, 10 aa, BK virus
KSQRNPCKCQ

SEQ ID NO: 6675 - protein, 10 aa, BK virus
SQRNPCKCQN

SEQ ID NO: 6676 - protein, 10 aa, BK virus
QRNPCKCQNY

SEQ ID NO: 6677 - protein, 10 aa, BK virus
TQKWGIQMKT

SEQ ID NO: 6678 - protein, 10 aa, BK virus
QKWGIQMKTL

SEQ ID NO: 6679 - protein, 10 aa, BK virus
KWGIQMKTLG

SEQ ID NO: 6680 - protein, 10 aa, BK virus
WGIQMKTLGA

SEQ ID NO: 6681 - protein, 10 aa, BK virus
GIQMKTLGAL

SEQ ID NO: 6682 - protein, 10 aa, BK virus
IQMKTLGALV

SEQ ID NO: 6683 - protein, 10 aa, BK virus
VLKMTLAVIA

SEQ ID NO: 6684 - protein, 10 aa, BK virus
LKMTLAVIAQ

SEQ ID NO: 6685 - protein, 10 aa, BK virus
KMTLAVIAQR

SEQ ID NO: 6686 - protein, 10 aa, BK virus
MTLAVIAQRE

SEQ ID NO: 6687 - protein, 10 aa, BK virus
TLAVIAQREK

SEQ ID NO: 6688 - protein, 10 aa, BK virus
LAVIAQREKC

SEQ ID NO: 6689 - protein, 10 aa, BK virus
AVIAQREKCF

SEQ ID NO: 6690 - protein, 10 aa, BK virus
VIAQREKCFP

SEQ ID NO: 6691 - protein, 10 aa, BK virus
IAQREKCFPV

SEQ ID NO: 6692 - protein, 10 aa, BK virus
AQREKCFPVT

SEQ ID NO: 6693 - protein, 10 aa, BK virus
QREKCFPVTA

SEQ ID NO: 6694 - protein, 10 aa, BK virus
REKCFPVTAQ

SEQ ID NO: 6695 - protein, 10 aa, BK virus
EKCFPVTAQQ

SEQ ID NO: 6696 - protein, 10 aa, BK virus
KCFPVTAQQE

SEQ ID NO: 6697 - protein, 10 aa, BK virus
CFPVTAQQEF

SEQ ID NO: 6698 - protein, 10 aa, BK virus
FPVTAQQEFP

SEQ ID NO: 6699 - protein, 10 aa, BK virus
PVTAQQEFPS

SEQ ID NO: 6700 - protein, 10 aa, BK virus
VTAQQEFPSP

SEQ ID NO: 6701 - protein, 10 aa, BK virus
TAQQEFPSPI

SEQ ID NO: 6702 - protein, 10 aa, BK virus
LACLTFMQGH

SEQ ID NO: 6703 - protein, 10 aa, BK virus
ACLTFMQGHK

SEQ ID NO: 6704 - protein, 10 aa, BK virus
CLTFMQGHKK

SEQ ID NO: 6705 - protein, 10 aa, BK virus
LTFMQGHKKC

SEQ ID NO: 6706 - protein, 10 aa, BK virus
TFMQGHKKCM

SEQ ID NO: 6707 - protein, 10 aa, BK virus
FMQGHKKCMS

SEQ ID NO: 6708 - protein, 10 aa, BK virus
MQGHKKCMSM

SEQ ID NO: 6709 - protein, 10 aa, BK virus
QGHKKCMSMV

SEQ ID NO: 6710 - protein, 10 aa, BK virus
GHKKCMSMVE

SEQ ID NO: 6711 - protein, 10 aa, BK virus
HKKCMSMVEE

SEQ ID NO: 6712 - protein, 10 aa, BK virus
KKCMSMVEEN

SEQ ID NO: 6713 - protein, 10 aa, BK virus
KCMSMVEENL

SEQ ID NO: 6714 - protein, 10 aa, BK virus
CMSMVEENLF

SEQ ID NO: 6715 - protein, 10 aa, BK virus
MSMVEENLFK

SEQ ID NO: 6716 - protein, 10 aa, BK virus
SMVEENLFKA

SEQ ID NO: 6717 - protein, 10 aa, BK virus
MVEENLFKAV

SEQ ID NO: 6718 - protein, 10 aa, BK virus
VEENLFKAVI

SEQ ID NO: 6719 - protein, 10 aa, BK virus
EENLFKAVIS

SEQ ID NO: 6720 - protein, 10 aa, BK virus
ENLFKAVIST

SEQ ID NO: 6721 - protein, 10 aa, BK virus
NLFKAVISTS

SEQ ID NO: 6722 - protein, 10 aa, BK virus
LFKAVISTSL

SEQ ID NO: 6723 - protein, 10 aa, BK virus
FKAVISTSLL

SEQ ID NO: 6724 - protein, 10 aa, BK virus
VENPWKCREC

SEQ ID NO: 6725 - protein, 10 aa, BK virus
ITGQSTLMVL

SEQ ID NO: 6726 - protein, 10 aa, BK virus
PLKTQQPSPR

SEQ ID NO: 6727 - protein, 10 aa, BK virus
ILTIRPIWTK

SEQ ID NO: 6728 - protein, 10 aa, BK virus
LTIRPIWTKT

SEQ ID NO: 6729 - protein, 10 aa, BK virus
TIRPIWTKTM

SEQ ID NO: 6730 - protein, 10 aa, BK virus
IRPIWTKTML

SEQ ID NO: 6731 - protein, 10 aa, BK virus
RPIWTKTMLI

SEQ ID NO: 6732 - protein, 10 aa, BK virus
PIWTKTMLIQ

SEQ ID NO: 6733 - protein, 10 aa, BK virus
IWTKTMLIQL

SEQ ID NO: 6734 - protein, 10 aa, BK virus
WTKTMLIQLS

SEQ ID NO: 6735 - protein, 10 aa, BK virus
TKTMLIQLSA

SEQ ID NO: 6736 - protein, 10 aa, BK virus
KTMLIQLSAG

SEQ ID NO: 6737 - protein, 10 aa, BK virus
TMLIQLSAGY

SEQ ID NO: 6738 - protein, 10 aa, BK virus
MLIQLSAGYL

SEQ ID NO: 6739 - protein, 10 aa, BK virus
LIQLSAGYLI

SEQ ID NO: 6740 - protein, 10 aa, BK virus
IQLSAGYLIP

SEQ ID NO: 6741 - protein, 10 aa, BK virus
QLSAGYLIPV

SEQ ID NO: 6742 - protein, 10 aa, BK virus
LSAGYLIPVE

SEQ ID NO: 6743 - protein, 10 aa, BK virus
SAGYLIPVEM

SEQ ID NO: 6744 - protein, 10 aa, BK virus
AGYLIPVEMK

SEQ ID NO: 6745 - protein, 10 aa, BK virus
GYLIPVEMKM

SEQ ID NO: 6746 - protein, 10 aa, BK virus
YLIPVEMKML

SEQ ID NO: 6747 - protein, 10 aa, BK virus
LIPVEMKMLG

SEQ ID NO: 6748 - protein, 10 aa, BK virus
IPVEMKMLGI

SEQ ID NO: 6749 - protein, 10 aa, BK virus
PVEMKMLGIL

SEQ ID NO: 6750 - protein, 10 aa, BK virus
VEMKMLGILG

SEQ ID NO: 6751 - protein, 10 aa, BK virus
EMKMLGILGL

SEQ ID NO: 6752 - protein, 10 aa, BK virus
MKMLGILGLS

SEQ ID NO: 6753 - protein, 10 aa, BK virus
KMLGILGLSQ

SEQ ID NO: 6754 - protein, 10 aa, BK virus
MLGILGLSQE

SEQ ID NO: 6755 - protein, 10 aa, BK virus
LGILGLSQEG

SEQ ID NO: 6756 - protein, 10 aa, BK virus
GILGLSQEGK

SEQ ID NO: 6757 - protein, 10 aa, BK virus
ILGLSQEGKM

SEQ ID NO: 6758 - protein, 10 aa, BK virus
LGLSQEGKMF

SEQ ID NO: 6759 - protein, 10 aa, BK virus
GLSQEGKMFP

SEQ ID NO: 6760 - protein, 10 aa, BK virus
LSQEGKMFPQ

SEQ ID NO: 6761 - protein, 10 aa, BK virus
SQEGKMFPQY

SEQ ID NO: 6762 - protein, 10 aa, BK virus
QEGKMFPQYF

SEQ ID NO: 6763 - protein, 10 aa, BK virus
EGKMFPQYFM

SEQ ID NO: 6764 - protein, 10 aa, BK virus
MNRVWGLFVK

SEQ ID NO: 6765 - protein, 10 aa, BK virus
NRVWGLFVKL

SEQ ID NO: 6766 - protein, 10 aa, BK virus
RVWGLFVKLI

SEQ ID NO: 6767 - protein, 10 aa, BK virus
VWGLFVKLIA

SEQ ID NO: 6768 - protein, 10 aa, BK virus
WGLFVKLIAC

SEQ ID NO: 6769 - protein, 10 aa, BK virus
GLFVKLIACM

SEQ ID NO: 6770 - protein, 10 aa, BK virus
LFVKLIACMF

SEQ ID NO: 6771 - protein, 10 aa, BK virus
FVKLIACMFQ

SEQ ID NO: 6772 - protein, 10 aa, BK virus
VKLIACMFQL

SEQ ID NO: 6773 - protein, 10 aa, BK virus
KLIACMFQLL

SEQ ID NO: 6774 - protein, 10 aa, BK virus
LIACMFQLLI

SEQ ID NO: 6775 - protein, 10 aa, BK virus
IACMFQLLIF

SEQ ID NO: 6776 - protein, 10 aa, BK virus
ACMFQLLIFV

SEQ ID NO: 6777 - protein, 10 aa, BK virus
CMFQLLIFVA

SEQ ID NO: 6778 - protein, 10 aa, BK virus
MFQLLIFVAC

SEQ ID NO: 6779 - protein, 10 aa, BK virus
FQLLIFVACL

SEQ ID NO: 6780 - protein, 10 aa, BK virus
QLLIFVACLL

SEQ ID NO: 6781 - protein, 10 aa, BK virus
LLIFVACLLT

SEQ ID NO: 6782 - protein, 10 aa, BK virus
LIFVACLLTA

SEQ ID NO: 6783 - protein, 10 aa, BK virus
IFVACLLTAL

SEQ ID NO: 6784 - protein, 10 aa, BK virus
FVACLLTALE

SEQ ID NO: 6785 - protein, 10 aa, BK virus
VACLLTALEH

SEQ ID NO: 6786 - protein, 10 aa, BK virus
ACLLTALEHN

SEQ ID NO: 6787 - protein, 10 aa, BK virus
CLLTALEHNS

SEQ ID NO: 6788 - protein, 10 aa, BK virus
LLTALEHNSG

SEQ ID NO: 6789 - protein, 10 aa, BK virus
LTALEHNSGE

SEQ ID NO: 6790 - protein, 10 aa, BK virus
TALEHNSGEA

SEQ ID NO: 6791 - protein, 10 aa, BK virus
ALEHNSGEAL

SEQ ID NO: 6792 - protein, 10 aa, BK virus
LEHNSGEALQ

SEQ ID NO: 6793 - protein, 10 aa, BK virus
EHNSGEALQD

SEQ ID NO: 6794 - protein, 10 aa, BK virus
HNSGEALQDI

SEQ ID NO: 6795 - protein, 10 aa, BK virus
NSGEALQDIL

SEQ ID NO: 6796 - protein, 10 aa, BK virus
SGEALQDILR

SEQ ID NO: 6797 - protein, 10 aa, BK virus
GEALQDILRS

SEQ ID NO: 6798 - protein, 10 aa, BK virus
EALQDILRSA

SEQ ID NO: 6799 - protein, 10 aa, BK virus
TGEPREWMGS

SEQ ID NO: 6800 - protein, 10 aa, BK virus
GEPREWMGSL

SEQ ID NO: 6801 - protein, 10 aa, BK virus
EPREWMGSLC

SEQ ID NO: 6802 - protein, 10 aa, BK virus
PREWMGSLCM

SEQ ID NO: 6803 - protein, 10 aa, BK virus
REWMGSLCMV

SEQ ID NO: 6804 - protein, 10 aa, BK virus
EWMGSLCMVW

SEQ ID NO: 6805 - protein, 10 aa, BK virus
WMGSLCMVWN

SEQ ID NO: 6806 - protein, 10 aa, BK virus
MGSLCMVWNP

SEQ ID NO: 6807 - protein, 10 aa, BK virus
GSLCMVWNPR

SEQ ID NO: 6808 - protein, 10 aa, BK virus
KRLGCLMAQK

SEQ ID NO: 6809 - protein, 10 aa, BK virus
RLGCLMAQKD

SEQ ID NO: 6810 - protein, 10 aa, BK virus
LGCLMAQKDF

SEQ ID NO: 6811 - protein, 10 aa, BK virus
GCLMAQKDFQ

SEQ ID NO: 6812 - protein, 10 aa, BK virus
CLMAQKDFQG

SEQ ID NO: 6813 - protein, 10 aa, BK virus
LMAQKDFQGT

SEQ ID NO: 6814 - protein, 10 aa, BK virus
MAQKDFQGTQ

SEQ ID NO: 6815 - protein, 10 aa, BK virus
AQKDFQGTQI

SEQ ID NO: 6816 - protein, 10 aa, BK virus
DILTNRDNCK

SEQ ID NO: 6817 - protein, 10 aa, BK virus
ILTNRDNCKP

SEQ ID NO: 6818 - protein, 10 aa, BK virus
LTNRDNCKPK

SEQ ID NO: 6819 - protein, 10 aa, BK virus
TNRDNCKPKC

SEQ ID NO: 6820 - protein, 10 aa, BK virus
NRDNCKPKCF

SEQ ID NO: 6821 - protein, 10 aa, BK virus
RDNCKPKCFK

SEQ ID NO: 6822 - protein, 10 aa, BK virus
DNCKPKCFKQ

SEQ ID NO: 6823 - protein, 10 aa, BK virus
NCKPKCFKQV

SEQ ID NO: 6824 - protein, 10 aa, BK virus
CKPKCFKQVL

SEQ ID NO: 6825 - protein, 10 aa, BK virus
KPKCFKQVLL

SEQ ID NO: 6826 - protein, 10 aa, BK virus
PKCFKQVLLL

SEQ ID NO: 6827 - protein, 10 aa, BK virus
KCFKQVLLLY

SEQ ID NO: 6828 - protein, 10 aa, BK virus
CFKQVLLLYI

SEQ ID NO: 6829 - protein, 10 aa, BK virus
FKQVLLLYIY

SEQ ID NO: 6830 - protein, 10 aa, BK virus
KQVLLLYIYI

SEQ ID NO: 6831 - protein, 10 aa, BK virus
MLLLYKPLLS

SEQ ID NO: 6832 - protein, 10 aa, BK virus
LLLYKPLLSL

SEQ ID NO: 6833 - protein, 10 aa, BK virus
LLYKPLLSLC

SEQ ID NO: 6834 - protein, 10 aa, BK virus
LYKPLLSLCY

SEQ ID NO: 6835 - protein, 10 aa, BK virus
YKPLLSLCYF

SEQ ID NO: 6836 - protein, 10 aa, BK virus
KPLLSLCYFG

SEQ ID NO: 6837 - protein, 10 aa, BK virus
PLLSLCYFGG

SEQ ID NO: 6838 - protein, 10 aa, BK virus
LLSLCYFGGG

SEQ ID NO: 6839 - protein, 10 aa, BK virus
LSLCYFGGGV

SEQ ID NO: 6840 - protein, 10 aa, BK virus
SLCYFGGGVL

SEQ ID NO: 6841 - protein, 10 aa, BK virus
LCYFGGGVLG

SEQ ID NO: 6842 - protein, 10 aa, BK virus
CYFGGGVLGL

SEQ ID NO: 6843 - protein, 10 aa, BK virus
YFGGGVLGLL

SEQ ID NO: 6844 - protein, 10 aa, BK virus
FGGGVLGLLK

SEQ ID NO: 6845 - protein, 10 aa, BK virus
GGGVLGLLKH

SEQ ID NO: 6846 - protein, 10 aa, BK virus
LWGSDLWESS

SEQ ID NO: 6847 - protein, 10 aa, BK virus
WGSDLWESSA

SEQ ID NO: 6848 - protein, 10 aa, BK virus
GSDLWESSAG

SEQ ID NO: 6849 - protein, 10 aa, BK virus
SDLWESSAGA

SEQ ID NO: 6850 - protein, 10 aa, BK virus
DLWESSAGAE

SEQ ID NO: 6851 - protein, 10 aa, BK virus
LWESSAGAEV

SEQ ID NO: 6852 - protein, 10 aa, BK virus
WESSAGAEVS

SEQ ID NO: 6853 - protein, 10 aa, BK virus
ESSAGAEVSE

SEQ ID NO: 6854 - protein, 10 aa, BK virus
SSAGAEVSET

SEQ ID NO: 6855 - protein, 10 aa, BK virus
SAGAEVSETW

SEQ ID NO: 6856 - protein, 10 aa, BK virus
AGAEVSETWE

SEQ ID NO: 6857 - protein, 10 aa, BK virus
GAEVSETWEE

SEQ ID NO: 6858 - protein, 10 aa, BK virus
AEVSETWEEH

SEQ ID NO: 6859 - protein, 10 aa, BK virus
EVSETWEEHC

SEQ ID NO: 6860 - protein, 10 aa, BK virus
VSETWEEHCD

SEQ ID NO: 6861 - protein, 10 aa, BK virus
SETWEEHCDW

SEQ ID NO: 6862 - protein, 10 aa, BK virus
ETWEEHCDWD

SEQ ID NO: 6863 - protein, 10 aa, BK virus
TWEEHCDWDS

SEQ ID NO: 6864 - protein, 10 aa, BK virus
WEEHCDWDSV

SEQ ID NO: 6865 - protein, 10 aa, BK virus
EEHCDWDSVL

SEQ ID NO: 6866 - protein, 10 aa, BK virus
EHCDWDSVLD

SEQ ID NO: 6867 - protein, 10 aa, BK virus
HCDWDSVLDP

SEQ ID NO: 6868 - protein, 10 aa, BK virus
CDWDSVLDPC

SEQ ID NO: 6869 - protein, 10 aa, BK virus
DWDSVLDPCP

SEQ ID NO: 6870 - protein, 10 aa, BK virus
WDSVLDPCPE

SEQ ID NO: 6871 - protein, 10 aa, BK virus
DSVLDPCPES

SEQ ID NO: 6872 - protein, 10 aa, BK virus
SVLDPCPESS

SEQ ID NO: 6873 - protein, 10 aa, BK virus
VLDPCPESSV

SEQ ID NO: 6874 - protein, 10 aa, BK virus
LDPCPESSVS

SEQ ID NO: 6875 - protein, 10 aa, BK virus
DPCPESSVSE

SEQ ID NO: 6876 - protein, 10 aa, BK virus
PCPESSVSES

SEQ ID NO: 6877 - protein, 10 aa, BK virus
CPESSVSESS

SEQ ID NO: 6878 - protein, 10 aa, BK virus
PESSVSESSS

SEQ ID NO: 6879 - protein, 10 aa, BK virus
ESSVSESSSL

SEQ ID NO: 6880 - protein, 10 aa, BK virus
SSVSESSSLV

SEQ ID NO: 6881 - protein, 10 aa, BK virus
SVSESSSLVI

SEQ ID NO: 6882 - protein, 10 aa, BK virus
VSESSSLVIS

SEQ ID NO: 6883 - protein, 10 aa, BK virus
SESSSLVISR

SEQ ID NO: 6884 - protein, 10 aa, BK virus
ESSSLVISRI

SEQ ID NO: 6885 - protein, 10 aa, BK virus
SSSLVISRIH

SEQ ID NO: 6886 - protein, 10 aa, BK virus
SSLVISRIHF

SEQ ID NO: 6887 - protein, 10 aa, BK virus
SLVISRIHFP

SEQ ID NO: 6888 - protein, 10 aa, BK virus
LVISRIHFPM

SEQ ID NO: 6889 - protein, 10 aa, BK virus
VISRIHFPMH

SEQ ID NO: 6890 - protein, 10 aa, BK virus
ISRIHFPMHI

SEQ ID NO: 6891 - protein, 10 aa, BK virus
SRIHFPMHIL

SEQ ID NO: 6892 - protein, 10 aa, BK virus
RIHFPMHILY

SEQ ID NO: 6893 - protein, 10 aa, BK virus
IHFPMHILYF

SEQ ID NO: 6894 - protein, 10 aa, BK virus
HFPMHILYFI

SEQ ID NO: 6895 - protein, 10 aa, BK virus
FPMHILYFIL

SEQ ID NO: 6896 - protein, 10 aa, BK virus
PMHILYFILE

SEQ ID NO: 6897 - protein, 10 aa, BK virus
MHILYFILEK

SEQ ID NO: 6898 - protein, 10 aa, BK virus
HILYFILEKV

SEQ ID NO: 6899 - protein, 10 aa, BK virus
ILYFILEKVY

SEQ ID NO: 6900 - protein, 10 aa, BK virus
LYFILEKVYI

SEQ ID NO: 6901 - protein, 10 aa, BK virus
YFILEKVYIL

SEQ ID NO: 6902 - protein, 10 aa, BK virus
FILEKVYILI

SEQ ID NO: 6903 - protein, 10 aa, BK virus
ILEKVYILIS

SEQ ID NO: 6904 - protein, 10 aa, BK virus
LEKVYILISE

SEQ ID NO: 6905 - protein, 10 aa, BK virus
EKVYILISES

SEQ ID NO: 6906 - protein, 10 aa, BK virus
KVYILISESS

SEQ ID NO: 6907 - protein, 10 aa, BK virus
VYILISESSL

SEQ ID NO: 6908 - protein, 10 aa, BK virus
YILISESSLS

SEQ ID NO: 6909 - protein, 10 aa, BK virus
ILISESSLSF

SEQ ID NO: 6910 - protein, 10 aa, BK virus
LISESSLSFH

SEQ ID NO: 6911 - protein, 10 aa, BK virus
ISESSLSFHS

SEQ ID NO: 6912 - protein, 10 aa, BK virus
SESSLSFHST

SEQ ID NO: 6913 - protein, 10 aa, BK virus
ESSLSFHSTI

SEQ ID NO: 6914 - protein, 10 aa, BK virus
SSLSFHSTIL

SEQ ID NO: 6915 - protein, 10 aa, BK virus
SLSFHSTILD

SEQ ID NO: 6916 - protein, 10 aa, BK virus
LSFHSTILDC

SEQ ID NO: 6917 - protein, 10 aa, BK virus
SFHSTILDCI

SEQ ID NO: 6918 - protein, 10 aa, BK virus
FHSTILDCIS

SEQ ID NO: 6919 - protein, 10 aa, BK virus
HSTILDCISV

SEQ ID NO: 6920 - protein, 10 aa, BK virus
STILDCISVA

SEQ ID NO: 6921 - protein, 10 aa, BK virus
TILDCISVAK

SEQ ID NO: 6922 - protein, 10 aa, BK virus
ILDCISVAKS

SEQ ID NO: 6923 - protein, 10 aa, BK virus
LDCISVAKSA

SEQ ID NO: 6924 - protein, 10 aa, BK virus
DCISVAKSAT

SEQ ID NO: 6925 - protein, 10 aa, BK virus
CISVAKSATG

SEQ ID NO: 6926 - protein, 10 aa, BK virus
ISVAKSATGL

SEQ ID NO: 6927 - protein, 10 aa, BK virus
SVAKSATGLN

SEQ ID NO: 6928 - protein, 10 aa, BK virus
VAKSATGLNQ

SEQ ID NO: 6929 - protein, 10 aa, BK virus
AKSATGLNQI

SEQ ID NO: 6930 - protein, 10 aa, BK virus
KSATGLNQIS

SEQ ID NO: 6931 - protein, 10 aa, BK virus
SATGLNQISS

SEQ ID NO: 6932 - protein, 10 aa, BK virus
ATGLNQISSS

SEQ ID NO: 6933 - protein, 10 aa, BK virus
TGLNQISSSN

SEQ ID NO: 6934 - protein, 10 aa, BK virus
GLNQISSSNK

SEQ ID NO: 6935 - protein, 10 aa, BK virus
LNQISSSNKV

SEQ ID NO: 6936 - protein, 10 aa, BK virus
NQISSSNKVI

SEQ ID NO: 6937 - protein, 10 aa, BK virus
QISSSNKVIP

SEQ ID NO: 6938 - protein, 10 aa, BK virus
ISSSNKVIPL

SEQ ID NO: 6939 - protein, 10 aa, BK virus
SSSNKVIPLC

SEQ ID NO: 6940 - protein, 10 aa, BK virus
SSNKVIPLCK

SEQ ID NO: 6941 - protein, 10 aa, BK virus
SNKVIPLCKI

SEQ ID NO: 6942 - protein, 10 aa, BK virus
NKVIPLCKIL

SEQ ID NO: 6943 - protein, 10 aa, BK virus
KVIPLCKILF

SEQ ID NO: 6944 - protein, 10 aa, BK virus
VIPLCKILFS

SEQ ID NO: 6945 - protein, 10 aa, BK virus
IPLCKILFSS

SEQ ID NO: 6946 - protein, 10 aa, BK virus
PLCKILFSSK

SEQ ID NO: 6947 - protein, 10 aa, BK virus
LCKILFSSKN

SEQ ID NO: 6948 - protein, 10 aa, BK virus
CKILFSSKNS

SEQ ID NO: 6949 - protein, 10 aa, BK virus
KILFSSKNSE

SEQ ID NO: 6950 - protein, 10 aa, BK virus
ILFSSKNSEF

SEQ ID NO: 6951 - protein, 10 aa, BK virus
LFSSKNSEFC

SEQ ID NO: 6952 - protein, 10 aa, BK virus
FSSKNSEFCK

SEQ ID NO: 6953 - protein, 10 aa, BK virus
SSKNSEFCKD

SEQ ID NO: 6954 - protein, 10 aa, BK virus
SKNSEFCKDF

SEQ ID NO: 6955 - protein, 10 aa, BK virus
KNSEFCKDFL

SEQ ID NO: 6956 - protein, 10 aa, BK virus
NSEFCKDFLK

SEQ ID NO: 6957 - protein, 10 aa, BK virus
SEFCKDFLKY

SEQ ID NO: 6958 - protein, 10 aa, BK virus
EFCKDFLKYI

SEQ ID NO: 6959 - protein, 10 aa, BK virus
FCKDFLKYIL

SEQ ID NO: 6960 - protein, 10 aa, BK virus
CKDFLKYILG

SEQ ID NO: 6961 - protein, 10 aa, BK virus
KDFLKYILGL

SEQ ID NO: 6962 - protein, 10 aa, BK virus
DFLKYILGLK

SEQ ID NO: 6963 - protein, 10 aa, BK virus
FLKYILGLKS

SEQ ID NO: 6964 - protein, 10 aa, BK virus
LKYILGLKSI

SEQ ID NO: 6965 - protein, 10 aa, BK virus
KYILGLKSIC

SEQ ID NO: 6966 - protein, 10 aa, BK virus
YILGLKSICL

SEQ ID NO: 6967 - protein, 10 aa, BK virus
ILGLKSICLT

SEQ ID NO: 6968 - protein, 10 aa, BK virus
LGLKSICLTN

SEQ ID NO: 6969 - protein, 10 aa, BK virus
GLKSICLTNL

SEQ ID NO: 6970 - protein, 10 aa, BK virus
LKSICLTNLA

SEQ ID NO: 6971 - protein, 10 aa, BK virus
KSICLTNLAC

SEQ ID NO: 6972 - protein, 10 aa, BK virus
SICLTNLACR

SEQ ID NO: 6973 - protein, 10 aa, BK virus
ICLTNLACRV

SEQ ID NO: 6974 - protein, 10 aa, BK virus
CLTNLACRVL

SEQ ID NO: 6975 - protein, 10 aa, BK virus
LTNLACRVLG

SEQ ID NO: 6976 - protein, 10 aa, BK virus
TNLACRVLGT

SEQ ID NO: 6977 - protein, 10 aa, BK virus
NLACRVLGTG

SEQ ID NO: 6978 - protein, 10 aa, BK virus
LACRVLGTGY

SEQ ID NO: 6979 - protein, 10 aa, BK virus
ACRVLGTGYS

SEQ ID NO: 6980 - protein, 10 aa, BK virus
CRVLGTGYSF

SEQ ID NO: 6981 - protein, 10 aa, BK virus
RVLGTGYSFI

SEQ ID NO: 6982 - protein, 10 aa, BK virus
VLGTGYSFIV

SEQ ID NO: 6983 - protein, 10 aa, BK virus
LGTGYSFIVT

SEQ ID NO: 6984 - protein, 10 aa, BK virus
GTGYSFIVTK

SEQ ID NO: 6985 - protein, 10 aa, BK virus
TGYSFIVTKP

SEQ ID NO: 6986 - protein, 10 aa, BK virus
GYSFIVTKPG

SEQ ID NO: 6987 - protein, 10 aa, BK virus
YSFIVTKPGG

SEQ ID NO: 6988 - protein, 10 aa, BK virus
SFIVTKPGGN

SEQ ID NO: 6989 - protein, 10 aa, BK virus
FIVTKPGGNI

SEQ ID NO: 6990 - protein, 10 aa, BK virus
IVTKPGGNIW

SEQ ID NO: 6991 - protein, 10 aa, BK virus
VTKPGGNIWV

SEQ ID NO: 6992 - protein, 10 aa, BK virus
TKPGGNIWVL

SEQ ID NO: 6993 - protein, 10 aa, BK virus
KPGGNIWVLL

SEQ ID NO: 6994 - protein, 10 aa, BK virus
PGGNIWVLLF

SEQ ID NO: 6995 - protein, 10 aa, BK virus
GGNIWVLLFK

SEQ ID NO: 6996 - protein, 10 aa, BK virus
GNIWVLLFKC

SEQ ID NO: 6997 - protein, 10 aa, BK virus
NIWVLLFKCF

SEQ ID NO: 6998 - protein, 10 aa, BK virus
IWVLLFKCFF

SEQ ID NO: 6999 - protein, 10 aa, BK virus
WVLLFKCFFS

SEQ ID NO: 7000 - protein, 10 aa, BK virus
VLLFKCFFSK

SEQ ID NO: 7001 - protein, 10 aa, BK virus
LLFKCFFSKF

SEQ ID NO: 7002 - protein, 10 aa, BK virus
LFKCFFSKFT

SEQ ID NO: 7003 - protein, 10 aa, BK virus
FKCFFSKFTL

SEQ ID NO: 7004 - protein, 10 aa, BK virus
KCFFSKFTLT

SEQ ID NO: 7005 - protein, 10 aa, BK virus
CFFSKFTLTL

SEQ ID NO: 7006 - protein, 10 aa, BK virus
FFSKFTLTLP

SEQ ID NO: 7007 - protein, 10 aa, BK virus
FSKFTLTLPS

SEQ ID NO: 7008 - protein, 10 aa, BK virus
SKFTLTLPSK

SEQ ID NO: 7009 - protein, 10 aa, BK virus
SLKLSKLFIP

SEQ ID NO: 7010 - protein, 10 aa, BK virus
LKLSKLFIPC

SEQ ID NO: 7011 - protein, 10 aa, BK virus
KLSKLFIPCP

SEQ ID NO: 7012 - protein, 10 aa, BK virus
LSKLFIPCPE

SEQ ID NO: 7013 - protein, 10 aa, BK virus
SKLFIPCPEG

SEQ ID NO: 7014 - protein, 10 aa, BK virus
KLFIPCPEGK

SEQ ID NO: 7015 - protein, 10 aa, BK virus
LFIPCPEGKS

SEQ ID NO: 7016 - protein, 10 aa, BK virus
FIPCPEGKSF

SEQ ID NO: 7017 - protein, 10 aa, BK virus
IPCPEGKSFD

SEQ ID NO: 7018 - protein, 10 aa, BK virus
PCPEGKSFDS

SEQ ID NO: 7019 - protein, 10 aa, BK virus
CPEGKSFDSA

SEQ ID NO: 7020 - protein, 10 aa, BK virus
PEGKSFDSAP

SEQ ID NO: 7021 - protein, 10 aa, BK virus
EGKSFDSAPV

SEQ ID NO: 7022 - protein, 10 aa, BK virus
GKSFDSAPVP

SEQ ID NO: 7023 - protein, 10 aa, BK virus
KSFDSAPVPF

SEQ ID NO: 7024 - protein, 10 aa, BK virus
SFDSAPVPFT

SEQ ID NO: 7025 - protein, 10 aa, BK virus
FDSAPVPFTS

SEQ ID NO: 7026 - protein, 10 aa, BK virus
DSAPVPFTSS

SEQ ID NO: 7027 - protein, 10 aa, BK virus
SAPVPFTSSK

SEQ ID NO: 7028 - protein, 10 aa, BK virus
APVPFTSSKT

SEQ ID NO: 7029 - protein, 10 aa, BK virus
PVPFTSSKTT

SEQ ID NO: 7030 - protein, 10 aa, BK virus
VPFTSSKTTM

SEQ ID NO: 7031 - protein, 10 aa, BK virus
PFTSSKTTMY

SEQ ID NO: 7032 - protein, 10 aa, BK virus
SIATPSSKVS

SEQ ID NO: 7033 - protein, 10 aa, BK virus
IATPSSKVSL

SEQ ID NO: 7034 - protein, 10 aa, BK virus
ATPSSKVSLS

SEQ ID NO: 7035 - protein, 10 aa, BK virus
TPSSKVSLSM

SEQ ID NO: 7036 - protein, 10 aa, BK virus
PSSKVSLSMG

SEQ ID NO: 7037 - protein, 10 aa, BK virus
SSKVSLSMGR

SEQ ID NO: 7038 - protein, 10 aa, BK virus
SKVSLSMGRF

SEQ ID NO: 7039 - protein, 10 aa, BK virus
KVSLSMGRFT

SEQ ID NO: 7040 - protein, 10 aa, BK virus
VSLSMGRFTF

SEQ ID NO: 7041 - protein, 10 aa, BK virus
SLSMGRFTFK

SEQ ID NO: 7042 - protein, 10 aa, BK virus
LSMGRFTFKA

SEQ ID NO: 7043 - protein, 10 aa, BK virus
SMGRFTFKAL

SEQ ID NO: 7044 - protein, 10 aa, BK virus
MGRFTFKALP

SEQ ID NO: 7045 - protein, 10 aa, BK virus
GRFTFKALPP

SEQ ID NO: 7046 - protein, 10 aa, BK virus
RFTFKALPPH

SEQ ID NO: 7047 - protein, 10 aa, BK virus
FTFKALPPHK

SEQ ID NO: 7048 - protein, 10 aa, BK virus
TFKALPPHKS

SEQ ID NO: 7049 - protein, 10 aa, BK virus
FKALPPHKSN

SEQ ID NO: 7050 - protein, 10 aa, BK virus
KALPPHKSNN

SEQ ID NO: 7051 - protein, 10 aa, BK virus
ALPPHKSNNP

SEQ ID NO: 7052 - protein, 10 aa, BK virus
LPPHKSNNPA

SEQ ID NO: 7053 - protein, 10 aa, BK virus
PPHKSNNPAA

SEQ ID NO: 7054 - protein, 10 aa, BK virus
PHKSNNPAAS

SEQ ID NO: 7055 - protein, 10 aa, BK virus
HKSNNPAASV

SEQ ID NO: 7056 - protein, 10 aa, BK virus
KSNNPAASVV

SEQ ID NO: 7057 - protein, 10 aa, BK virus
SNNPAASVVF

SEQ ID NO: 7058 - protein, 10 aa, BK virus
NNPAASVVFP

SEQ ID NO: 7059 - protein, 10 aa, BK virus
NPAASVVFPL

SEQ ID NO: 7060 - protein, 10 aa, BK virus
PAASVVFPLS

SEQ ID NO: 7061 - protein, 10 aa, BK virus
AASVVFPLSM

SEQ ID NO: 7062 - protein, 10 aa, BK virus
ASVVFPLSMG

SEQ ID NO: 7063 - protein, 10 aa, BK virus
SVVFPLSMGP

SEQ ID NO: 7064 - protein, 10 aa, BK virus
VVFPLSMGPL

SEQ ID NO: 7065 - protein, 10 aa, BK virus
VFPLSMGPLN

SEQ ID NO: 7066 - protein, 10 aa, BK virus
FPLSMGPLNN

SEQ ID NO: 7067 - protein, 10 aa, BK virus
PLSMGPLNNQ

SEQ ID NO: 7068 - protein, 10 aa, BK virus
LSMGPLNNQY

SEQ ID NO: 7069 - protein, 10 aa, BK virus
SMGPLNNQYL

SEQ ID NO: 7070 - protein, 10 aa, BK virus
MGPLNNQYLL

SEQ ID NO: 7071 - protein, 10 aa, BK virus
GPLNNQYLLL

SEQ ID NO: 7072 - protein, 10 aa, BK virus
PLNNQYLLLG

SEQ ID NO: 7073 - protein, 10 aa, BK virus
LNNQYLLLGT

SEQ ID NO: 7074 - protein, 10 aa, BK virus
NNQYLLLGTL

SEQ ID NO: 7075 - protein, 10 aa, BK virus
NQYLLLGTLK

SEQ ID NO: 7076 - protein, 10 aa, BK virus
QYLLLGTLKT

SEQ ID NO: 7077 - protein, 10 aa, BK virus
YLLLGTLKTI

SEQ ID NO: 7078 - protein, 10 aa, BK virus
LLLGTLKTIQ

SEQ ID NO: 7079 - protein, 10 aa, BK virus
LLGTLKTIQC

SEQ ID NO: 7080 - protein, 10 aa, BK virus
LGTLKTIQCK

SEQ ID NO: 7081 - protein, 10 aa, BK virus
GTLKTIQCKK

SEQ ID NO: 7082 - protein, 10 aa, BK virus
TLKTIQCKKS

SEQ ID NO: 7083 - protein, 10 aa, BK virus
LKTIQCKKSN

SEQ ID NO: 7084 - protein, 10 aa, BK virus
KTIQCKKSNI

SEQ ID NO: 7085 - protein, 10 aa, BK virus
TIQCKKSNIT

SEQ ID NO: 7086 - protein, 10 aa, BK virus
IQCKKSNITE

SEQ ID NO: 7087 - protein, 10 aa, BK virus
QCKKSNITES

SEQ ID NO: 7088 - protein, 10 aa, BK virus
CKKSNITESI

SEQ ID NO: 7089 - protein, 10 aa, BK virus
KKSNITESIL

SEQ ID NO: 7090 - protein, 10 aa, BK virus
KSNITESILG

SEQ ID NO: 7091 - protein, 10 aa, BK virus
SNITESILGS

SEQ ID NO: 7092 - protein, 10 aa, BK virus
NITESILGSK

SEQ ID NO: 7093 - protein, 10 aa, BK virus
ITESILGSKQ

SEQ ID NO: 7094 - protein, 10 aa, BK virus
TESILGSKQC

SEQ ID NO: 7095 - protein, 10 aa, BK virus
ESILGSKQCS

SEQ ID NO: 7096 - protein, 10 aa, BK virus
SILGSKQCSQ

SEQ ID NO: 7097 - protein, 10 aa, BK virus
ILGSKQCSQA

SEQ ID NO: 7098 - protein, 10 aa, BK virus
LGSKQCSQAT

SEQ ID NO: 7099 - protein, 10 aa, BK virus
GSKQCSQATP

SEQ ID NO: 7100 - protein, 10 aa, BK virus
SKQCSQATPA

SEQ ID NO: 7101 - protein, 10 aa, BK virus
KQCSQATPAI

SEQ ID NO: 7102 - protein, 10 aa, BK virus
QCSQATPAIY

SEQ ID NO: 7103 - protein, 10 aa, BK virus
CSQATPAIYC

SEQ ID NO: 7104 - protein, 10 aa, BK virus
SQATPAIYCS

SEQ ID NO: 7105 - protein, 10 aa, BK virus
QATPAIYCSS

SEQ ID NO: 7106 - protein, 10 aa, BK virus
ATPAIYCSST

SEQ ID NO: 7107 - protein, 10 aa, BK virus
TPAIYCSSTA

SEQ ID NO: 7108 - protein, 10 aa, BK virus
PAIYCSSTAF

SEQ ID NO: 7109 - protein, 10 aa, BK virus
AIYCSSTAFP

SEQ ID NO: 7110 - protein, 10 aa, BK virus
APNIKSILSN

SEQ ID NO: 7111 - protein, 10 aa, BK virus
PNIKSILSNI

SEQ ID NO: 7112 - protein, 10 aa, BK virus
LNLSVSISSL

SEQ ID NO: 7113 - protein, 10 aa, BK virus
NLSVSISSLV

SEQ ID NO: 7114 - protein, 10 aa, BK virus
LSVSISSLVI

SEQ ID NO: 7115 - protein, 10 aa, BK virus
RVSTLFLAKT

SEQ ID NO: 7116 - protein, 10 aa, BK virus
VSTLFLAKTV

SEQ ID NO: 7117 - protein, 10 aa, BK virus
STLFLAKTVS

SEQ ID NO: 7118 - protein, 10 aa, BK virus
TLFLAKTVST

SEQ ID NO: 7119 - protein, 10 aa, BK virus
LFLAKTVSTA

SEQ ID NO: 7120 - protein, 10 aa, BK virus
FLAKTVSTAC

SEQ ID NO: 7121 - protein, 10 aa, BK virus
FLLSAKIIAF

SEQ ID NO: 7122 - protein, 10 aa, BK virus
LLSAKIIAFA

SEQ ID NO: 7123 - protein, 10 aa, BK virus
LSAKIIAFAK

SEQ ID NO: 7124 - protein, 10 aa, BK virus
SAKIIAFAKC

SEQ ID NO: 7125 - protein, 10 aa, BK virus
AKIIAFAKCF

SEQ ID NO: 7126 - protein, 10 aa, BK virus
KIIAFAKCFS

SEQ ID NO: 7127 - protein, 10 aa, BK virus
NSKYIPNNKN

SEQ ID NO: 7128 - protein, 10 aa, BK virus
SKYIPNNKNT

SEQ ID NO: 7129 - protein, 10 aa, BK virus
KYIPNNKNTS

SEQ ID NO: 7130 - protein, 10 aa, BK virus
YIPNNKNTSS

SEQ ID NO: 7131 - protein, 10 aa, BK virus
IPNNKNTSSH

SEQ ID NO: 7132 - protein, 10 aa, BK virus
PNNKNTSSHF

SEQ ID NO: 7133 - protein, 10 aa, BK virus
NNKNTSSHFV

SEQ ID NO: 7134 - protein, 10 aa, BK virus
NKNTSSHFVS

SEQ ID NO: 7135 - protein, 10 aa, BK virus
KNTSSHFVST

SEQ ID NO: 7136 - protein, 10 aa, BK virus
NTSSHFVSTA

SEQ ID NO: 7137 - protein, 10 aa, BK virus
TSSHFVSTAY

SEQ ID NO: 7138 - protein, 10 aa, BK virus
SSHFVSTAYS

SEQ ID NO: 7139 - protein, 10 aa, BK virus
SHFVSTAYSV

SEQ ID NO: 7140 - protein, 10 aa, BK virus
HFVSTAYSVI

SEQ ID NO: 7141 - protein, 10 aa, BK virus
FVSTAYSVIN

SEQ ID NO: 7142 - protein, 10 aa, BK virus
VSTAYSVINF

SEQ ID NO: 7143 - protein, 10 aa, BK virus
STAYSVINFQ

SEQ ID NO: 7144 - protein, 10 aa, BK virus
TAYSVINFQD

SEQ ID NO: 7145 - protein, 10 aa, BK virus
AYSVINFQDT

SEQ ID NO: 7146 - protein, 10 aa, BK virus
YSVINFQDTC

SEQ ID NO: 7147 - protein, 10 aa, BK virus
SVINFQDTCF

SEQ ID NO: 7148 - protein, 10 aa, BK virus
VINFQDTCFV

SEQ ID NO: 7149 - protein, 10 aa, BK virus
INFQDTCFVS

SEQ ID NO: 7150 - protein, 10 aa, BK virus
NFQDTCFVSS

SEQ ID NO: 7151 - protein, 10 aa, BK virus
FQDTCFVSSG

SEQ ID NO: 7152 - protein, 10 aa, BK virus
QDTCFVSSGS

SEQ ID NO: 7153 - protein, 10 aa, BK virus
DTCFVSSGSS

SEQ ID NO: 7154 - protein, 10 aa, BK virus
TCFVSSGSSG

SEQ ID NO: 7155 - protein, 10 aa, BK virus
CFVSSGSSGL

SEQ ID NO: 7156 - protein, 10 aa, BK virus
FVSSGSSGLK

SEQ ID NO: 7157 - protein, 10 aa, BK virus
VSSGSSGLKS

SEQ ID NO: 7158 - protein, 10 aa, BK virus
SSGSSGLKSC

SEQ ID NO: 7159 - protein, 10 aa, BK virus
SGSSGLKSCS

SEQ ID NO: 7160 - protein, 10 aa, BK virus
GSSGLKSCSF

SEQ ID NO: 7161 - protein, 10 aa, BK virus
SSGLKSCSFK

SEQ ID NO: 7162 - protein, 10 aa, BK virus
SGLKSCSFKP

SEQ ID NO: 7163 - protein, 10 aa, BK virus
GLKSCSFKPP

SEQ ID NO: 7164 - protein, 10 aa, BK virus
MLSSIVWYGS

SEQ ID NO: 7165 - protein, 10 aa, BK virus
LSSIVWYGSL

SEQ ID NO: 7166 - protein, 10 aa, BK virus
SSIVWYGSLV

SEQ ID NO: 7167 - protein, 10 aa, BK virus
SIVWYGSLVK

SEQ ID NO: 7168 - protein, 10 aa, BK virus
IVWYGSLVKA

SEQ ID NO: 7169 - protein, 10 aa, BK virus
VWYGSLVKAL

SEQ ID NO: 7170 - protein, 10 aa, BK virus
WYGSLVKALY

SEQ ID NO: 7171 - protein, 10 aa, BK virus
YGSLVKALYS

SEQ ID NO: 7172 - protein, 10 aa, BK virus
GSLVKALYSK

SEQ ID NO: 7173 - protein, 10 aa, BK virus
SLVKALYSKY

SEQ ID NO: 7174 - protein, 10 aa, BK virus
LVKALYSKYS

SEQ ID NO: 7175 - protein, 10 aa, BK virus
VKALYSKYSL

SEQ ID NO: 7176 - protein, 10 aa, BK virus
KALYSKYSLL

SEQ ID NO: 7177 - protein, 10 aa, BK virus
ALYSKYSLLT

SEQ ID NO: 7178 - protein, 10 aa, BK virus
LYSKYSLLTP

SEQ ID NO: 7179 - protein, 10 aa, BK virus
YSKYSLLTPL

SEQ ID NO: 7180 - protein, 10 aa, BK virus
SKYSLLTPLQ

SEQ ID NO: 7181 - protein, 10 aa, BK virus
KYSLLTPLQI

SEQ ID NO: 7182 - protein, 10 aa, BK virus
YSLLTPLQIK

SEQ ID NO: 7183 - protein, 10 aa, BK virus
SLLTPLQIKK

SEQ ID NO: 7184 - protein, 10 aa, BK virus
LLTPLQIKKL

SEQ ID NO: 7185 - protein, 10 aa, BK virus
LTPLQIKKLK

SEQ ID NO: 7186 - protein, 10 aa, BK virus
TPLQIKKLKV

SEQ ID NO: 7187 - protein, 10 aa, BK virus
PLQIKKLKVH

SEQ ID NO: 7188 - protein, 10 aa, BK virus
LQIKKLKVHS

SEQ ID NO: 7189 - protein, 10 aa, BK virus
QIKKLKVHSF

SEQ ID NO: 7190 - protein, 10 aa, BK virus
QKLLIAETLC

SEQ ID NO: 7191 - protein, 10 aa, BK virus
KLLIAETLCL

SEQ ID NO: 7192 - protein, 10 aa, BK virus
LLIAETLCLC

SEQ ID NO: 7193 - protein, 10 aa, BK virus
LIAETLCLCG

SEQ ID NO: 7194 - protein, 10 aa, BK virus
IAETLCLCGV

SEQ ID NO: 7195 - protein, 10 aa, BK virus
AETLCLCGVK

SEQ ID NO: 7196 - protein, 10 aa, BK virus
ETLCLCGVKK

SEQ ID NO: 7197 - protein, 10 aa, BK virus
TLCLCGVKKN

SEQ ID NO: 7198 - protein, 10 aa, BK virus
LCLCGVKKNI

SEQ ID NO: 7199 - protein, 10 aa, BK virus
CLCGVKKNII

SEQ ID NO: 7200 - protein, 10 aa, BK virus
LCGVKKNIIL

SEQ ID NO: 7201 - protein, 10 aa, BK virus
CGVKKNIILC

SEQ ID NO: 7202 - protein, 10 aa, BK virus
GVKKNIILCP

SEQ ID NO: 7203 - protein, 10 aa, BK virus
VKKNIILCPA

SEQ ID NO: 7204 - protein, 10 aa, BK virus
KKNIILCPAH

SEQ ID NO: 7205 - protein, 10 aa, BK virus
KNIILCPAHM

SEQ ID NO: 7206 - protein, 10 aa, BK virus
NIILCPAHMC

SEQ ID NO: 7207 - protein, 10 aa, BK virus
IILCPAHMCL

SEQ ID NO: 7208 - protein, 10 aa, BK virus
ILCPAHMCLL

SEQ ID NO: 7209 - protein, 10 aa, BK virus
LCPAHMCLLI

SEQ ID NO: 7210 - protein, 10 aa, BK virus
CPAHMCLLIK

SEQ ID NO: 7211 - protein, 10 aa, BK virus
PAHMCLLIKV

SEQ ID NO: 7212 - protein, 10 aa, BK virus
AHMCLLIKVT

SEQ ID NO: 7213 - protein, 10 aa, BK virus
HMCLLIKVTE

SEQ ID NO: 7214 - protein, 10 aa, BK virus
MCLLIKVTEY

SEQ ID NO: 7215 - protein, 10 aa, BK virus
CLLIKVTEYF

SEQ ID NO: 7216 - protein, 10 aa, BK virus
LLIKVTEYFS

SEQ ID NO: 7217 - protein, 10 aa, BK virus
LIKVTEYFSI

SEQ ID NO: 7218 - protein, 10 aa, BK virus
IKVTEYFSIS

SEQ ID NO: 7219 - protein, 10 aa, BK virus
KVTEYFSISF

SEQ ID NO: 7220 - protein, 10 aa, BK virus
VTEYFSISFL

SEQ ID NO: 7221 - protein, 10 aa, BK virus
TEYFSISFLY

SEQ ID NO: 7222 - protein, 10 aa, BK virus
EYFSISFLYR

SEQ ID NO: 7223 - protein, 10 aa, BK virus
YFSISFLYRI

SEQ ID NO: 7224 - protein, 10 aa, BK virus
AFSLVVYTAK

SEQ ID NO: 7225 - protein, 10 aa, BK virus
FSLVVYTAKQ

SEQ ID NO: 7226 - protein, 10 aa, BK virus
SLVVYTAKQA

SEQ ID NO: 7227 - protein, 10 aa, BK virus
LVVYTAKQAR

SEQ ID NO: 7228 - protein, 10 aa, BK virus
VVYTAKQARV

SEQ ID NO: 7229 - protein, 10 aa, BK virus
VYTAKQARVL

SEQ ID NO: 7230 - protein, 10 aa, BK virus
YTAKQARVLL

SEQ ID NO: 7231 - protein, 10 aa, BK virus
TAKQARVLLL

SEQ ID NO: 7232 - protein, 10 aa, BK virus
AKQARVLLLN

SEQ ID NO: 7233 - protein, 10 aa, BK virus
KQARVLLLNT

SEQ ID NO: 7234 - protein, 10 aa, BK virus
QARVLLLNTA

SEQ ID NO: 7235 - protein, 10 aa, BK virus
LRNWCRSEGK

SEQ ID NO: 7236 - protein, 10 aa, BK virus
RNWCRSEGKS

SEQ ID NO: 7237 - protein, 10 aa, BK virus
NWCRSEGKSL

SEQ ID NO: 7238 - protein, 10 aa, BK virus
WCRSEGKSLG

SEQ ID NO: 7239 - protein, 10 aa, BK virus
CRSEGKSLGS

SEQ ID NO: 7240 - protein, 10 aa, BK virus
RSEGKSLGSS

SEQ ID NO: 7241 - protein, 10 aa, BK virus
SEGKSLGSST

SEQ ID NO: 7242 - protein, 10 aa, BK virus
EGKSLGSSTF

SEQ ID NO: 7243 - protein, 10 aa, BK virus
GKSLGSSTFL

SEQ ID NO: 7244 - protein, 10 aa, BK virus
KSLGSSTFLF

SEQ ID NO: 7245 - protein, 10 aa, BK virus
SLGSSTFLFF

SEQ ID NO: 7246 - protein, 10 aa, BK virus
LGSSTFLFFL

SEQ ID NO: 7247 - protein, 10 aa, BK virus
GSSTFLFFLG

SEQ ID NO: 7248 - protein, 10 aa, BK virus
SSTFLFFLGG

SEQ ID NO: 7249 - protein, 10 aa, BK virus
STFLFFLGGV

SEQ ID NO: 7250 - protein, 10 aa, BK virus
TFLFFLGGVE

SEQ ID NO: 7251 - protein, 10 aa, BK virus
FLFFLGGVEC

SEQ ID NO: 7252 - protein, 10 aa, BK virus
ESAVASSSLA

SEQ ID NO: 7253 - protein, 10 aa, BK virus
SAVASSSLAN

SEQ ID NO: 7254 - protein, 10 aa, BK virus
AVASSSLANI

SEQ ID NO: 7255 - protein, 10 aa, BK virus
VASSSLANIS

SEQ ID NO: 7256 - protein, 10 aa, BK virus
ASSSLANISS

SEQ ID NO: 7257 - protein, 10 aa, BK virus
SSSLANISSW

SEQ ID NO: 7258 - protein, 10 aa, BK virus
SSLANISSWQ

SEQ ID NO: 7259 - protein, 10 aa, BK virus
SLANISSWQN

SEQ ID NO: 7260 - protein, 10 aa, BK virus
LANISSWQNK

SEQ ID NO: 7261 - protein, 10 aa, BK virus
ANISSWQNKS

SEQ ID NO: 7262 - protein, 10 aa, BK virus
NISSWQNKSS

SEQ ID NO: 7263 - protein, 10 aa, BK virus
ISSWQNKSSS

SEQ ID NO: 7264 - protein, 10 aa, BK virus
SSWQNKSSSH

SEQ ID NO: 7265 - protein, 10 aa, BK virus
SWQNKSSSHF

SEQ ID NO: 7266 - protein, 10 aa, BK virus
WQNKSSSHFS

SEQ ID NO: 7267 - protein, 10 aa, BK virus
QNKSSSHFSL

SEQ ID NO: 7268 - protein, 10 aa, BK virus
NKSSSHFSLK

SEQ ID NO: 7269 - protein, 10 aa, BK virus
KSSSHFSLKE

SEQ ID NO: 7270 - protein, 10 aa, BK virus
SSSHFSLKEL

SEQ ID NO: 7271 - protein, 10 aa, BK virus
SSHFSLKELH

SEQ ID NO: 7272 - protein, 10 aa, BK virus
SHFSLKELHQ

SEQ ID NO: 7273 - protein, 10 aa, BK virus
HFSLKELHQD

SEQ ID NO: 7274 - protein, 10 aa, BK virus
FSLKELHQDS

SEQ ID NO: 7275 - protein, 10 aa, BK virus
SLKELHQDSH

SEQ ID NO: 7276 - protein, 10 aa, BK virus
LKELHQDSHS

SEQ ID NO: 7277 - protein, 10 aa, BK virus
KELHQDSHSS

SEQ ID NO: 7278 - protein, 10 aa, BK virus
ELHQDSHSSV

SEQ ID NO: 7279 - protein, 10 aa, BK virus
LHQDSHSSVP

SEQ ID NO: 7280 - protein, 10 aa, BK virus
VGTYKKNNYL

SEQ ID NO: 7281 - protein, 10 aa, BK virus
GTYKKNNYLG

SEQ ID NO: 7282 - protein, 10 aa, BK virus
TYKKNNYLGP

SEQ ID NO: 7283 - protein, 10 aa, BK virus
YKKNNYLGPF

SEQ ID NO: 7284 - protein, 10 aa, BK virus
KKNNYLGPFN

SEQ ID NO: 7285 - protein, 10 aa, BK virus
KNNYLGPFNI

SEQ ID NO: 7286 - protein, 10 aa, BK virus
NNYLGPFNIL

SEQ ID NO: 7287 - protein, 10 aa, BK virus
NYLGPFNILL

SEQ ID NO: 7288 - protein, 10 aa, BK virus
YLGPFNILLF

SEQ ID NO: 7289 - protein, 10 aa, BK virus
LGPFNILLFI

SEQ ID NO: 7290 - protein, 10 aa, BK virus
REFLQLFGPT

SEQ ID NO: 7291 - protein, 10 aa, BK virus
EFLQLFGPTI

SEQ ID NO: 7292 - protein, 10 aa, BK virus
FLQLFGPTIA

SEQ ID NO: 7293 - protein, 10 aa, BK virus
LQLFGPTIAE

SEQ ID NO: 7294 - protein, 10 aa, BK virus
QLFGPTIAEF

SEQ ID NO: 7295 - protein, 10 aa, BK virus
LFGPTIAEFL

SEQ ID NO: 7296 - protein, 10 aa, BK virus
FGPTIAEFLQ

SEQ ID NO: 7297 - protein, 10 aa, BK virus
GPTIAEFLQL

SEQ ID NO: 7298 - protein, 10 aa, BK virus
PTIAEFLQLG

SEQ ID NO: 7299 - protein, 10 aa, BK virus
TIAEFLQLGL

SEQ ID NO: 7300 - protein, 10 aa, BK virus
IAEFLQLGLS

SEQ ID NO: 7301 - protein, 10 aa, BK virus
AEFLQLGLSQ

SEQ ID NO: 7302 - protein, 10 aa, BK virus
EFLQLGLSQT

SEQ ID NO: 7303 - protein, 10 aa, BK virus
FLQLGLSQTT

SEQ ID NO: 7304 - protein, 10 aa, BK virus
LQLGLSQTTV

SEQ ID NO: 7305 - protein, 10 aa, BK virus
SSQCSSNLSK

SEQ ID NO: 7306 - protein, 10 aa, BK virus
SQCSSNLSKP

SEQ ID NO: 7307 - protein, 10 aa, BK virus
QCSSNLSKPR

SEQ ID NO: 7308 - protein, 10 aa, BK virus
CSSNLSKPRA

SEQ ID NO: 7309 - protein, 10 aa, BK virus
SSNLSKPRAL

SEQ ID NO: 7310 - protein, 10 aa, BK virus
SNLSKPRALF

SEQ ID NO: 7311 - protein, 10 aa, BK virus
NLSKPRALFL

SEQ ID NO: 7312 - protein, 10 aa, BK virus
LSKPRALFLK

SEQ ID NO: 7313 - protein, 10 aa, BK virus
SKPRALFLKI

SEQ ID NO: 7314 - protein, 10 aa, BK virus
KPRALFLKIF

SEQ ID NO: 7315 - protein, 10 aa, BK virus
PRALFLKIFY

SEQ ID NO: 7316 - protein, 10 aa, BK virus
RALFLKIFYL

SEQ ID NO: 7317 - protein, 10 aa, BK virus
ALFLKIFYLN

SEQ ID NO: 7318 - protein, 10 aa, BK virus
LFLKIFYLNA

SEQ ID NO: 7319 - protein, 10 aa, BK virus
FLKIFYLNAL

SEQ ID NO: 7320 - protein, 10 aa, BK virus
LKIFYLNALI

SEQ ID NO: 7321 - protein, 10 aa, BK virus
ADIACKGSAQ

SEQ ID NO: 7322 - protein, 10 aa, BK virus
DIACKGSAQK

SEQ ID NO: 7323 - protein, 10 aa, BK virus
IACKGSAQKA

SEQ ID NO: 7324 - protein, 10 aa, BK virus
ACKGSAQKAF

SEQ ID NO: 7325 - protein, 10 aa, BK virus
CKGSAQKAFW

SEQ ID NO: 7326 - protein, 10 aa, BK virus
KGSAQKAFWN

SEQ ID NO: 7327 - protein, 10 aa, BK virus
GSAQKAFWNK

SEQ ID NO: 7328 - protein, 10 aa, BK virus
AIPCSTGYLG

SEQ ID NO: 7329 - protein, 10 aa, BK virus
IPCSTGYLGK

SEQ ID NO: 7330 - protein, 10 aa, BK virus
PCSTGYLGKE

SEQ ID NO: 7331 - protein, 10 aa, BK virus
CSTGYLGKEE

SEQ ID NO: 7332 - protein, 10 aa, BK virus
STGYLGKEEN

SEQ ID NO: 7333 - protein, 10 aa, BK virus
TGYLGKEENQ

SEQ ID NO: 7334 - protein, 10 aa, BK virus
GYLGKEENQH

SEQ ID NO: 7335 - protein, 10 aa, BK virus
YLGKEENQHK

SEQ ID NO: 7336 - protein, 10 aa, BK virus
LGKEENQHKP

SEQ ID NO: 7337 - protein, 10 aa, BK virus
GKEENQHKPL

SEQ ID NO: 7338 - protein, 10 aa, BK virus
KEENQHKPLS

SEQ ID NO: 7339 - protein, 10 aa, BK virus
EENQHKPLSY

SEQ ID NO: 7340 - protein, 10 aa, BK virus
ENQHKPLSYS

SEQ ID NO: 7341 - protein, 10 aa, BK virus
NQHKPLSYSR

SEQ ID NO: 7342 - protein, 10 aa, BK virus
QHKPLSYSRF

SEQ ID NO: 7343 - protein, 10 aa, BK virus
HKPLSYSRFQ

SEQ ID NO: 7344 - protein, 10 aa, BK virus
KPLSYSRFQN

SEQ ID NO: 7345 - protein, 10 aa, BK virus
PLSYSRFQNQ

SEQ ID NO: 7346 - protein, 10 aa, BK virus
LSYSRFQNQA

SEQ ID NO: 7347 - protein, 10 aa, BK virus
SYSRFQNQAD

SEQ ID NO: 7348 - protein, 10 aa, BK virus
YSRFQNQADE

SEQ ID NO: 7349 - protein, 10 aa, BK virus
SRFQNQADEL

SEQ ID NO: 7350 - protein, 10 aa, BK virus
RFQNQADELP

SEQ ID NO: 7351 - protein, 10 aa, BK virus
FQNQADELPL

SEQ ID NO: 7352 - protein, 10 aa, BK virus
QNQADELPLH

SEQ ID NO: 7353 - protein, 10 aa, BK virus
NQADELPLHP

SEQ ID NO: 7354 - protein, 10 aa, BK virus
QADELPLHPA

SEQ ID NO: 7355 - protein, 10 aa, BK virus
ADELPLHPAP

SEQ ID NO: 7356 - protein, 10 aa, BK virus
DELPLHPAPF

SEQ ID NO: 7357 - protein, 10 aa, BK virus
ELPLHPAPFF

SEQ ID NO: 7358 - protein, 10 aa, BK virus
LPLHPAPFFY

SEQ ID NO: 7359 - protein, 10 aa, BK virus
PLHPAPFFYT

SEQ ID NO: 7360 - protein, 10 aa, BK virus
LHPAPFFYTK

SEQ ID NO: 7361 - protein, 10 aa, BK virus
HPAPFFYTKY

SEQ ID NO: 7362 - protein, 10 aa, BK virus
PAPFFYTKYS

SEQ ID NO: 7363 - protein, 10 aa, BK virus
APFFYTKYSF

SEQ ID NO: 7364 - protein, 10 aa, BK virus
PFFYTKYSFS

SEQ ID NO: 7365 - protein, 10 aa, BK virus
FFYTKYSFSS

SEQ ID NO: 7366 - protein, 10 aa, BK virus
FYTKYSFSSF

SEQ ID NO: 7367 - protein, 10 aa, BK virus
YTKYSFSSFY

SEQ ID NO: 7368 - protein, 10 aa, BK virus
TKYSFSSFYP

SEQ ID NO: 7369 - protein, 10 aa, BK virus
KYSFSSFYPR

SEQ ID NO: 7370 - protein, 10 aa, BK virus
YSFSSFYPRR

SEQ ID NO: 7371 - protein, 10 aa, BK virus
SFSSFYPRRP

SEQ ID NO: 7372 - protein, 10 aa, BK virus
FSSFYPRRPL

SEQ ID NO: 7373 - protein, 10 aa, BK virus
SSFYPRRPLC

SEQ ID NO: 7374 - protein, 10 aa, BK virus
SFYPRRPLCQ

SEQ ID NO: 7375 - protein, 10 aa, BK virus
FYPRRPLCQG

SEQ ID NO: 7376 - protein, 10 aa, BK virus
YPRRPLCQGE

SEQ ID NO: 7377 - protein, 10 aa, BK virus
PRRPLCQGEI

SEQ ID NO: 7378 - protein, 10 aa, BK virus
RRPLCQGEIP

SEQ ID NO: 7379 - protein, 10 aa, BK virus
RPLCQGEIPY

SEQ ID NO: 7380 - protein, 10 aa, BK virus
PLCQGEIPYT

SEQ ID NO: 7381 - protein, 10 aa, BK virus
LCQGEIPYTS

SEQ ID NO: 7382 - protein, 10 aa, BK virus
CQGEIPYTSL

SEQ ID NO: 7383 - protein, 10 aa, BK virus
QGEIPYTSLN

SEQ ID NO: 7384 - protein, 10 aa, BK virus
GEIPYTSLNK

SEQ ID NO: 7385 - protein, 10 aa, BK virus
EIPYTSLNKL

SEQ ID NO: 7386 - protein, 10 aa, BK virus
IPYTSLNKLF

SEQ ID NO: 7387 - protein, 10 aa, BK virus
PYTSLNKLFS

SEQ ID NO: 7388 - protein, 10 aa, BK virus
YTSLNKLFSL

SEQ ID NO: 7389 - protein, 10 aa, BK virus
TSLNKLFSLR

SEQ ID NO: 7390 - protein, 10 aa, BK virus
SLNKLFSLRE

SEQ ID NO: 7391 - protein, 10 aa, BK virus
LNKLFSLRED

SEQ ID NO: 7392 - protein, 10 aa, BK virus
NKLFSLREDF

SEQ ID NO: 7393 - protein, 10 aa, BK virus
KLFSLREDFP

SEQ ID NO: 7394 - protein, 10 aa, BK virus
LFSLREDFPR

SEQ ID NO: 7395 - protein, 10 aa, BK virus
FSLREDFPRQ

SEQ ID NO: 7396 - protein, 10 aa, BK virus
SLREDFPRQL

SEQ ID NO: 7397 - protein, 10 aa, BK virus
LREDFPRQLF

SEQ ID NO: 7398 - protein, 10 aa, BK virus
REDFPRQLFQ

SEQ ID NO: 7399 - protein, 10 aa, BK virus
EDFPRQLFQG

SEQ ID NO: 7400 - protein, 10 aa, BK virus
DFPRQLFQGL

SEQ ID NO: 7401 - protein, 10 aa, BK virus
FPRQLFQGLK

SEQ ID NO: 7402 - protein, 10 aa, BK virus
PRQLFQGLKG

SEQ ID NO: 7403 - protein, 10 aa, BK virus
RQLFQGLKGP

SEQ ID NO: 7404 - protein, 11 aa, BK virus
GFPQIVLLGLR

SEQ ID NO: 7405 - protein, 11 aa, BK virus
FPQIVLLGLRK

SEQ ID NO: 7406 - protein, 11 aa, BK virus
PQIVLLGLRKS

SEQ ID NO: 7407 - protein, 11 aa, BK virus
QIVLLGLRKSL

SEQ ID NO: 7408 - protein, 11 aa, BK virus
IVLLGLRKSLH

SEQ ID NO: 7409 - protein, 11 aa, BK virus
VLLGLRKSLHT

SEQ ID NO: 7410 - protein, 11 aa, BK virus
LLGLRKSLHTL

SEQ ID NO: 7411 - protein, 11 aa, BK virus
LGLRKSLHTLT

SEQ ID NO: 7412 - protein, 11 aa, BK virus
GLRKSLHTLTT

SEQ ID NO: 7413 - protein, 11 aa, BK virus
EKGWRQRRPRP

SEQ ID NO: 7414 - protein, 11 aa, BK virus
KGWRQRRPRPL

SEQ ID NO: 7415 - protein, 11 aa, BK virus
GWRQRRPRPLI

SEQ ID NO: 7416 - protein, 11 aa, BK virus
WRQRRPRPLIY

SEQ ID NO: 7417 - protein, 11 aa, BK virus
RQRRPRPLIYY

SEQ ID NO: 7418 - protein, 11 aa, BK virus
QRRPRPLIYYK

SEQ ID NO: 7419 - protein, 11 aa, BK virus
RRPRPLIYYKK

SEQ ID NO: 7420 - protein, 11 aa, BK virus
RPRPLIYYKKK

SEQ ID NO: 7421 - protein, 11 aa, BK virus
PRPLIYYKKKG

SEQ ID NO: 7422 - protein, 11 aa, BK virus
RPLIYYKKKGH

SEQ ID NO: 7423 - protein, 11 aa, BK virus
PLIYYKKKGHR

SEQ ID NO: 7424 - protein, 11 aa, BK virus
LIYYKKKGHRE

SEQ ID NO: 7425 - protein, 11 aa, BK virus
IYYKKKGHREE

SEQ ID NO: 7426 - protein, 11 aa, BK virus
YYKKKGHREEL

SEQ ID NO: 7427 - protein, 11 aa, BK virus
YKKKGHREELL

SEQ ID NO: 7428 - protein, 11 aa, BK virus
KKKGHREELLT

SEQ ID NO: 7429 - protein, 11 aa, BK virus
KKGHREELLTH

SEQ ID NO: 7430 - protein, 11 aa, BK virus
KGHREELLTHG

SEQ ID NO: 7431 - protein, 11 aa, BK virus
GHREELLTHGM

SEQ ID NO: 7432 - protein, 11 aa, BK virus
HREELLTHGMQ

SEQ ID NO: 7433 - protein, 11 aa, BK virus
REELLTHGMQP

SEQ ID NO: 7434 - protein, 11 aa, BK virus
EELLTHGMQPN

SEQ ID NO: 7435 - protein, 11 aa, BK virus
ELLTHGMQPNH

SEQ ID NO: 7436 - protein, 11 aa, BK virus
LLTHGMQPNHD

SEQ ID NO: 7437 - protein, 11 aa, BK virus
LTHGMQPNHDL

SEQ ID NO: 7438 - protein, 11 aa, BK virus
THGMQPNHDLR

SEQ ID NO: 7439 - protein, 11 aa, BK virus
HGMQPNHDLRK

SEQ ID NO: 7440 - protein, 11 aa, BK virus
GMQPNHDLRKE

SEQ ID NO: 7441 - protein, 11 aa, BK virus
MQPNHDLRKES

SEQ ID NO: 7442 - protein, 11 aa, BK virus
QPNHDLRKESA

SEQ ID NO: 7443 - protein, 11 aa, BK virus
LTGECSQTMTS

SEQ ID NO: 7444 - protein, 11 aa, BK virus
TGECSQTMTSG

SEQ ID NO: 7445 - protein, 11 aa, BK virus
GECSQTMTSGR

SEQ ID NO: 7446 - protein, 11 aa, BK virus
ECSQTMTSGRK

SEQ ID NO: 7447 - protein, 11 aa, BK virus
CSQTMTSGRKV

SEQ ID NO: 7448 - protein, 11 aa, BK virus
SQTMTSGRKVH

SEQ ID NO: 7449 - protein, 11 aa, BK virus
QTMTSGRKVHD

SEQ ID NO: 7450 - protein, 11 aa, BK virus
TMTSGRKVHDS

SEQ ID NO: 7451 - protein, 11 aa, BK virus
MTSGRKVHDSQ

SEQ ID NO: 7452 - protein, 11 aa, BK virus
TSGRKVHDSQG

SEQ ID NO: 7453 - protein, 11 aa, BK virus
SGRKVHDSQGG

SEQ ID NO: 7454 - protein, 11 aa, BK virus
GRKVHDSQGGA

SEQ ID NO: 7455 - protein, 11 aa, BK virus
RKVHDSQGGAA

SEQ ID NO: 7456 - protein, 11 aa, BK virus
KVHDSQGGAAY

SEQ ID NO: 7457 - protein, 11 aa, BK virus
VHDSQGGAAYP

SEQ ID NO: 7458 - protein, 11 aa, BK virus
HDSQGGAAYPW

SEQ ID NO: 7459 - protein, 11 aa, BK virus
DSQGGAAYPWN

SEQ ID NO: 7460 - protein, 11 aa, BK virus
SQGGAAYPWNA

SEQ ID NO: 7461 - protein, 11 aa, BK virus
QGGAAYPWNAA

SEQ ID NO: 7462 - protein, 11 aa, BK virus
GGAAYPWNAAK

SEQ ID NO: 7463 - protein, 11 aa, BK virus
GAAYPWNAAKP

SEQ ID NO: 7464 - protein, 11 aa, BK virus
PQEGKCMTDMF

SEQ ID NO: 7465 - protein, 11 aa, BK virus
QEGKCMTDMFC

SEQ ID NO: 7466 - protein, 11 aa, BK virus
EGKCMTDMFCE

SEQ ID NO: 7467 - protein, 11 aa, BK virus
GKCMTDMFCEP

SEQ ID NO: 7468 - protein, 11 aa, BK virus
KCMTDMFCEPR

SEQ ID NO: 7469 - protein, 11 aa, BK virus
CMTDMFCEPRN

SEQ ID NO: 7470 - protein, 11 aa, BK virus
MTDMFCEPRNL

SEQ ID NO: 7471 - protein, 11 aa, BK virus
TDMFCEPRNLG

SEQ ID NO: 7472 - protein, 11 aa, BK virus
DMFCEPRNLGL

SEQ ID NO: 7473 - protein, 11 aa, BK virus
MFCEPRNLGLV

SEQ ID NO: 7474 - protein, 11 aa, BK virus
FCEPRNLGLVP

SEQ ID NO: 7475 - protein, 11 aa, BK virus
CEPRNLGLVPS

SEQ ID NO: 7476 - protein, 11 aa, BK virus
TGQRPWFCASC

SEQ ID NO: 7477 - protein, 11 aa, BK virus
GQRPWFCASCH

SEQ ID NO: 7478 - protein, 11 aa, BK virus
QRPWFCASCHD

SEQ ID NO: 7479 - protein, 11 aa, BK virus
RPWFCASCHDK

SEQ ID NO: 7480 - protein, 11 aa, BK virus
PWFCASCHDKL

SEQ ID NO: 7481 - protein, 11 aa, BK virus
WFCASCHDKLQ

SEQ ID NO: 7482 - protein, 11 aa, BK virus
KLVKPGLEQKK

SEQ ID NO: 7483 - protein, 11 aa, BK virus
LVKPGLEQKKE

SEQ ID NO: 7484 - protein, 11 aa, BK virus
VKPGLEQKKEL

SEQ ID NO: 7485 - protein, 11 aa, BK virus
KPGLEQKKELR

SEQ ID NO: 7486 - protein, 11 aa, BK virus
PGLEQKKELRG

SEQ ID NO: 7487 - protein, 11 aa, BK virus
GLEQKKELRGF

SEQ ID NO: 7488 - protein, 11 aa, BK virus
LEQKKELRGFL

SEQ ID NO: 7489 - protein, 11 aa, BK virus
EQKKELRGFLF

SEQ ID NO: 7490 - protein, 11 aa, BK virus
QKKELRGFLFL

SEQ ID NO: 7491 - protein, 11 aa, BK virus
KKELRGFLFLF

SEQ ID NO: 7492 - protein, 11 aa, BK virus
SFCWNFVEVKT

SEQ ID NO: 7493 - protein, 11 aa, BK virus
FCWNFVEVKTV

SEQ ID NO: 7494 - protein, 11 aa, BK virus
TGKTKVPLLYL

SEQ ID NO: 7495 - protein, 11 aa, BK virus
GKTKVPLLYLL

SEQ ID NO: 7496 - protein, 11 aa, BK virus
VIPFFLYFQVH

SEQ ID NO: 7497 - protein, 11 aa, BK virus
IPFFLYFQVHG

SEQ ID NO: 7498 - protein, 11 aa, BK virus
PFFLYFQVHGC

SEQ ID NO: 7499 - protein, 11 aa, BK virus
FFLYFQVHGCC

SEQ ID NO: 7500 - protein, 11 aa, BK virus
FLYFQVHGCCS

SEQ ID NO: 7501 - protein, 11 aa, BK virus
LYFQVHGCCSS

SEQ ID NO: 7502 - protein, 11 aa, BK virus
YFQVHGCCSST

SEQ ID NO: 7503 - protein, 11 aa, BK virus
FQVHGCCSSTF

SEQ ID NO: 7504 - protein, 11 aa, BK virus
QVHGCCSSTFG

SEQ ID NO: 7505 - protein, 11 aa, BK virus
VHGCCSSTFGG

SEQ ID NO: 7506 - protein, 11 aa, BK virus
HGCCSSTFGGP

SEQ ID NO: 7507 - protein, 11 aa, BK virus
GCCSSTFGGPS

SEQ ID NO: 7508 - protein, 11 aa, BK virus
CCSSTFGGPSC

SEQ ID NO: 7509 - protein, 11 aa, BK virus
CSSTFGGPSCQ

SEQ ID NO: 7510 - protein, 11 aa, BK virus
SSTFGGPSCQC

SEQ ID NO: 7511 - protein, 11 aa, BK virus
STFGGPSCQCI

SEQ ID NO: 7512 - protein, 11 aa, BK virus
NCCWGGCCCYR

SEQ ID NO: 7513 - protein, 11 aa, BK virus
CCWGGCCCYRS

SEQ ID NO: 7514 - protein, 11 aa, BK virus
CWGGCCCYRSS

SEQ ID NO: 7515 - protein, 11 aa, BK virus
WGGCCCYRSSN

SEQ ID NO: 7516 - protein, 11 aa, BK virus
GGCCCYRSSNC

SEQ ID NO: 7517 - protein, 11 aa, BK virus
GCCCYRSSNCI

SEQ ID NO: 7518 - protein, 11 aa, BK virus
CCCYRSSNCIP

SEQ ID NO: 7519 - protein, 11 aa, BK virus
CCYRSSNCIPC

SEQ ID NO: 7520 - protein, 11 aa, BK virus
CYRSSNCIPCY

SEQ ID NO: 7521 - protein, 11 aa, BK virus
YRSSNCIPCYC

SEQ ID NO: 7522 - protein, 11 aa, BK virus
RSSNCIPCYCR

SEQ ID NO: 7523 - protein, 11 aa, BK virus
SSNCIPCYCRG

SEQ ID NO: 7524 - protein, 11 aa, BK virus
SNCIPCYCRGH

SEQ ID NO: 7525 - protein, 11 aa, BK virus
NCIPCYCRGHN

SEQ ID NO: 7526 - protein, 11 aa, BK virus
CIPCYCRGHNK

SEQ ID NO: 7527 - protein, 11 aa, BK virus
IPCYCRGHNKY

SEQ ID NO: 7528 - protein, 11 aa, BK virus
PCYCRGHNKYL

SEQ ID NO: 7529 - protein, 11 aa, BK virus
CYCRGHNKYLR

SEQ ID NO: 7530 - protein, 11 aa, BK virus
YCRGHNKYLRG

SEQ ID NO: 7531 - protein, 11 aa, BK virus
CRGHNKYLRGY

SEQ ID NO: 7532 - protein, 11 aa, BK virus
RGHNKYLRGYS

SEQ ID NO: 7533 - protein, 11 aa, BK virus
GHNKYLRGYSC

SEQ ID NO: 7534 - protein, 11 aa, BK virus
HNKYLRGYSCY

SEQ ID NO: 7535 - protein, 11 aa, BK virus
NKYLRGYSCYR

SEQ ID NO: 7536 - protein, 11 aa, BK virus
KYLRGYSCYRP

SEQ ID NO: 7537 - protein, 11 aa, BK virus
YLRGYSCYRPN

SEQ ID NO: 7538 - protein, 11 aa, BK virus
LRGYSCYRPNS

SEQ ID NO: 7539 - protein, 11 aa, BK virus
RGYSCYRPNSS

SEQ ID NO: 7540 - protein, 11 aa, BK virus
GYSCYRPNSSN

SEQ ID NO: 7541 - protein, 11 aa, BK virus
YSCYRPNSSNI

SEQ ID NO: 7542 - protein, 11 aa, BK virus
SCYRPNSSNIC

SEQ ID NO: 7543 - protein, 11 aa, BK virus
CYRPNSSNICC

SEQ ID NO: 7544 - protein, 11 aa, BK virus
YRPNSSNICCN

SEQ ID NO: 7545 - protein, 11 aa, BK virus
RPNSSNICCNC

SEQ ID NO: 7546 - protein, 11 aa, BK virus
PNSSNICCNCW

SEQ ID NO: 7547 - protein, 11 aa, BK virus
NSSNICCNCWC

SEQ ID NO: 7548 - protein, 11 aa, BK virus
SSNICCNCWCS

SEQ ID NO: 7549 - protein, 11 aa, BK virus
SNICCNCWCSW

SEQ ID NO: 7550 - protein, 11 aa, BK virus
NICCNCWCSWG

SEQ ID NO: 7551 - protein, 11 aa, BK virus
ICCNCWCSWGY

SEQ ID NO: 7552 - protein, 11 aa, BK virus
CCNCWCSWGYC

SEQ ID NO: 7553 - protein, 11 aa, BK virus
CNCWCSWGYCW

SEQ ID NO: 7554 - protein, 11 aa, BK virus
NCWCSWGYCWV

SEQ ID NO: 7555 - protein, 11 aa, BK virus
CWCSWGYCWVC

SEQ ID NO: 7556 - protein, 11 aa, BK virus
WCSWGYCWVCC

SEQ ID NO: 7557 - protein, 11 aa, BK virus
CSWGYCWVCCF

SEQ ID NO: 7558 - protein, 11 aa, BK virus
SWGYCWVCCFN

SEQ ID NO: 7559 - protein, 11 aa, BK virus
WGYCWVCCFNS

SEQ ID NO: 7560 - protein, 11 aa, BK virus
GYCWVCCFNSN

SEQ ID NO: 7561 - protein, 11 aa, BK virus
YCWVCCFNSNC

SEQ ID NO: 7562 - protein, 11 aa, BK virus
LGSQSFHCRPL

SEQ ID NO: 7563 - protein, 11 aa, BK virus
GSQSFHCRPLS

SEQ ID NO: 7564 - protein, 11 aa, BK virus
SQSFHCRPLSA

SEQ ID NO: 7565 - protein, 11 aa, BK virus
QSFHCRPLSAI

SEQ ID NO: 7566 - protein, 11 aa, BK virus
SFHCRPLSAIR

SEQ ID NO: 7567 - protein, 11 aa, BK virus
FHCRPLSAIRH

SEQ ID NO: 7568 - protein, 11 aa, BK virus
HCRPLSAIRHG

SEQ ID NO: 7569 - protein, 11 aa, BK virus
CRPLSAIRHGF

SEQ ID NO: 7570 - protein, 11 aa, BK virus
RPLSAIRHGFG

SEQ ID NO: 7571 - protein, 11 aa, BK virus
PLSAIRHGFGI

SEQ ID NO: 7572 - protein, 11 aa, BK virus
LSAIRHGFGIV

SEQ ID NO: 7573 - protein, 11 aa, BK virus
ALGSFFVCYYF

SEQ ID NO: 7574 - protein, 11 aa, BK virus
LGSFFVCYYFP

SEQ ID NO: 7575 - protein, 11 aa, BK virus
GSFFVCYYFPG

SEQ ID NO: 7576 - protein, 11 aa, BK virus
SFFVCYYFPGF

SEQ ID NO: 7577 - protein, 11 aa, BK virus
FFVCYYFPGFV

SEQ ID NO: 7578 - protein, 11 aa, BK virus
FVCYYFPGFVA

SEQ ID NO: 7579 - protein, 11 aa, BK virus
VCYYFPGFVAC

SEQ ID NO: 7580 - protein, 11 aa, BK virus
CYYFPGFVACY

SEQ ID NO: 7581 - protein, 11 aa, BK virus
YTFYNLTGIAE

SEQ ID NO: 7582 - protein, 11 aa, BK virus
TFYNLTGIAEK

SEQ ID NO: 7583 - protein, 11 aa, BK virus
FYNLTGIAEKN

SEQ ID NO: 7584 - protein, 11 aa, BK virus
YNLTGIAEKNR

SEQ ID NO: 7585 - protein, 11 aa, BK virus
NLTGIAEKNRK

SEQ ID NO: 7586 - protein, 11 aa, BK virus
LTGIAEKNRKI

SEQ ID NO: 7587 - protein, 11 aa, BK virus
TGIAEKNRKIF

SEQ ID NO: 7588 - protein, 11 aa, BK virus
IFGGNYLDNCK

SEQ ID NO: 7589 - protein, 11 aa, BK virus
FGGNYLDNCKC

SEQ ID NO: 7590 - protein, 11 aa, BK virus
GGNYLDNCKCP

SEQ ID NO: 7591 - protein, 11 aa, BK virus
GNYLDNCKCPY

SEQ ID NO: 7592 - protein, 11 aa, BK virus
NYLDNCKCPYK

SEQ ID NO: 7593 - protein, 11 aa, BK virus
YLDNCKCPYKL

SEQ ID NO: 7594 - protein, 11 aa, BK virus
LDNCKCPYKLL

SEQ ID NO: 7595 - protein, 11 aa, BK virus
KGRYPCTFWPY

SEQ ID NO: 7596 - protein, 11 aa, BK virus
GRYPCTFWPYL

SEQ ID NO: 7597 - protein, 11 aa, BK virus
QYRRSYTKNGL

SEQ ID NO: 7598 - protein, 11 aa, BK virus
YRRSYTKNGLK

SEQ ID NO: 7599 - protein, 11 aa, BK virus
RRSYTKNGLKK

SEQ ID NO: 7600 - protein, 11 aa, BK virus
RSYTKNGLKKS

SEQ ID NO: 7601 - protein, 11 aa, BK virus
SYTKNGLKKST

SEQ ID NO: 7602 - protein, 11 aa, BK virus
YTKNGLKKSTK

SEQ ID NO: 7603 - protein, 11 aa, BK virus
TKNGLKKSTKC

SEQ ID NO: 7604 - protein, 11 aa, BK virus
KNGLKKSTKCT

SEQ ID NO: 7605 - protein, 11 aa, BK virus
NGLKKSTKCTF

SEQ ID NO: 7606 - protein, 11 aa, BK virus
GLKKSTKCTFR

SEQ ID NO: 7607 - protein, 11 aa, BK virus
LKKSTKCTFRR

SEQ ID NO: 7608 - protein, 11 aa, BK virus
KKSTKCTFRRV

SEQ ID NO: 7609 - protein, 11 aa, BK virus
KSTKCTFRRVY

SEQ ID NO: 7610 - protein, 11 aa, BK virus
STKCTFRRVYR

SEQ ID NO: 7611 - protein, 11 aa, BK virus
TKCTFRRVYRK

SEQ ID NO: 7612 - protein, 11 aa, BK virus
KCTFRRVYRKN

SEQ ID NO: 7613 - protein, 11 aa, BK virus
CTFRRVYRKNY

SEQ ID NO: 7614 - protein, 11 aa, BK virus
TFRRVYRKNYC

SEQ ID NO: 7615 - protein, 11 aa, BK virus
FRRVYRKNYCP

SEQ ID NO: 7616 - protein, 11 aa, BK virus
RRVYRKNYCPR

SEQ ID NO: 7617 - protein, 11 aa, BK virus
RVYRKNYCPRR

SEQ ID NO: 7618 - protein, 11 aa, BK virus
VYRKNYCPRRC

SEQ ID NO: 7619 - protein, 11 aa, BK virus
SKNCSSMDVAF

SEQ ID NO: 7620 - protein, 11 aa, BK virus
KNCSSMDVAFT

SEQ ID NO: 7621 - protein, 11 aa, BK virus
NCSSMDVAFTS

SEQ ID NO: 7622 - protein, 11 aa, BK virus
CSSMDVAFTSR

SEQ ID NO: 7623 - protein, 11 aa, BK virus
SSMDVAFTSRP

SEQ ID NO: 7624 - protein, 11 aa, BK virus
SMDVAFTSRPV

SEQ ID NO: 7625 - protein, 11 aa, BK virus
MDVAFTSRPVR

SEQ ID NO: 7626 - protein, 11 aa, BK virus
DVAFTSRPVRD

SEQ ID NO: 7627 - protein, 11 aa, BK virus
VAFTSRPVRDC

SEQ ID NO: 7628 - protein, 11 aa, BK virus
AFTSRPVRDCN

SEQ ID NO: 7629 - protein, 11 aa, BK virus
FTSRPVRDCNT

SEQ ID NO: 7630 - protein, 11 aa, BK virus
TSRPVRDCNTC

SEQ ID NO: 7631 - protein, 11 aa, BK virus
SRPVRDCNTCS

SEQ ID NO: 7632 - protein, 11 aa, BK virus
RWPQPKEKESV

SEQ ID NO: 7633 - protein, 11 aa, BK virus
WPQPKEKESVQ

SEQ ID NO: 7634 - protein, 11 aa, BK virus
PQPKEKESVQG

SEQ ID NO: 7635 - protein, 11 aa, BK virus
QPKEKESVQGQ

SEQ ID NO: 7636 - protein, 11 aa, BK virus
PKEKESVQGQL

SEQ ID NO: 7637 - protein, 11 aa, BK virus
KEKESVQGQLP

SEQ ID NO: 7638 - protein, 11 aa, BK virus
EKESVQGQLPK

SEQ ID NO: 7639 - protein, 11 aa, BK virus
KESVQGQLPKS

SEQ ID NO: 7640 - protein, 11 aa, BK virus
ESVQGQLPKSQ

SEQ ID NO: 7641 - protein, 11 aa, BK virus
SVQGQLPKSQR

SEQ ID NO: 7642 - protein, 11 aa, BK virus
VQGQLPKSQRN

SEQ ID NO: 7643 - protein, 11 aa, BK virus
QGQLPKSQRNP

SEQ ID NO: 7644 - protein, 11 aa, BK virus
GQLPKSQRNPC

SEQ ID NO: 7645 - protein, 11 aa, BK virus
QLPKSQRNPCK

SEQ ID NO: 7646 - protein, 11 aa, BK virus
LPKSQRNPCKC

SEQ ID NO: 7647 - protein, 11 aa, BK virus
PKSQRNPCKCQ

SEQ ID NO: 7648 - protein, 11 aa, BK virus
KSQRNPCKCQN

SEQ ID NO: 7649 - protein, 11 aa, BK virus
SQRNPCKCQNY

SEQ ID NO: 7650 - protein, 11 aa, BK virus
TQKWGIQMKTL

SEQ ID NO: 7651 - protein, 11 aa, BK virus
QKWGIQMKTLG

SEQ ID NO: 7652 - protein, 11 aa, BK virus
KWGIQMKTLGA

SEQ ID NO: 7653 - protein, 11 aa, BK virus
WGIQMKTLGAL

SEQ ID NO: 7654 - protein, 11 aa, BK virus
GIQMKTLGALV

SEQ ID NO: 7655 - protein, 11 aa, BK virus
VLKMTLAVIAQ

SEQ ID NO: 7656 - protein, 11 aa, BK virus
LKMTLAVIAQR

SEQ ID NO: 7657 - protein, 11 aa, BK virus
KMTLAVIAQRE

SEQ ID NO: 7658 - protein, 11 aa, BK virus
MTLAVIAQREK

SEQ ID NO: 7659 - protein, 11 aa, BK virus
TLAVIAQREKC

SEQ ID NO: 7660 - protein, 11 aa, BK virus
LAVIAQREKCF

SEQ ID NO: 7661 - protein, 11 aa, BK virus
AVIAQREKCFP

SEQ ID NO: 7662 - protein, 11 aa, BK virus
VIAQREKCFPV

SEQ ID NO: 7663 - protein, 11 aa, BK virus
IAQREKCFPVT

SEQ ID NO: 7664 - protein, 11 aa, BK virus
AQREKCFPVTA

SEQ ID NO: 7665 - protein, 11 aa, BK virus
QREKCFPVTAQ

SEQ ID NO: 7666 - protein, 11 aa, BK virus
REKCFPVTAQQ

SEQ ID NO: 7667 - protein, 11 aa, BK virus
EKCFPVTAQQE

SEQ ID NO: 7668 - protein, 11 aa, BK virus
KCFPVTAQQEF

SEQ ID NO: 7669 - protein, 11 aa, BK virus
CFPVTAQQEFP

SEQ ID NO: 7670 - protein, 11 aa, BK virus
FPVTAQQEFPS

SEQ ID NO: 7671 - protein, 11 aa, BK virus
PVTAQQEFPSP

SEQ ID NO: 7672 - protein, 11 aa, BK virus
VTAQQEFPSPI

SEQ ID NO: 7673 - protein, 11 aa, BK virus
LACLTFMQGHK

SEQ ID NO: 7674 - protein, 11 aa, BK virus
ACLTFMQGHKK

SEQ ID NO: 7675 - protein, 11 aa, BK virus
CLTFMQGHKKC

SEQ ID NO: 7676 - protein, 11 aa, BK virus
LTFMQGHKKCM

SEQ ID NO: 7677 - protein, 11 aa, BK virus
TFMQGHKKCMS

SEQ ID NO: 7678 - protein, 11 aa, BK virus
FMQGHKKCMSM

SEQ ID NO: 7679 - protein, 11 aa, BK virus
MQGHKKCMSMV

SEQ ID NO: 7680 - protein, 11 aa, BK virus
QGHKKCMSMVE

SEQ ID NO: 7681 - protein, 11 aa, BK virus
GHKKCMSMVEE

SEQ ID NO: 7682 - protein, 11 aa, BK virus
HKKCMSMVEEN

SEQ ID NO: 7683 - protein, 11 aa, BK virus
KKCMSMVEENL

SEQ ID NO: 7684 - protein, 11 aa, BK virus
KCMSMVEENLF

SEQ ID NO: 7685 - protein, 11 aa, BK virus
CMSMVEENLFK

SEQ ID NO: 7686 - protein, 11 aa, BK virus
MSMVEENLFKA

SEQ ID NO: 7687 - protein, 11 aa, BK virus
SMVEENLFKAV

SEQ ID NO: 7688 - protein, 11 aa, BK virus
MVEENLFKAVI

SEQ ID NO: 7689 - protein, 11 aa, BK virus
VEENLFKAVIS

SEQ ID NO: 7690 - protein, 11 aa, BK virus
EENLFKAVIST

SEQ ID NO: 7691 - protein, 11 aa, BK virus
ENLFKAVISTS

SEQ ID NO: 7692 - protein, 11 aa, BK virus
NLFKAVISTSL

SEQ ID NO: 7693 - protein, 11 aa, BK virus
LFKAVISTSLL

SEQ ID NO: 7694 - protein, 11 aa, BK virus
ILTIRPIWTKT

SEQ ID NO: 7695 - protein, 11 aa, BK virus
LTIRPIWTKTM

SEQ ID NO: 7696 - protein, 11 aa, BK virus
TIRPIWTKTML

SEQ ID NO: 7697 - protein, 11 aa, BK virus
IRPIWTKTMLI

SEQ ID NO: 7698 - protein, 11 aa, BK virus
RPIWTKTMLIQ

SEQ ID NO: 7699 - protein, 11 aa, BK virus
PIWTKTMLIQL

SEQ ID NO: 7700 - protein, 11 aa, BK virus
IWTKTMLIQLS

SEQ ID NO: 7701 - protein, 11 aa, BK virus
WTKTMLIQLSA

SEQ ID NO: 7702 - protein, 11 aa, BK virus
TKTMLIQLSAG

SEQ ID NO: 7703 - protein, 11 aa, BK virus
KTMLIQLSAGY

SEQ ID NO: 7704 - protein, 11 aa, BK virus
TMLIQLSAGYL

SEQ ID NO: 7705 - protein, 11 aa, BK virus
MLIQLSAGYLI

SEQ ID NO: 7706 - protein, 11 aa, BK virus
LIQLSAGYLIP

SEQ ID NO: 7707 - protein, 11 aa, BK virus
IQLSAGYLIPV

SEQ ID NO: 7708 - protein, 11 aa, BK virus
QLSAGYLIPVE

SEQ ID NO: 7709 - protein, 11 aa, BK virus
LSAGYLIPVEM

SEQ ID NO: 7710 - protein, 11 aa, BK virus
SAGYLIPVEMK

SEQ ID NO: 7711 - protein, 11 aa, BK virus
AGYLIPVEMKM

SEQ ID NO: 7712 - protein, 11 aa, BK virus
GYLIPVEMKML

SEQ ID NO: 7713 - protein, 11 aa, BK virus
YLIPVEMKMLG

SEQ ID NO: 7714 - protein, 11 aa, BK virus
LIPVEMKMLGI

SEQ ID NO: 7715 - protein, 11 aa, BK virus
IPVEMKMLGIL

SEQ ID NO: 7716 - protein, 11 aa, BK virus
PVEMKMLGILG

SEQ ID NO: 7717 - protein, 11 aa, BK virus
VEMKMLGILGL

SEQ ID NO: 7718 - protein, 11 aa, BK virus
EMKMLGILGLS

SEQ ID NO: 7719 - protein, 11 aa, BK virus
MKMLGILGLSQ

SEQ ID NO: 7720 - protein, 11 aa, BK virus
KMLGILGLSQE

SEQ ID NO: 7721 - protein, 11 aa, BK virus
MLGILGLSQEG

SEQ ID NO: 7722 - protein, 11 aa, BK virus
LGILGLSQEGK

SEQ ID NO: 7723 - protein, 11 aa, BK virus
GILGLSQEGKM

SEQ ID NO: 7724 - protein, 11 aa, BK virus
ILGLSQEGKMF

SEQ ID NO: 7725 - protein, 11 aa, BK virus
LGLSQEGKMFP

SEQ ID NO: 7726 - protein, 11 aa, BK virus
GLSQEGKMFPQ

SEQ ID NO: 7727 - protein, 11 aa, BK virus
LSQEGKMFPQY

SEQ ID NO: 7728 - protein, 11 aa, BK virus
SQEGKMFPQYF

SEQ ID NO: 7729 - protein, 11 aa, BK virus
QEGKMFPQYFM

SEQ ID NO: 7730 - protein, 11 aa, BK virus
MNRVWGLFVKL

SEQ ID NO: 7731 - protein, 11 aa, BK virus
NRVWGLFVKLI

SEQ ID NO: 7732 - protein, 11 aa, BK virus
RVWGLFVKLIA

SEQ ID NO: 7733 - protein, 11 aa, BK virus
VWGLFVKLIAC

SEQ ID NO: 7734 - protein, 11 aa, BK virus
WGLFVKLIACM

SEQ ID NO: 7735 - protein, 11 aa, BK virus
GLFVKLIACMF

SEQ ID NO: 7736 - protein, 11 aa, BK virus
LFVKLIACMFQ

SEQ ID NO: 7737 - protein, 11 aa, BK virus
FVKLIACMFQL

SEQ ID NO: 7738 - protein, 11 aa, BK virus
VKLIACMFQLL

SEQ ID NO: 7739 - protein, 11 aa, BK virus
KLIACMFQLLI

SEQ ID NO: 7740 - protein, 11 aa, BK virus
LIACMFQLLIF

SEQ ID NO: 7741 - protein, 11 aa, BK virus
IACMFQLLIFV

SEQ ID NO: 7742 - protein, 11 aa, BK virus
ACMFQLLIFVA

SEQ ID NO: 7743 - protein, 11 aa, BK virus
CMFQLLIFVAC

SEQ ID NO: 7744 - protein, 11 aa, BK virus
MFQLLIFVACL

SEQ ID NO: 7745 - protein, 11 aa, BK virus
FQLLIFVACLL

SEQ ID NO: 7746 - protein, 11 aa, BK virus
QLLIFVACLLT

SEQ ID NO: 7747 - protein, 11 aa, BK virus
LLIFVACLLTA

SEQ ID NO: 7748 - protein, 11 aa, BK virus
LIFVACLLTAL

SEQ ID NO: 7749 - protein, 11 aa, BK virus
IFVACLLTALE

SEQ ID NO: 7750 - protein, 11 aa, BK virus
FVACLLTALEH

SEQ ID NO: 7751 - protein, 11 aa, BK virus
VACLLTALEHN

SEQ ID NO: 7752 - protein, 11 aa, BK virus
ACLLTALEHNS

SEQ ID NO: 7753 - protein, 11 aa, BK virus
CLLTALEHNSG

SEQ ID NO: 7754 - protein, 11 aa, BK virus
LLTALEHNSGE

SEQ ID NO: 7755 - protein, 11 aa, BK virus
LTALEHNSGEA

SEQ ID NO: 7756 - protein, 11 aa, BK virus
TALEHNSGEAL

SEQ ID NO: 7757 - protein, 11 aa, BK virus
ALEHNSGEALQ

SEQ ID NO: 7758 - protein, 11 aa, BK virus
LEHNSGEALQD

SEQ ID NO: 7759 - protein, 11 aa, BK virus
EHNSGEALQDI

SEQ ID NO: 7760 - protein, 11 aa, BK virus
HNSGEALQDIL

SEQ ID NO: 7761 - protein, 11 aa, BK virus
NSGEALQDILR

SEQ ID NO: 7762 - protein, 11 aa, BK virus
SGEALQDILRS

SEQ ID NO: 7763 - protein, 11 aa, BK virus
GEALQDILRSA

SEQ ID NO: 7764 - protein, 11 aa, BK virus
TGEPREWMGSL

SEQ ID NO: 7765 - protein, 11 aa, BK virus
GEPREWMGSLC

SEQ ID NO: 7766 - protein, 11 aa, BK virus
EPREWMGSLCM

SEQ ID NO: 7767 - protein, 11 aa, BK virus
PREWMGSLCMV

SEQ ID NO: 7768 - protein, 11 aa, BK virus
REWMGSLCMVW

SEQ ID NO: 7769 - protein, 11 aa, BK virus
EWMGSLCMVWN

SEQ ID NO: 7770 - protein, 11 aa, BK virus
WMGSLCMVWNP

SEQ ID NO: 7771 - protein, 11 aa, BK virus
MGSLCMVWNPR

SEQ ID NO: 7772 - protein, 11 aa, BK virus
KRLGCLMAQKD

SEQ ID NO: 7773 - protein, 11 aa, BK virus
RLGCLMAQKDF

SEQ ID NO: 7774 - protein, 11 aa, BK virus
LGCLMAQKDFQ

SEQ ID NO: 7775 - protein, 11 aa, BK virus
GCLMAQKDFQG

SEQ ID NO: 7776 - protein, 11 aa, BK virus
CLMAQKDFQGT

SEQ ID NO: 7777 - protein, 11 aa, BK virus
LMAQKDFQGTQ

SEQ ID NO: 7778 - protein, 11 aa, BK virus
MAQKDFQGTQI

SEQ ID NO: 7779 - protein, 11 aa, BK virus
DILTNRDNCKP

SEQ ID NO: 7780 - protein, 11 aa, BK virus
ILTNRDNCKPK

SEQ ID NO: 7781 - protein, 11 aa, BK virus
LTNRDNCKPKC

SEQ ID NO: 7782 - protein, 11 aa, BK virus
TNRDNCKPKCF

SEQ ID NO: 7783 - protein, 11 aa, BK virus
NRDNCKPKCFK

SEQ ID NO: 7784 - protein, 11 aa, BK virus
RDNCKPKCFKQ

SEQ ID NO: 7785 - protein, 11 aa, BK virus
DNCKPKCFKQV

SEQ ID NO: 7786 - protein, 11 aa, BK virus
NCKPKCFKQVL

SEQ ID NO: 7787 - protein, 11 aa, BK virus
CKPKCFKQVLL

SEQ ID NO: 7788 - protein, 11 aa, BK virus
KPKCFKQVLLL

SEQ ID NO: 7789 - protein, 11 aa, BK virus
PKCFKQVLLLY

SEQ ID NO: 7790 - protein, 11 aa, BK virus
KCFKQVLLLYI

SEQ ID NO: 7791 - protein, 11 aa, BK virus
CFKQVLLLYIY

SEQ ID NO: 7792 - protein, 11 aa, BK virus
FKQVLLLYIYI

SEQ ID NO: 7793 - protein, 11 aa, BK virus
MLLLYKPLLSL

SEQ ID NO: 7794 - protein, 11 aa, BK virus
LLLYKPLLSLC

SEQ ID NO: 7795 - protein, 11 aa, BK virus
LLYKPLLSLCY

SEQ ID NO: 7796 - protein, 11 aa, BK virus
LYKPLLSLCYF

SEQ ID NO: 7797 - protein, 11 aa, BK virus
YKPLLSLCYFG

SEQ ID NO: 7798 - protein, 11 aa, BK virus
KPLLSLCYFGG

SEQ ID NO: 7799 - protein, 11 aa, BK virus
PLLSLCYFGGG

SEQ ID NO: 7800 - protein, 11 aa, BK virus
LLSLCYFGGGV

SEQ ID NO: 7801 - protein, 11 aa, BK virus
LSLCYFGGGVL

SEQ ID NO: 7802 - protein, 11 aa, BK virus
SLCYFGGGVLG

SEQ ID NO: 7803 - protein, 11 aa, BK virus
LCYFGGGVLGL

SEQ ID NO: 7804 - protein, 11 aa, BK virus
CYFGGGVLGLL

SEQ ID NO: 7805 - protein, 11 aa, BK virus
YFGGGVLGLLK

SEQ ID NO: 7806 - protein, 11 aa, BK virus
FGGGVLGLLKH

SEQ ID NO: 7807 - protein, 11 aa, BK virus
LWGSDLWESSA

SEQ ID NO: 7808 - protein, 11 aa, BK virus
WGSDLWESSAG

SEQ ID NO: 7809 - protein, 11 aa, BK virus
GSDLWESSAGA

SEQ ID NO: 7810 - protein, 11 aa, BK virus
SDLWESSAGAE

SEQ ID NO: 7811 - protein, 11 aa, BK virus
DLWESSAGAEV

SEQ ID NO: 7812 - protein, 11 aa, BK virus
LWESSAGAEVS

SEQ ID NO: 7813 - protein, 11 aa, BK virus
WESSAGAEVSE

SEQ ID NO: 7814 - protein, 11 aa, BK virus
ESSAGAEVSET

SEQ ID NO: 7815 - protein, 11 aa, BK virus
SSAGAEVSETW

SEQ ID NO: 7816 - protein, 11 aa, BK virus
SAGAEVSETWE

SEQ ID NO: 7817 - protein, 11 aa, BK virus
AGAEVSETWEE

SEQ ID NO: 7818 - protein, 11 aa, BK virus
GAEVSETWEEH

SEQ ID NO: 7819 - protein, 11 aa, BK virus
AEVSETWEEHC

SEQ ID NO: 7820 - protein, 11 aa, BK virus
EVSETWEEHCD

SEQ ID NO: 7821 - protein, 11 aa, BK virus
VSETWEEHCDW

SEQ ID NO: 7822 - protein, 11 aa, BK virus
SETWEEHCDWD

SEQ ID NO: 7823 - protein, 11 aa, BK virus
ETWEEHCDWDS

SEQ ID NO: 7824 - protein, 11 aa, BK virus
TWEEHCDWDSV

SEQ ID NO: 7825 - protein, 11 aa, BK virus
WEEHCDWDSVL

SEQ ID NO: 7826 - protein, 11 aa, BK virus
EEHCDWDSVLD

SEQ ID NO: 7827 - protein, 11 aa, BK virus
EHCDWDSVLDP

SEQ ID NO: 7828 - protein, 11 aa, BK virus
HCDWDSVLDPC

SEQ ID NO: 7829 - protein, 11 aa, BK virus
CDWDSVLDPCP

SEQ ID NO: 7830 - protein, 11 aa, BK virus
DWDSVLDPCPE

SEQ ID NO: 7831 - protein, 11 aa, BK virus
WDSVLDPCPES

SEQ ID NO: 7832 - protein, 11 aa, BK virus
DSVLDPCPESS

SEQ ID NO: 7833 - protein, 11 aa, BK virus
SVLDPCPESSV

SEQ ID NO: 7834 - protein, 11 aa, BK virus
VLDPCPESSVS

SEQ ID NO: 7835 - protein, 11 aa, BK virus
LDPCPESSVSE

SEQ ID NO: 7836 - protein, 11 aa, BK virus
DPCPESSVSES

SEQ ID NO: 7837 - protein, 11 aa, BK virus
PCPESSVSESS

SEQ ID NO: 7838 - protein, 11 aa, BK virus
CPESSVSESSS

SEQ ID NO: 7839 - protein, 11 aa, BK virus
PESSVSESSSL

SEQ ID NO: 7840 - protein, 11 aa, BK virus
ESSVSESSSLV

SEQ ID NO: 7841 - protein, 11 aa, BK virus
SSVSESSSLVI

SEQ ID NO: 7842 - protein, 11 aa, BK virus
SVSESSSLVIS

SEQ ID NO: 7843 - protein, 11 aa, BK virus
VSESSSLVISR

SEQ ID NO: 7844 - protein, 11 aa, BK virus
SESSSLVISRI

SEQ ID NO: 7845 - protein, 11 aa, BK virus
ESSSLVISRIH

SEQ ID NO: 7846 - protein, 11 aa, BK virus
SSSLVISRIHF

SEQ ID NO: 7847 - protein, 11 aa, BK virus
SSLVISRIHFP

SEQ ID NO: 7848 - protein, 11 aa, BK virus
SLVISRIHFPM

SEQ ID NO: 7849 - protein, 11 aa, BK virus
LVISRIHFPMH

SEQ ID NO: 7850 - protein, 11 aa, BK virus
VISRIHFPMHI

SEQ ID NO: 7851 - protein, 11 aa, BK virus
ISRIHFPMHIL

SEQ ID NO: 7852 - protein, 11 aa, BK virus
SRIHFPMHILY

SEQ ID NO: 7853 - protein, 11 aa, BK virus
RIHFPMHILYF

SEQ ID NO: 7854 - protein, 11 aa, BK virus
IHFPMHILYFI

SEQ ID NO: 7855 - protein, 11 aa, BK virus
HFPMHILYFIL

SEQ ID NO: 7856 - protein, 11 aa, BK virus
FPMHILYFILE

SEQ ID NO: 7857 - protein, 11 aa, BK virus
PMHILYFILEK

SEQ ID NO: 7858 - protein, 11 aa, BK virus
MHILYFILEKV

SEQ ID NO: 7859 - protein, 11 aa, BK virus
HILYFILEKVY

SEQ ID NO: 7860 - protein, 11 aa, BK virus
ILYFILEKVYI

SEQ ID NO: 7861 - protein, 11 aa, BK virus
LYFILEKVYIL

SEQ ID NO: 7862 - protein, 11 aa, BK virus
YFILEKVYILI

SEQ ID NO: 7863 - protein, 11 aa, BK virus
FILEKVYILIS

SEQ ID NO: 7864 - protein, 11 aa, BK virus
ILEKVYILISE

SEQ ID NO: 7865 - protein, 11 aa, BK virus
LEKVYILISES

SEQ ID NO: 7866 - protein, 11 aa, BK virus
EKVYILISESS

SEQ ID NO: 7867 - protein, 11 aa, BK virus
KVYILISESSL

SEQ ID NO: 7868 - protein, 11 aa, BK virus
VYILISESSLS

SEQ ID NO: 7869 - protein, 11 aa, BK virus
YILISESSLSF

SEQ ID NO: 7870 - protein, 11 aa, BK virus
ILISESSLSFH

SEQ ID NO: 7871 - protein, 11 aa, BK virus
LISESSLSFHS

SEQ ID NO: 7872 - protein, 11 aa, BK virus
ISESSLSFHST

SEQ ID NO: 7873 - protein, 11 aa, BK virus
SESSLSFHSTI

SEQ ID NO: 7874 - protein, 11 aa, BK virus
ESSLSFHSTIL

SEQ ID NO: 7875 - protein, 11 aa, BK virus
SSLSFHSTILD

SEQ ID NO: 7876 - protein, 11 aa, BK virus
SLSFHSTILDC

SEQ ID NO: 7877 - protein, 11 aa, BK virus
LSFHSTILDCI

SEQ ID NO: 7878 - protein, 11 aa, BK virus
SFHSTILDCIS

SEQ ID NO: 7879 - protein, 11 aa, BK virus
FHSTILDCISV

SEQ ID NO: 7880 - protein, 11 aa, BK virus
HSTILDCISVA

SEQ ID NO: 7881 - protein, 11 aa, BK virus
STILDCISVAK

SEQ ID NO: 7882 - protein, 11 aa, BK virus
TILDCISVAKS

SEQ ID NO: 7883 - protein, 11 aa, BK virus
ILDCISVAKSA

SEQ ID NO: 7884 - protein, 11 aa, BK virus
LDCISVAKSAT

SEQ ID NO: 7885 - protein, 11 aa, BK virus
DCISVAKSATG

SEQ ID NO: 7886 - protein, 11 aa, BK virus
CISVAKSATGL

SEQ ID NO: 7887 - protein, 11 aa, BK virus
ISVAKSATGLN

SEQ ID NO: 7888 - protein, 11 aa, BK virus
SVAKSATGLNQ

SEQ ID NO: 7889 - protein, 11 aa, BK virus
VAKSATGLNQI

SEQ ID NO: 7890 - protein, 11 aa, BK virus
AKSATGLNQIS

SEQ ID NO: 7891 - protein, 11 aa, BK virus
KSATGLNQISS

SEQ ID NO: 7892 - protein, 11 aa, BK virus
SATGLNQISSS

SEQ ID NO: 7893 - protein, 11 aa, BK virus
ATGLNQISSSN

SEQ ID NO: 7894 - protein, 11 aa, BK virus
TGLNQISSSNK

SEQ ID NO: 7895 - protein, 11 aa, BK virus
GLNQISSSNKV

SEQ ID NO: 7896 - protein, 11 aa, BK virus
LNQISSSNKVI

SEQ ID NO: 7897 - protein, 11 aa, BK virus
NQISSSNKVIP

SEQ ID NO: 7898 - protein, 11 aa, BK virus
QISSSNKVIPL

SEQ ID NO: 7899 - protein, 11 aa, BK virus
ISSSNKVIPLC

SEQ ID NO: 7900 - protein, 11 aa, BK virus
SSSNKVIPLCK

SEQ ID NO: 7901 - protein, 11 aa, BK virus
SSNKVIPLCKI

SEQ ID NO: 7902 - protein, 11 aa, BK virus
SNKVIPLCKIL

SEQ ID NO: 7903 - protein, 11 aa, BK virus
NKVIPLCKILF

SEQ ID NO: 7904 - protein, 11 aa, BK virus
KVIPLCKILFS

SEQ ID NO: 7905 - protein, 11 aa, BK virus
VIPLCKILFSS

SEQ ID NO: 7906 - protein, 11 aa, BK virus
IPLCKILFSSK

SEQ ID NO: 7907 - protein, 11 aa, BK virus
PLCKILFSSKN

SEQ ID NO: 7908 - protein, 11 aa, BK virus
LCKILFSSKNS

SEQ ID NO: 7909 - protein, 11 aa, BK virus
CKILFSSKNSE

SEQ ID NO: 7910 - protein, 11 aa, BK virus
KILFSSKNSEF

SEQ ID NO: 7911 - protein, 11 aa, BK virus
ILFSSKNSEFC

SEQ ID NO: 7912 - protein, 11 aa, BK virus
LFSSKNSEFCK

SEQ ID NO: 7913 - protein, 11 aa, BK virus
FSSKNSEFCKD

SEQ ID NO: 7914 - protein, 11 aa, BK virus
SSKNSEFCKDF

SEQ ID NO: 7915 - protein, 11 aa, BK virus
SKNSEFCKDFL

SEQ ID NO: 7916 - protein, 11 aa, BK virus
KNSEFCKDFLK

SEQ ID NO: 7917 - protein, 11 aa, BK virus
NSEFCKDFLKY

SEQ ID NO: 7918 - protein, 11 aa, BK virus
SEFCKDFLKYI

SEQ ID NO: 7919 - protein, 11 aa, BK virus
EFCKDFLKYIL

SEQ ID NO: 7920 - protein, 11 aa, BK virus
FCKDFLKYILG

SEQ ID NO: 7921 - protein, 11 aa, BK virus
CKDFLKYILGL

SEQ ID NO: 7922 - protein, 11 aa, BK virus
KDFLKYILGLK

SEQ ID NO: 7923 - protein, 11 aa, BK virus
DFLKYILGLKS

SEQ ID NO: 7924 - protein, 11 aa, BK virus
FLKYILGLKSI

SEQ ID NO: 7925 - protein, 11 aa, BK virus
LKYILGLKSIC

SEQ ID NO: 7926 - protein, 11 aa, BK virus
KYILGLKSICL

SEQ ID NO: 7927 - protein, 11 aa, BK virus
YILGLKSICLT

SEQ ID NO: 7928 - protein, 11 aa, BK virus
ILGLKSICLTN

SEQ ID NO: 7929 - protein, 11 aa, BK virus
LGLKSICLTNL

SEQ ID NO: 7930 - protein, 11 aa, BK virus
GLKSICLTNLA

SEQ ID NO: 7931 - protein, 11 aa, BK virus
LKSICLTNLAC

SEQ ID NO: 7932 - protein, 11 aa, BK virus
KSICLTNLACR

SEQ ID NO: 7933 - protein, 11 aa, BK virus
SICLTNLACRV

SEQ ID NO: 7934 - protein, 11 aa, BK virus
ICLTNLACRVL

SEQ ID NO: 7935 - protein, 11 aa, BK virus
CLTNLACRVLG

SEQ ID NO: 7936 - protein, 11 aa, BK virus
LTNLACRVLGT

SEQ ID NO: 7937 - protein, 11 aa, BK virus
TNLACRVLGTG

SEQ ID NO: 7938 - protein, 11 aa, BK virus
NLACRVLGTGY

SEQ ID NO: 7939 - protein, 11 aa, BK virus
LACRVLGTGYS

SEQ ID NO: 7940 - protein, 11 aa, BK virus
ACRVLGTGYSF

SEQ ID NO: 7941 - protein, 11 aa, BK virus
CRVLGTGYSFI

SEQ ID NO: 7942 - protein, 11 aa, BK virus
RVLGTGYSFIV

SEQ ID NO: 7943 - protein, 11 aa, BK virus
VLGTGYSFIVT

SEQ ID NO: 7944 - protein, 11 aa, BK virus
LGTGYSFIVTK

SEQ ID NO: 7945 - protein, 11 aa, BK virus
GTGYSFIVTKP

SEQ ID NO: 7946 - protein, 11 aa, BK virus
TGYSFIVTKPG

SEQ ID NO: 7947 - protein, 11 aa, BK virus
GYSFIVTKPGG

SEQ ID NO: 7948 - protein, 11 aa, BK virus
YSFIVTKPGGN

SEQ ID NO: 7949 - protein, 11 aa, BK virus
SFIVTKPGGNI

SEQ ID NO: 7950 - protein, 11 aa, BK virus
FIVTKPGGNIW

SEQ ID NO: 7951 - protein, 11 aa, BK virus
IVTKPGGNIWV

SEQ ID NO: 7952 - protein, 11 aa, BK virus
VTKPGGNIWVL

SEQ ID NO: 7953 - protein, 11 aa, BK virus
TKPGGNIWVLL

SEQ ID NO: 7954 - protein, 11 aa, BK virus
KPGGNIWVLLF

SEQ ID NO: 7955 - protein, 11 aa, BK virus
PGGNIWVLLFK

SEQ ID NO: 7956 - protein, 11 aa, BK virus
GGNIWVLLFKC

SEQ ID NO: 7957 - protein, 11 aa, BK virus
GNIWVLLFKCF

SEQ ID NO: 7958 - protein, 11 aa, BK virus
NIWVLLFKCFF

SEQ ID NO: 7959 - protein, 11 aa, BK virus
IWVLLFKCFFS

SEQ ID NO: 7960 - protein, 11 aa, BK virus
WVLLFKCFFSK

SEQ ID NO: 7961 - protein, 11 aa, BK virus
VLLFKCFFSKF

SEQ ID NO: 7962 - protein, 11 aa, BK virus
LLFKCFFSKFT

SEQ ID NO: 7963 - protein, 11 aa, BK virus
LFKCFFSKFTL

SEQ ID NO: 7964 - protein, 11 aa, BK virus
FKCFFSKFTLT

SEQ ID NO: 7965 - protein, 11 aa, BK virus
KCFFSKFTLTL

SEQ ID NO: 7966 - protein, 11 aa, BK virus
CFFSKFTLTLP

SEQ ID NO: 7967 - protein, 11 aa, BK virus
FFSKFTLTLPS

SEQ ID NO: 7968 - protein, 11 aa, BK virus
FSKFTLTLPSK

SEQ ID NO: 7969 - protein, 11 aa, BK virus
SLKLSKLFIPC

SEQ ID NO: 7970 - protein, 11 aa, BK virus
LKLSKLFIPCP

SEQ ID NO: 7971 - protein, 11 aa, BK virus
KLSKLFIPCPE

SEQ ID NO: 7972 - protein, 11 aa, BK virus
LSKLFIPCPEG

SEQ ID NO: 7973 - protein, 11 aa, BK virus
SKLFIPCPEGK

SEQ ID NO: 7974 - protein, 11 aa, BK virus
KLFIPCPEGKS

SEQ ID NO: 7975 - protein, 11 aa, BK virus
LFIPCPEGKSF

SEQ ID NO: 7976 - protein, 11 aa, BK virus
FIPCPEGKSFD

SEQ ID NO: 7977 - protein, 11 aa, BK virus
IPCPEGKSFDS

SEQ ID NO: 7978 - protein, 11 aa, BK virus
PCPEGKSFDSA

SEQ ID NO: 7979 - protein, 11 aa, BK virus
CPEGKSFDSAP

SEQ ID NO: 7980 - protein, 11 aa, BK virus
PEGKSFDSAPV

SEQ ID NO: 7981 - protein, 11 aa, BK virus
EGKSFDSAPVP

SEQ ID NO: 7982 - protein, 11 aa, BK virus
GKSFDSAPVPF

SEQ ID NO: 7983 - protein, 11 aa, BK virus
KSFDSAPVPFT

SEQ ID NO: 7984 - protein, 11 aa, BK virus
SFDSAPVPFTS

SEQ ID NO: 7985 - protein, 11 aa, BK virus
FDSAPVPFTSS

SEQ ID NO: 7986 - protein, 11 aa, BK virus
DSAPVPFTSSK

SEQ ID NO: 7987 - protein, 11 aa, BK virus
SAPVPFTSSKT

SEQ ID NO: 7988 - protein, 11 aa, BK virus
APVPFTSSKTT

SEQ ID NO: 7989 - protein, 11 aa, BK virus
PVPFTSSKTTM

SEQ ID NO: 7990 - protein, 11 aa, BK virus
VPFTSSKTTMY

SEQ ID NO: 7991 - protein, 11 aa, BK virus
SIATPSSKVSL

SEQ ID NO: 7992 - protein, 11 aa, BK virus
IATPSSKVSLS

SEQ ID NO: 7993 - protein, 11 aa, BK virus
ATPSSKVSLSM

SEQ ID NO: 7994 - protein, 11 aa, BK virus
TPSSKVSLSMG

SEQ ID NO: 7995 - protein, 11 aa, BK virus
PSSKVSLSMGR

SEQ ID NO: 7996 - protein, 11 aa, BK virus
SSKVSLSMGRF

SEQ ID NO: 7997 - protein, 11 aa, BK virus
SKVSLSMGRFT

SEQ ID NO: 7998 - protein, 11 aa, BK virus
KVSLSMGRFTF

SEQ ID NO: 7999 - protein, 11 aa, BK virus
VSLSMGRFTFK

SEQ ID NO: 8000 - protein, 11 aa, BK virus
SLSMGRFTFKA

SEQ ID NO: 8001 - protein, 11 aa, BK virus
LSMGRFTFKAL

SEQ ID NO: 8002 - protein, 11 aa, BK virus
SMGRFTFKALP

SEQ ID NO: 8003 - protein, 11 aa, BK virus
MGRFTFKALPP

SEQ ID NO: 8004 - protein, 11 aa, BK virus
GRFTFKALPPH

SEQ ID NO: 8005 - protein, 11 aa, BK virus
RFTFKALPPHK

SEQ ID NO: 8006 - protein, 11 aa, BK virus
FTFKALPPHKS

SEQ ID NO: 8007 - protein, 11 aa, BK virus
TFKALPPHKSN

SEQ ID NO: 8008 - protein, 11 aa, BK virus
FKALPPHKSNN

SEQ ID NO: 8009 - protein, 11 aa, BK virus
KALPPHKSNNP

SEQ ID NO: 8010 - protein, 11 aa, BK virus
ALPPHKSNNPA

SEQ ID NO: 8011 - protein, 11 aa, BK virus
LPPHKSNNPAA

SEQ ID NO: 8012 - protein, 11 aa, BK virus
PPHKSNNPAAS

SEQ ID NO: 8013 - protein, 11 aa, BK virus
PHKSNNPAASV

SEQ ID NO: 8014 - protein, 11 aa, BK virus
HKSNNPAASVV

SEQ ID NO: 8015 - protein, 11 aa, BK virus
KSNNPAASVVF

SEQ ID NO: 8016 - protein, 11 aa, BK virus
SNNPAASVVFP

SEQ ID NO: 8017 - protein, 11 aa, BK virus
NNPAASVVFPL

SEQ ID NO: 8018 - protein, 11 aa, BK virus
NPAASVVFPLS

SEQ ID NO: 8019 - protein, 11 aa, BK virus
PAASVVFPLSM

SEQ ID NO: 8020 - protein, 11 aa, BK virus
AASVVFPLSMG

SEQ ID NO: 8021 - protein, 11 aa, BK virus
ASVVFPLSMGP

SEQ ID NO: 8022 - protein, 11 aa, BK virus
SVVFPLSMGPL

SEQ ID NO: 8023 - protein, 11 aa, BK virus
VVFPLSMGPLN

SEQ ID NO: 8024 - protein, 11 aa, BK virus
VFPLSMGPLNN

SEQ ID NO: 8025 - protein, 11 aa, BK virus
FPLSMGPLNNQ

SEQ ID NO: 8026 - protein, 11 aa, BK virus
PLSMGPLNNQY

SEQ ID NO: 8027 - protein, 11 aa, BK virus
LSMGPLNNQYL

SEQ ID NO: 8028 - protein, 11 aa, BK virus
SMGPLNNQYLL

SEQ ID NO: 8029 - protein, 11 aa, BK virus
MGPLNNQYLLL

SEQ ID NO: 8030 - protein, 11 aa, BK virus
GPLNNQYLLLG

SEQ ID NO: 8031 - protein, 11 aa, BK virus
PLNNQYLLLGT

SEQ ID NO: 8032 - protein, 11 aa, BK virus
LNNQYLLLGTL

SEQ ID NO: 8033 - protein, 11 aa, BK virus
NNQYLLLGTLK

SEQ ID NO: 8034 - protein, 11 aa, BK virus
NQYLLLGTLKT

SEQ ID NO: 8035 - protein, 11 aa, BK virus
QYLLLGTLKTI

SEQ ID NO: 8036 - protein, 11 aa, BK virus
YLLLGTLKTIQ

SEQ ID NO: 8037 - protein, 11 aa, BK virus
LLLGTLKTIQC

SEQ ID NO: 8038 - protein, 11 aa, BK virus
LLGTLKTIQCK

SEQ ID NO: 8039 - protein, 11 aa, BK virus
LGTLKTIQCKK

SEQ ID NO: 8040 - protein, 11 aa, BK virus
GTLKTIQCKKS

SEQ ID NO: 8041 - protein, 11 aa, BK virus
TLKTIQCKKSN

SEQ ID NO: 8042 - protein, 11 aa, BK virus
LKTIQCKKSNI

SEQ ID NO: 8043 - protein, 11 aa, BK virus
KTIQCKKSNIT

SEQ ID NO: 8044 - protein, 11 aa, BK virus
TIQCKKSNITE

SEQ ID NO: 8045 - protein, 11 aa, BK virus
IQCKKSNITES

SEQ ID NO: 8046 - protein, 11 aa, BK virus
QCKKSNITESI

SEQ ID NO: 8047 - protein, 11 aa, BK virus
CKKSNITESIL

SEQ ID NO: 8048 - protein, 11 aa, BK virus
KKSNITESILG

SEQ ID NO: 8049 - protein, 11 aa, BK virus
KSNITESILGS

SEQ ID NO: 8050 - protein, 11 aa, BK virus
SNITESILGSK

SEQ ID NO: 8051 - protein, 11 aa, BK virus
NITESILGSKQ

SEQ ID NO: 8052 - protein, 11 aa, BK virus
ITESILGSKQC

SEQ ID NO: 8053 - protein, 11 aa, BK virus
TESILGSKQCS

SEQ ID NO: 8054 - protein, 11 aa, BK virus
ESILGSKQCSQ

SEQ ID NO: 8055 - protein, 11 aa, BK virus
SILGSKQCSQA

SEQ ID NO: 8056 - protein, 11 aa, BK virus
ILGSKQCSQAT

SEQ ID NO: 8057 - protein, 11 aa, BK virus
LGSKQCSQATP

SEQ ID NO: 8058 - protein, 11 aa, BK virus
GSKQCSQATPA

SEQ ID NO: 8059 - protein, 11 aa, BK virus
SKQCSQATPAI

SEQ ID NO: 8060 - protein, 11 aa, BK virus
KQCSQATPAIY

SEQ ID NO: 8061 - protein, 11 aa, BK virus
QCSQATPAIYC

SEQ ID NO: 8062 - protein, 11 aa, BK virus
CSQATPAIYCS

SEQ ID NO: 8063 - protein, 11 aa, BK virus
SQATPAIYCSS

SEQ ID NO: 8064 - protein, 11 aa, BK virus
QATPAIYCSST

SEQ ID NO: 8065 - protein, 11 aa, BK virus
ATPAIYCSSTA

SEQ ID NO: 8066 - protein, 11 aa, BK virus
TPAIYCSSTAF

SEQ ID NO: 8067 - protein, 11 aa, BK virus
PAIYCSSTAFP

SEQ ID NO: 8068 - protein, 11 aa, BK virus
APNIKSILSNI

SEQ ID NO: 8069 - protein, 11 aa, BK virus
LNLSVSISSLV

SEQ ID NO: 8070 - protein, 11 aa, BK virus
NLSVSISSLVI

SEQ ID NO: 8071 - protein, 11 aa, BK virus
RVSTLFLAKTV

SEQ ID NO: 8072 - protein, 11 aa, BK virus
VSTLFLAKTVS

SEQ ID NO: 8073 - protein, 11 aa, BK virus
STLFLAKTVST

SEQ ID NO: 8074 - protein, 11 aa, BK virus
TLFLAKTVSTA

SEQ ID NO: 8075 - protein, 11 aa, BK virus
LFLAKTVSTAC

SEQ ID NO: 8076 - protein, 11 aa, BK virus
FLLSAKIIAFA

SEQ ID NO: 8077 - protein, 11 aa, BK virus
LLSAKIIAFAK

SEQ ID NO: 8078 - protein, 11 aa, BK virus
LSAKIIAFAKC

SEQ ID NO: 8079 - protein, 11 aa, BK virus
SAKIIAFAKCF

SEQ ID NO: 8080 - protein, 11 aa, BK virus
AKIIAFAKCFS

SEQ ID NO: 8081 - protein, 11 aa, BK virus
NSKYIPNNKNT

SEQ ID NO: 8082 - protein, 11 aa, BK virus
SKYIPNNKNTS

SEQ ID NO: 8083 - protein, 11 aa, BK virus
KYIPNNKNTSS

SEQ ID NO: 8084 - protein, 11 aa, BK virus
YIPNNKNTSSH

SEQ ID NO: 8085 - protein, 11 aa, BK virus
IPNNKNTSSHF

SEQ ID NO: 8086 - protein, 11 aa, BK virus
PNNKNTSSHFV

SEQ ID NO: 8087 - protein, 11 aa, BK virus
NNKNTSSHFVS

SEQ ID NO: 8088 - protein, 11 aa, BK virus
NKNTSSHFVST

SEQ ID NO: 8089 - protein, 11 aa, BK virus
KNTSSHFVSTA

SEQ ID NO: 8090 - protein, 11 aa, BK virus
NTSSHFVSTAY

SEQ ID NO: 8091 - protein, 11 aa, BK virus
TSSHFVSTAYS

SEQ ID NO: 8092 - protein, 11 aa, BK virus
SSHFVSTAYSV

SEQ ID NO: 8093 - protein, 11 aa, BK virus
SHFVSTAYSVI

SEQ ID NO: 8094 - protein, 11 aa, BK virus
HFVSTAYSVIN

SEQ ID NO: 8095 - protein, 11 aa, BK virus
FVSTAYSVINF

SEQ ID NO: 8096 - protein, 11 aa, BK virus
VSTAYSVINFQ

SEQ ID NO: 8097 - protein, 11 aa, BK virus
STAYSVINFQD

SEQ ID NO: 8098 - protein, 11 aa, BK virus
TAYSVINFQDT

SEQ ID NO: 8099 - protein, 11 aa, BK virus
AYSVINFQDTC

SEQ ID NO: 8100 - protein, 11 aa, BK virus
YSVINFQDTCF

SEQ ID NO: 8101 - protein, 11 aa, BK virus
SVINFQDTCFV

SEQ ID NO: 8102 - protein, 11 aa, BK virus
VINFQDTCFVS

SEQ ID NO: 8103 - protein, 11 aa, BK virus
INFQDTCFVSS

SEQ ID NO: 8104 - protein, 11 aa, BK virus
NFQDTCFVSSG

SEQ ID NO: 8105 - protein, 11 aa, BK virus
FQDTCFVSSGS

SEQ ID NO: 8106 - protein, 11 aa, BK virus
QDTCFVSSGSS

SEQ ID NO: 8107 - protein, 11 aa, BK virus
DTCFVSSGSSG

SEQ ID NO: 8108 - protein, 11 aa, BK virus
TCFVSSGSSGL

SEQ ID NO: 8109 - protein, 11 aa, BK virus
CFVSSGSSGLK

SEQ ID NO: 8110 - protein, 11 aa, BK virus
FVSSGSSGLKS

SEQ ID NO: 8111 - protein, 11 aa, BK virus
VSSGSSGLKSC

SEQ ID NO: 8112 - protein, 11 aa, BK virus
SSGSSGLKSCS

SEQ ID NO: 8113 - protein, 11 aa, BK virus
SGSSGLKSCSF

SEQ ID NO: 8114 - protein, 11 aa, BK virus
GSSGLKSCSFK

SEQ ID NO: 8115 - protein, 11 aa, BK virus
SSGLKSCSFKP

SEQ ID NO: 8116 - protein, 11 aa, BK virus
SGLKSCSFKPP

SEQ ID NO: 8117 - protein, 11 aa, BK virus
MLSSIVWYGSL

SEQ ID NO: 8118 - protein, 11 aa, BK virus
LSSIVWYGSLV

SEQ ID NO: 8119 - protein, 11 aa, BK virus
SSIVWYGSLVK

SEQ ID NO: 8120 - protein, 11 aa, BK virus
SIVWYGSLVKA

SEQ ID NO: 8121 - protein, 11 aa, BK virus
IVWYGSLVKAL

SEQ ID NO: 8122 - protein, 11 aa, BK virus
VWYGSLVKALY

SEQ ID NO: 8123 - protein, 11 aa, BK virus
WYGSLVKALYS

SEQ ID NO: 8124 - protein, 11 aa, BK virus
YGSLVKALYSK

SEQ ID NO: 8125 - protein, 11 aa, BK virus
GSLVKALYSKY

SEQ ID NO: 8126 - protein, 11 aa, BK virus
SLVKALYSKYS

SEQ ID NO: 8127 - protein, 11 aa, BK virus
LVKALYSKYSL

SEQ ID NO: 8128 - protein, 11 aa, BK virus
VKALYSKYSLL

SEQ ID NO: 8129 - protein, 11 aa, BK virus
KALYSKYSLLT

SEQ ID NO: 8130 - protein, 11 aa, BK virus
ALYSKYSLLTP

SEQ ID NO: 8131 - protein, 11 aa, BK virus
LYSKYSLLTPL

SEQ ID NO: 8132 - protein, 11 aa, BK virus
YSKYSLLTPLQ

SEQ ID NO: 8133 - protein, 11 aa, BK virus
SKYSLLTPLQI

SEQ ID NO: 8134 - protein, 11 aa, BK virus
KYSLLTPLQIK

SEQ ID NO: 8135 - protein, 11 aa, BK virus
YSLLTPLQIKK

SEQ ID NO: 8136 - protein, 11 aa, BK virus
SLLTPLQIKKL

SEQ ID NO: 8137 - protein, 11 aa, BK virus
LLTPLQIKKLK

SEQ ID NO: 8138 - protein, 11 aa, BK virus
LTPLQIKKLKV

SEQ ID NO: 8139 - protein, 11 aa, BK virus
TPLQIKKLKVH

SEQ ID NO: 8140 - protein, 11 aa, BK virus
PLQIKKLKVHS

SEQ ID NO: 8141 - protein, 11 aa, BK virus
LQIKKLKVHSF

SEQ ID NO: 8142 - protein, 11 aa, BK virus
QKLLIAETLCL

SEQ ID NO: 8143 - protein, 11 aa, BK virus
KLLIAETLCLC

SEQ ID NO: 8144 - protein, 11 aa, BK virus
LLIAETLCLCG

SEQ ID NO: 8145 - protein, 11 aa, BK virus
LIAETLCLCGV

SEQ ID NO: 8146 - protein, 11 aa, BK virus
IAETLCLCGVK

SEQ ID NO: 8147 - protein, 11 aa, BK virus
AETLCLCGVKK

SEQ ID NO: 8148 - protein, 11 aa, BK virus
ETLCLCGVKKN

SEQ ID NO: 8149 - protein, 11 aa, BK virus
TLCLCGVKKNI

SEQ ID NO: 8150 - protein, 11 aa, BK virus
LCLCGVKKNII

SEQ ID NO: 8151 - protein, 11 aa, BK virus
CLCGVKKNIIL

SEQ ID NO: 8152 - protein, 11 aa, BK virus
LCGVKKNIILC

SEQ ID NO: 8153 - protein, 11 aa, BK virus
CGVKKNIILCP

SEQ ID NO: 8154 - protein, 11 aa, BK virus
GVKKNIILCPA

SEQ ID NO: 8155 - protein, 11 aa, BK virus
VKKNIILCPAH

SEQ ID NO: 8156 - protein, 11 aa, BK virus
KKNIILCPAHM

SEQ ID NO: 8157 - protein, 11 aa, BK virus
KNIILCPAHMC

SEQ ID NO: 8158 - protein, 11 aa, BK virus
NIILCPAHMCL

SEQ ID NO: 8159 - protein, 11 aa, BK virus
IILCPAHMCLL

SEQ ID NO: 8160 - protein, 11 aa, BK virus
ILCPAHMCLLI

SEQ ID NO: 8161 - protein, 11 aa, BK virus
LCPAHMCLLIK

SEQ ID NO: 8162 - protein, 11 aa, BK virus
CPAHMCLLIKV

SEQ ID NO: 8163 - protein, 11 aa, BK virus
PAHMCLLIKVT

SEQ ID NO: 8164 - protein, 11 aa, BK virus
AHMCLLIKVTE

SEQ ID NO: 8165 - protein, 11 aa, BK virus
HMCLLIKVTEY

SEQ ID NO: 8166 - protein, 11 aa, BK virus
MCLLIKVTEYF

SEQ ID NO: 8167 - protein, 11 aa, BK virus
CLLIKVTEYFS

SEQ ID NO: 8168 - protein, 11 aa, BK virus
LLIKVTEYFSI

SEQ ID NO: 8169 - protein, 11 aa, BK virus
LIKVTEYFSIS

SEQ ID NO: 8170 - protein, 11 aa, BK virus
IKVTEYFSISF

SEQ ID NO: 8171 - protein, 11 aa, BK virus
KVTEYFSISFL

SEQ ID NO: 8172 - protein, 11 aa, BK virus
VTEYFSISFLY

SEQ ID NO: 8173 - protein, 11 aa, BK virus
TEYFSISFLYR

SEQ ID NO: 8174 - protein, 11 aa, BK virus
EYFSISFLYRI

SEQ ID NO: 8175 - protein, 11 aa, BK virus
AFSLVVYTAKQ

SEQ ID NO: 8176 - protein, 11 aa, BK virus
FSLVVYTAKQA

SEQ ID NO: 8177 - protein, 11 aa, BK virus
SLVVYTAKQAR

SEQ ID NO: 8178 - protein, 11 aa, BK virus
LVVYTAKQARV

SEQ ID NO: 8179 - protein, 11 aa, BK virus
VVYTAKQARVL

SEQ ID NO: 8180 - protein, 11 aa, BK virus
VYTAKQARVLL

SEQ ID NO: 8181 - protein, 11 aa, BK virus
YTAKQARVLLL

SEQ ID NO: 8182 - protein, 11 aa, BK virus
TAKQARVLLLN

SEQ ID NO: 8183 - protein, 11 aa, BK virus
AKQARVLLLNT

SEQ ID NO: 8184 - protein, 11 aa, BK virus
KQARVLLLNTA

SEQ ID NO: 8185 - protein, 11 aa, BK virus
LRNWCRSEGKS

SEQ ID NO: 8186 - protein, 11 aa, BK virus
RNWCRSEGKSL

SEQ ID NO: 8187 - protein, 11 aa, BK virus
NWCRSEGKSLG

SEQ ID NO: 8188 - protein, 11 aa, BK virus
WCRSEGKSLGS

SEQ ID NO: 8189 - protein, 11 aa, BK virus
CRSEGKSLGSS

SEQ ID NO: 8190 - protein, 11 aa, BK virus
RSEGKSLGSST

SEQ ID NO: 8191 - protein, 11 aa, BK virus
SEGKSLGSSTF

SEQ ID NO: 8192 - protein, 11 aa, BK virus
EGKSLGSSTFL

SEQ ID NO: 8193 - protein, 11 aa, BK virus
GKSLGSSTFLF

SEQ ID NO: 8194 - protein, 11 aa, BK virus
KSLGSSTFLFF

SEQ ID NO: 8195 - protein, 11 aa, BK virus
SLGSSTFLFFL

SEQ ID NO: 8196 - protein, 11 aa, BK virus
LGSSTFLFFLG

SEQ ID NO: 8197 - protein, 11 aa, BK virus
GSSTFLFFLGG

SEQ ID NO: 8198 - protein, 11 aa, BK virus
SSTFLFFLGGV

SEQ ID NO: 8199 - protein, 11 aa, BK virus
STFLFFLGGVE

SEQ ID NO: 8200 - protein, 11 aa, BK virus
TFLFFLGGVEC

SEQ ID NO: 8201 - protein, 11 aa, BK virus
ESAVASSSLAN

SEQ ID NO: 8202 - protein, 11 aa, BK virus
SAVASSSLANI

SEQ ID NO: 8203 - protein, 11 aa, BK virus
AVASSSLANIS

SEQ ID NO: 8204 - protein, 11 aa, BK virus
VASSSLANISS

SEQ ID NO: 8205 - protein, 11 aa, BK virus
ASSSLANISSW

SEQ ID NO: 8206 - protein, 11 aa, BK virus
SSSLANISSWQ

SEQ ID NO: 8207 - protein, 11 aa, BK virus
SSLANISSWQN

SEQ ID NO: 8208 - protein, 11 aa, BK virus
SLANISSWQNK

SEQ ID NO: 8209 - protein, 11 aa, BK virus
LANISSWQNKS

SEQ ID NO: 8210 - protein, 11 aa, BK virus
ANISSWQNKSS

SEQ ID NO: 8211 - protein, 11 aa, BK virus
NISSWQNKSSS

SEQ ID NO: 8212 - protein, 11 aa, BK virus
ISSWQNKSSSH

SEQ ID NO: 8213 - protein, 11 aa, BK virus
SSWQNKSSSHF

SEQ ID NO: 8214 - protein, 11 aa, BK virus
SWQNKSSSHFS

SEQ ID NO: 8215 - protein, 11 aa, BK virus
WQNKSSSHFSL

SEQ ID NO: 8216 - protein, 11 aa, BK virus
QNKSSSHFSLK

SEQ ID NO: 8217 - protein, 11 aa, BK virus
NKSSSHFSLKE

SEQ ID NO: 8218 - protein, 11 aa, BK virus
KSSSHFSLKEL

SEQ ID NO: 8219 - protein, 11 aa, BK virus
SSSHFSLKELH

SEQ ID NO: 8220 - protein, 11 aa, BK virus
SSHFSLKELHQ

SEQ ID NO: 8221 - protein, 11 aa, BK virus
SHFSLKELHQD

SEQ ID NO: 8222 - protein, 11 aa, BK virus
HFSLKELHQDS

SEQ ID NO: 8223 - protein, 11 aa, BK virus
FSLKELHQDSH

SEQ ID NO: 8224 - protein, 11 aa, BK virus
SLKELHQDSHS

SEQ ID NO: 8225 - protein, 11 aa, BK virus
LKELHQDSHSS

SEQ ID NO: 8226 - protein, 11 aa, BK virus
KELHQDSHSSV

SEQ ID NO: 8227 - protein, 11 aa, BK virus
ELHQDSHSSVP

SEQ ID NO: 8228 - protein, 11 aa, BK virus
VGTYKKNNYLG

SEQ ID NO: 8229 - protein, 11 aa, BK virus
GTYKKNNYLGP

SEQ ID NO: 8230 - protein, 11 aa, BK virus
TYKKNNYLGPF

SEQ ID NO: 8231 - protein, 11 aa, BK virus
YKKNNYLGPFN

SEQ ID NO: 8232 - protein, 11 aa, BK virus
KKNNYLGPFNI

SEQ ID NO: 8233 - protein, 11 aa, BK virus
KNNYLGPFNIL

SEQ ID NO: 8234 - protein, 11 aa, BK virus
NNYLGPFNILL

SEQ ID NO: 8235 - protein, 11 aa, BK virus
NYLGPFNILLF

SEQ ID NO: 8236 - protein, 11 aa, BK virus
YLGPFNILLFI

SEQ ID NO: 8237 - protein, 11 aa, BK virus
REFLQLFGPTI

SEQ ID NO: 8238 - protein, 11 aa, BK virus
EFLQLFGPTIA

SEQ ID NO: 8239 - protein, 11 aa, BK virus
FLQLFGPTIAE

SEQ ID NO: 8240 - protein, 11 aa, BK virus
LQLFGPTIAEF

SEQ ID NO: 8241 - protein, 11 aa, BK virus
QLFGPTIAEFL

SEQ ID NO: 8242 - protein, 11 aa, BK virus
LFGPTIAEFLQ

SEQ ID NO: 8243 - protein, 11 aa, BK virus
FGPTIAEFLQL

SEQ ID NO: 8244 - protein, 11 aa, BK virus
GPTIAEFLQLG

SEQ ID NO: 8245 - protein, 11 aa, BK virus
PTIAEFLQLGL

SEQ ID NO: 8246 - protein, 11 aa, BK virus
TIAEFLQLGLS

SEQ ID NO: 8247 - protein, 11 aa, BK virus
IAEFLQLGLSQ

SEQ ID NO: 8248 - protein, 11 aa, BK virus
AEFLQLGLSQT

SEQ ID NO: 8249 - protein, 11 aa, BK virus
EFLQLGLSQTT

SEQ ID NO: 8250 - protein, 11 aa, BK virus
FLQLGLSQTTV

SEQ ID NO: 8251 - protein, 11 aa, BK virus
SSQCSSNLSKP

SEQ ID NO: 8252 - protein, 11 aa, BK virus
SQCSSNLSKPR

SEQ ID NO: 8253 - protein, 11 aa, BK virus
QCSSNLSKPRA

SEQ ID NO: 8254 - protein, 11 aa, BK virus
CSSNLSKPRAL

SEQ ID NO: 8255 - protein, 11 aa, BK virus
SSNLSKPRALF

SEQ ID NO: 8256 - protein, 11 aa, BK virus
SNLSKPRALFL

SEQ ID NO: 8257 - protein, 11 aa, BK virus
NLSKPRALFLK

SEQ ID NO: 8258 - protein, 11 aa, BK virus
LSKPRALFLKI

SEQ ID NO: 8259 - protein, 11 aa, BK virus
SKPRALFLKIF

SEQ ID NO: 8260 - protein, 11 aa, BK virus
KPRALFLKIFY

SEQ ID NO: 8261 - protein, 11 aa, BK virus
PRALFLKIFYL

SEQ ID NO: 8262 - protein, 11 aa, BK virus
RALFLKIFYLN

SEQ ID NO: 8263 - protein, 11 aa, BK virus
ALFLKIFYLNA

SEQ ID NO: 8264 - protein, 11 aa, BK virus
LFLKIFYLNAL

SEQ ID NO: 8265 - protein, 11 aa, BK virus
FLKIFYLNALI

SEQ ID NO: 8266 - protein, 11 aa, BK virus
ADIACKGSAQK

SEQ ID NO: 8267 - protein, 11 aa, BK virus
DIACKGSAQKA

SEQ ID NO: 8268 - protein, 11 aa, BK virus
IACKGSAQKAF

SEQ ID NO: 8269 - protein, 11 aa, BK virus
ACKGSAQKAFW

SEQ ID NO: 8270 - protein, 11 aa, BK virus
CKGSAQKAFWN

SEQ ID NO: 8271 - protein, 11 aa, BK virus
KGSAQKAFWNK

SEQ ID NO: 8272 - protein, 11 aa, BK virus
AIPCSTGYLGK

SEQ ID NO: 8273 - protein, 11 aa, BK virus
IPCSTGYLGKE

SEQ ID NO: 8274 - protein, 11 aa, BK virus
PCSTGYLGKEE

SEQ ID NO: 8275 - protein, 11 aa, BK virus
CSTGYLGKEEN

SEQ ID NO: 8276 - protein, 11 aa, BK virus
STGYLGKEENQ

SEQ ID NO: 8277 - protein, 11 aa, BK virus
TGYLGKEENQH

SEQ ID NO: 8278 - protein, 11 aa, BK virus
GYLGKEENQHK

SEQ ID NO: 8279 - protein, 11 aa, BK virus
YLGKEENQHKP

SEQ ID NO: 8280 - protein, 11 aa, BK virus
LGKEENQHKPL

SEQ ID NO: 8281 - protein, 11 aa, BK virus
GKEENQHKPLS

SEQ ID NO: 8282 - protein, 11 aa, BK virus
KEENQHKPLSY

SEQ ID NO: 8283 - protein, 11 aa, BK virus
EENQHKPLSYS

SEQ ID NO: 8284 - protein, 11 aa, BK virus
ENQHKPLSYSR

SEQ ID NO: 8285 - protein, 11 aa, BK virus
NQHKPLSYSRF

SEQ ID NO: 8286 - protein, 11 aa, BK virus
QHKPLSYSRFQ

SEQ ID NO: 8287 - protein, 11 aa, BK virus
HKPLSYSRFQN

SEQ ID NO: 8288 - protein, 11 aa, BK virus
KPLSYSRFQNQ

SEQ ID NO: 8289 - protein, 11 aa, BK virus
PLSYSRFQNQA

SEQ ID NO: 8290 - protein, 11 aa, BK virus
LSYSRFQNQAD

SEQ ID NO: 8291 - protein, 11 aa, BK virus
SYSRFQNQADE

SEQ ID NO: 8292 - protein, 11 aa, BK virus
YSRFQNQADEL

SEQ ID NO: 8293 - protein, 11 aa, BK virus
SRFQNQADELP

SEQ ID NO: 8294 - protein, 11 aa, BK virus
RFQNQADELPL

SEQ ID NO: 8295 - protein, 11 aa, BK virus
FQNQADELPLH

SEQ ID NO: 8296 - protein, 11 aa, BK virus
QNQADELPLHP

SEQ ID NO: 8297 - protein, 11 aa, BK virus
NQADELPLHPA

SEQ ID NO: 8298 - protein, 11 aa, BK virus
QADELPLHPAP

SEQ ID NO: 8299 - protein, 11 aa, BK virus
ADELPLHPAPF

SEQ ID NO: 8300 - protein, 11 aa, BK virus
DELPLHPAPFF

SEQ ID NO: 8301 - protein, 11 aa, BK virus
ELPLHPAPFFY

SEQ ID NO: 8302 - protein, 11 aa, BK virus
LPLHPAPFFYT

SEQ ID NO: 8303 - protein, 11 aa, BK virus
PLHPAPFFYTK

SEQ ID NO: 8304 - protein, 11 aa, BK virus
LHPAPFFYTKY

SEQ ID NO: 8305 - protein, 11 aa, BK virus
HPAPFFYTKYS

SEQ ID NO: 8306 - protein, 11 aa, BK virus
PAPFFYTKYSF

SEQ ID NO: 8307 - protein, 11 aa, BK virus
APFFYTKYSFS

SEQ ID NO: 8308 - protein, 11 aa, BK virus
PFFYTKYSFSS

SEQ ID NO: 8309 - protein, 11 aa, BK virus
FFYTKYSFSSF

SEQ ID NO: 8310 - protein, 11 aa, BK virus
FYTKYSFSSFY

SEQ ID NO: 8311 - protein, 11 aa, BK virus
YTKYSFSSFYP

SEQ ID NO: 8312 - protein, 11 aa, BK virus
TKYSFSSFYPR

SEQ ID NO: 8313 - protein, 11 aa, BK virus
KYSFSSFYPRR

SEQ ID NO: 8314 - protein, 11 aa, BK virus
YSFSSFYPRRP

SEQ ID NO: 8315 - protein, 11 aa, BK virus
SFSSFYPRRPL

SEQ ID NO: 8316 - protein, 11 aa, BK virus
FSSFYPRRPLC

SEQ ID NO: 8317 - protein, 11 aa, BK virus
SSFYPRRPLCQ

SEQ ID NO: 8318 - protein, 11 aa, BK virus
SFYPRRPLCQG

SEQ ID NO: 8319 - protein, 11 aa, BK virus
FYPRRPLCQGE

SEQ ID NO: 8320 - protein, 11 aa, BK virus
YPRRPLCQGEI

SEQ ID NO: 8321 - protein, 11 aa, BK virus
PRRPLCQGEIP

SEQ ID NO: 8322 - protein, 11 aa, BK virus
RRPLCQGEIPY

SEQ ID NO: 8323 - protein, 11 aa, BK virus
RPLCQGEIPYT

SEQ ID NO: 8324 - protein, 11 aa, BK virus
PLCQGEIPYTS

SEQ ID NO: 8325 - protein, 11 aa, BK virus
LCQGEIPYTSL

SEQ ID NO: 8326 - protein, 11 aa, BK virus
CQGEIPYTSLN

SEQ ID NO: 8327 - protein, 11 aa, BK virus
QGEIPYTSLNK

SEQ ID NO: 8328 - protein, 11 aa, BK virus
GEIPYTSLNKL

SEQ ID NO: 8329 - protein, 11 aa, BK virus
EIPYTSLNKLF

SEQ ID NO: 8330 - protein, 11 aa, BK virus
IPYTSLNKLFS

SEQ ID NO: 8331 - protein, 11 aa, BK virus
PYTSLNKLFSL

SEQ ID NO: 8332 - protein, 11 aa, BK virus
YTSLNKLFSLR

SEQ ID NO: 8333 - protein, 11 aa, BK virus
TSLNKLFSLRE

SEQ ID NO: 8334 - protein, 11 aa, BK virus
SLNKLFSLRED

SEQ ID NO: 8335 - protein, 11 aa, BK virus
LNKLFSLREDF

SEQ ID NO: 8336 - protein, 11 aa, BK virus
NKLFSLREDFP

SEQ ID NO: 8337 - protein, 11 aa, BK virus
KLFSLREDFPR

SEQ ID NO: 8338 - protein, 11 aa, BK virus
LFSLREDFPRQ

SEQ ID NO: 8339 - protein, 11 aa, BK virus
FSLREDFPRQL

SEQ ID NO: 8340 - protein, 11 aa, BK virus
SLREDFPRQLF

SEQ ID NO: 8341 - protein, 11 aa, BK virus
LREDFPRQLFQ

SEQ ID NO: 8342 - protein, 11 aa, BK virus
REDFPRQLFQG

SEQ ID NO: 8343 - protein, 11 aa, BK virus
EDFPRQLFQGL

SEQ ID NO: 8344 - protein, 11 aa, BK virus
DFPRQLFQGLK

SEQ ID NO: 8345 - protein, 11 aa, BK virus
FPRQLFQGLKG

SEQ ID NO: 8346 - protein, 11 aa, BK virus
PRQLFQGLKGP

SEQ ID NO: 8347 - protein, 8 aa, BK virus
LQKLQKNR

SEQ ID NO: 8348 - protein, 8 aa, BK virus
QKLQKNRD

SEQ ID NO: 8349 - protein, 8 aa, BK virus
KLQKNRDF

SEQ ID NO: 8350 - protein, 8 aa, BK virus
LQKNRDFP

SEQ ID NO: 8351 - protein, 8 aa, BK virus
QKNRDFPK

SEQ ID NO: 8352 - protein, 8 aa, BK virus
ASEKASTP

SEQ ID NO: 8353 - protein, 8 aa, BK virus
SEKASTPL

SEQ ID NO: 8354 - protein, 8 aa, BK virus
EKASTPLL

SEQ ID NO: 8355 - protein, 8 aa, BK virus
KASTPLLL

SEQ ID NO: 8356 - protein, 8 aa, BK virus
ASTPLLLE

SEQ ID NO: 8357 - protein, 8 aa, BK virus
STPLLLER

SEQ ID NO: 8358 - protein, 8 aa, BK virus
TPLLLERK

SEQ ID NO: 8359 - protein, 8 aa, BK virus
PLLLERKG

SEQ ID NO: 8360 - protein, 8 aa, BK virus
LLLERKGG

SEQ ID NO: 8361 - protein, 8 aa, BK virus
LLERKGGG

SEQ ID NO: 8362 - protein, 8 aa, BK virus
LERKGGGR

SEQ ID NO: 8363 - protein, 8 aa, BK virus
ERKGGGRG

SEQ ID NO: 8364 - protein, 8 aa, BK virus
RKGGGRGG

SEQ ID NO: 8365 - protein, 8 aa, BK virus
KGGGRGGL

SEQ ID NO: 8366 - protein, 8 aa, BK virus
GGGRGGLG

SEQ ID NO: 8367 - protein, 8 aa, BK virus
GGRGGLGL

SEQ ID NO: 8368 - protein, 8 aa, BK virus
GRGGLGLL

SEQ ID NO: 8369 - protein, 8 aa, BK virus
RGGLGLLY

SEQ ID NO: 8370 - protein, 8 aa, BK virus
GGLGLLYI

SEQ ID NO: 8371 - protein, 8 aa, BK virus
GLGLLYII

SEQ ID NO: 8372 - protein, 8 aa, BK virus
LGLLYIIK

SEQ ID NO: 8373 - protein, 8 aa, BK virus
GLLYIIKK

SEQ ID NO: 8374 - protein, 8 aa, BK virus
LLYIIKKK

SEQ ID NO: 8375 - protein, 8 aa, BK virus
LYIIKKKA

SEQ ID NO: 8376 - protein, 8 aa, BK virus
YIIKKKAT

SEQ ID NO: 8377 - protein, 8 aa, BK virus
IIKKKATG

SEQ ID NO: 8378 - protein, 8 aa, BK virus
IKKKATGR

SEQ ID NO: 8379 - protein, 8 aa, BK virus
KKKATGRS

SEQ ID NO: 8380 - protein, 8 aa, BK virus
KKATGRSC

SEQ ID NO: 8381 - protein, 8 aa, BK virus
KATGRSCL

SEQ ID NO: 8382 - protein, 8 aa, BK virus
ATGRSCLP

SEQ ID NO: 8383 - protein, 8 aa, BK virus
TGRSCLPM

SEQ ID NO: 8384 - protein, 8 aa, BK virus
GRSCLPME

SEQ ID NO: 8385 - protein, 8 aa, BK virus
RSCLPMEC

SEQ ID NO: 8386 - protein, 8 aa, BK virus
SCLPMECS

SEQ ID NO: 8387 - protein, 8 aa, BK virus
CLPMECSQ

SEQ ID NO: 8388 - protein, 8 aa, BK virus
LPMECSQT

SEQ ID NO: 8389 - protein, 8 aa, BK virus
PMECSQTM

SEQ ID NO: 8390 - protein, 8 aa, BK virus
MECSQTMT

SEQ ID NO: 8391 - protein, 8 aa, BK virus
ECSQTMTS

SEQ ID NO: 8392 - protein, 8 aa, BK virus
CSQTMTSG

SEQ ID NO: 8393 - protein, 8 aa, BK virus
SQTMTSGR

SEQ ID NO: 8394 - protein, 8 aa, BK virus
QTMTSGRK

SEQ ID NO: 8395 - protein, 8 aa, BK virus
TMTSGRKV

SEQ ID NO: 8396 - protein, 8 aa, BK virus
MTSGRKVH

SEQ ID NO: 8397 - protein, 8 aa, BK virus
TSGRKVHD

SEQ ID NO: 8398 - protein, 8 aa, BK virus
SGRKVHDS

SEQ ID NO: 8399 - protein, 8 aa, BK virus
GRKVHDSQ

SEQ ID NO: 8400 - protein, 8 aa, BK virus
RKVHDSQG

SEQ ID NO: 8401 - protein, 8 aa, BK virus
KVHDSQGN

SEQ ID NO: 8402 - protein, 8 aa, BK virus
VHDSQGNA

SEQ ID NO: 8403 - protein, 8 aa, BK virus
HDSQGNAA

SEQ ID NO: 8404 - protein, 8 aa, BK virus
DSQGNAAK

SEQ ID NO: 8405 - protein, 8 aa, BK virus
SQGNAAKP

SEQ ID NO: 8406 - protein, 8 aa, BK virus
PQEGKCMT

SEQ ID NO: 8407 - protein, 8 aa, BK virus
QEGKCMTH

SEQ ID NO: 8408 - protein, 8 aa, BK virus
EGKCMTHR

SEQ ID NO: 8409 - protein, 8 aa, BK virus
GKCMTHRE

SEQ ID NO: 8410 - protein, 8 aa, BK virus
KCMTHREE

SEQ ID NO: 8411 - protein, 8 aa, BK virus
CMTHREEL

SEQ ID NO: 8412 - protein, 8 aa, BK virus
MTHREELL

SEQ ID NO: 8413 - protein, 8 aa, BK virus
THREELLT

SEQ ID NO: 8414 - protein, 8 aa, BK virus
HREELLTH

SEQ ID NO: 8415 - protein, 8 aa, BK virus
REELLTHG

SEQ ID NO: 8416 - protein, 8 aa, BK virus
EELLTHGM

SEQ ID NO: 8417 - protein, 8 aa, BK virus
ELLTHGMQ

SEQ ID NO: 8418 - protein, 8 aa, BK virus
LLTHGMQP

SEQ ID NO: 8419 - protein, 8 aa, BK virus
LTHGMQPN

SEQ ID NO: 8420 - protein, 8 aa, BK virus
THGMQPNH

SEQ ID NO: 8421 - protein, 8 aa, BK virus
HGMQPNHD

SEQ ID NO: 8422 - protein, 8 aa, BK virus
GMQPNHDL

SEQ ID NO: 8423 - protein, 8 aa, BK virus
MQPNHDLR

SEQ ID NO: 8424 - protein, 8 aa, BK virus
QPNHDLRK

SEQ ID NO: 8425 - protein, 8 aa, BK virus
PNHDLRKE

SEQ ID NO: 8426 - protein, 8 aa, BK virus
NHDLRKES

SEQ ID NO: 8427 - protein, 8 aa, BK virus
HDLRKESA

SEQ ID NO: 8428 - protein, 8 aa, BK virus
QTCFASLG

SEQ ID NO: 8429 - protein, 8 aa, BK virus
TCFASLGI

SEQ ID NO: 8430 - protein, 8 aa, BK virus
CFASLGIL

SEQ ID NO: 8431 - protein, 8 aa, BK virus
FASLGILA

SEQ ID NO: 8432 - protein, 8 aa, BK virus
ASLGILAL

SEQ ID NO: 8433 - protein, 8 aa, BK virus
SLGILALS

SEQ ID NO: 8434 - protein, 8 aa, BK virus
LGILALSP

SEQ ID NO: 8435 - protein, 8 aa, BK virus
GILALSPV

SEQ ID NO: 8436 - protein, 8 aa, BK virus
ILALSPVK

SEQ ID NO: 8437 - protein, 8 aa, BK virus
LALSPVKL

SEQ ID NO: 8438 - protein, 8 aa, BK virus
ALSPVKLD

SEQ ID NO: 8439 - protein, 8 aa, BK virus
LSPVKLDK

SEQ ID NO: 8440 - protein, 8 aa, BK virus
SPVKLDKG

SEQ ID NO: 8441 - protein, 8 aa, BK virus
PVKLDKGH

SEQ ID NO: 8442 - protein, 8 aa, BK virus
VKLDKGHG

SEQ ID NO: 8443 - protein, 8 aa, BK virus
KLDKGHGS

SEQ ID NO: 8444 - protein, 8 aa, BK virus
LDKGHGSA

SEQ ID NO: 8445 - protein, 8 aa, BK virus
DKGHGSAP

SEQ ID NO: 8446 - protein, 8 aa, BK virus
KGHGSAPA

SEQ ID NO: 8447 - protein, 8 aa, BK virus
GHGSAPAV

SEQ ID NO: 8448 - protein, 8 aa, BK virus
HGSAPAVT

SEQ ID NO: 8449 - protein, 8 aa, BK virus
GSAPAVTT

SEQ ID NO: 8450 - protein, 8 aa, BK virus
SAPAVTTS

SEQ ID NO: 8451 - protein, 8 aa, BK virus
APAVTTSF

SEQ ID NO: 8452 - protein, 8 aa, BK virus
PAVTTSFS

SEQ ID NO: 8453 - protein, 8 aa, BK virus
AVTTSFSE

SEQ ID NO: 8454 - protein, 8 aa, BK virus
VTTSFSES

SEQ ID NO: 8455 - protein, 8 aa, BK virus
TTSFSESW

SEQ ID NO: 8456 - protein, 8 aa, BK virus
NLDWNKKK

SEQ ID NO: 8457 - protein, 8 aa, BK virus
LDWNKKKS

SEQ ID NO: 8458 - protein, 8 aa, BK virus
DWNKKKSS

SEQ ID NO: 8459 - protein, 8 aa, BK virus
WNKKKSSE

SEQ ID NO: 8460 - protein, 8 aa, BK virus
NKKKSSED

SEQ ID NO: 8461 - protein, 8 aa, BK virus
KKKSSEDF

SEQ ID NO: 8462 - protein, 8 aa, BK virus
KKSSEDFY

SEQ ID NO: 8463 - protein, 8 aa, BK virus
KSSEDFYF

SEQ ID NO: 8464 - protein, 8 aa, BK virus
SSEDFYFY

SEQ ID NO: 8465 - protein, 8 aa, BK virus
SEDFYFYF

SEQ ID NO: 8466 - protein, 8 aa, BK virus
EDFYFYFR

SEQ ID NO: 8467 - protein, 8 aa, BK virus
DFYFYFRA

SEQ ID NO: 8468 - protein, 8 aa, BK virus
FYFYFRAF

SEQ ID NO: 8469 - protein, 8 aa, BK virus
YFYFRAFA

SEQ ID NO: 8470 - protein, 8 aa, BK virus
FYFRAFAG

SEQ ID NO: 8471 - protein, 8 aa, BK virus
YFRAFAGI

SEQ ID NO: 8472 - protein, 8 aa, BK virus
FRAFAGIL

SEQ ID NO: 8473 - protein, 8 aa, BK virus
RQCRREKQ

SEQ ID NO: 8474 - protein, 8 aa, BK virus
QCRREKQK

SEQ ID NO: 8475 - protein, 8 aa, BK virus
CRREKQKY

SEQ ID NO: 8476 - protein, 8 aa, BK virus
RREKQKYH

SEQ ID NO: 8477 - protein, 8 aa, BK virus
REKQKYHC

SEQ ID NO: 8478 - protein, 8 aa, BK virus
EKQKYHCF

SEQ ID NO: 8479 - protein, 8 aa, BK virus
KQKYHCFT

SEQ ID NO: 8480 - protein, 8 aa, BK virus
QKYHCFTC

SEQ ID NO: 8481 - protein, 8 aa, BK virus
KYHCFTCC

SEQ ID NO: 8482 - protein, 8 aa, BK virus
YHCFTCCK

SEQ ID NO: 8483 - protein, 8 aa, BK virus
HCFTCCKR

SEQ ID NO: 8484 - protein, 8 aa, BK virus
CFTCCKRL

SEQ ID NO: 8485 - protein, 8 aa, BK virus
FTCCKRLC

SEQ ID NO: 8486 - protein, 8 aa, BK virus
TCCKRLCK

SEQ ID NO: 8487 - protein, 8 aa, BK virus
CCKRLCKR

SEQ ID NO: 8488 - protein, 8 aa, BK virus
CKRLCKRL

SEQ ID NO: 8489 - protein, 8 aa, BK virus
KRLCKRLL

SEQ ID NO: 8490 - protein, 8 aa, BK virus
RLCKRLLG

SEQ ID NO: 8491 - protein, 8 aa, BK virus
LCKRLLGK

SEQ ID NO: 8492 - protein, 8 aa, BK virus
SLFFCISR

SEQ ID NO: 8493 - protein, 8 aa, BK virus
LFFCISRF

SEQ ID NO: 8494 - protein, 8 aa, BK virus
FFCISRFM

SEQ ID NO: 8495 - protein, 8 aa, BK virus
FCISRFMG

SEQ ID NO: 8496 - protein, 8 aa, BK virus
CISRFMGA

SEQ ID NO: 8497 - protein, 8 aa, BK virus
ISRFMGAA

SEQ ID NO: 8498 - protein, 8 aa, BK virus
SRFMGAAL

SEQ ID NO: 8499 - protein, 8 aa, BK virus
RFMGAALA

SEQ ID NO: 8500 - protein, 8 aa, BK virus
FMGAALAL

SEQ ID NO: 8501 - protein, 8 aa, BK virus
MGAALALL

SEQ ID NO: 8502 - protein, 8 aa, BK virus
GAALALLG

SEQ ID NO: 8503 - protein, 8 aa, BK virus
AALALLGD

SEQ ID NO: 8504 - protein, 8 aa, BK virus
ALALLGDL

SEQ ID NO: 8505 - protein, 8 aa, BK virus
LALLGDLV

SEQ ID NO: 8506 - protein, 8 aa, BK virus
ALLGDLVA

SEQ ID NO: 8507 - protein, 8 aa, BK virus
LLGDLVAS

SEQ ID NO: 8508 - protein, 8 aa, BK virus
LGDLVASV

SEQ ID NO: 8509 - protein, 8 aa, BK virus
GDLVASVS

SEQ ID NO: 8510 - protein, 8 aa, BK virus
DLVASVSE

SEQ ID NO: 8511 - protein, 8 aa, BK virus
LVASVSEA

SEQ ID NO: 8512 - protein, 8 aa, BK virus
VASVSEAA

SEQ ID NO: 8513 - protein, 8 aa, BK virus
ASVSEAAA

SEQ ID NO: 8514 - protein, 8 aa, BK virus
SVSEAAAA

SEQ ID NO: 8515 - protein, 8 aa, BK virus
VSEAAAAT

SEQ ID NO: 8516 - protein, 8 aa, BK virus
SEAAAATG

SEQ ID NO: 8517 - protein, 8 aa, BK virus
EAAAATGF

SEQ ID NO: 8518 - protein, 8 aa, BK virus
AAAATGFS

SEQ ID NO: 8519 - protein, 8 aa, BK virus
AAATGFSV

SEQ ID NO: 8520 - protein, 8 aa, BK virus
AATGFSVA

SEQ ID NO: 8521 - protein, 8 aa, BK virus
ATGFSVAE

SEQ ID NO: 8522 - protein, 8 aa, BK virus
TGFSVAEI

SEQ ID NO: 8523 - protein, 8 aa, BK virus
GFSVAEIA

SEQ ID NO: 8524 - protein, 8 aa, BK virus
FSVAEIAA

SEQ ID NO: 8525 - protein, 8 aa, BK virus
SVAEIAAG

SEQ ID NO: 8526 - protein, 8 aa, BK virus
VAEIAAGE

SEQ ID NO: 8527 - protein, 8 aa, BK virus
AEIAAGEA

SEQ ID NO: 8528 - protein, 8 aa, BK virus
EIAAGEAA

SEQ ID NO: 8529 - protein, 8 aa, BK virus
IAAGEAAA

SEQ ID NO: 8530 - protein, 8 aa, BK virus
AAGEAAAA

SEQ ID NO: 8531 - protein, 8 aa, BK virus
AGEAAAAI

SEQ ID NO: 8532 - protein, 8 aa, BK virus
GEAAAAIE

SEQ ID NO: 8533 - protein, 8 aa, BK virus
EAAAAIEV

SEQ ID NO: 8534 - protein, 8 aa, BK virus
AAAAIEVQ

SEQ ID NO: 8535 - protein, 8 aa, BK virus
AAAIEVQI

SEQ ID NO: 8536 - protein, 8 aa, BK virus
AAIEVQIA

SEQ ID NO: 8537 - protein, 8 aa, BK virus
AIEVQIAS

SEQ ID NO: 8538 - protein, 8 aa, BK virus
IEVQIASL

SEQ ID NO: 8539 - protein, 8 aa, BK virus
EVQIASLA

SEQ ID NO: 8540 - protein, 8 aa, BK virus
VQIASLAT

SEQ ID NO: 8541 - protein, 8 aa, BK virus
QIASLATV

SEQ ID NO: 8542 - protein, 8 aa, BK virus
IASLATVE

SEQ ID NO: 8543 - protein, 8 aa, BK virus
ASLATVEG

SEQ ID NO: 8544 - protein, 8 aa, BK virus
SLATVEGI

SEQ ID NO: 8545 - protein, 8 aa, BK virus
LATVEGIT

SEQ ID NO: 8546 - protein, 8 aa, BK virus
ATVEGITS

SEQ ID NO: 8547 - protein, 8 aa, BK virus
TVEGITST

SEQ ID NO: 8548 - protein, 8 aa, BK virus
VEGITSTS

SEQ ID NO: 8549 - protein, 8 aa, BK virus
EGITSTSE

SEQ ID NO: 8550 - protein, 8 aa, BK virus
GITSTSEA

SEQ ID NO: 8551 - protein, 8 aa, BK virus
ITSTSEAI

SEQ ID NO: 8552 - protein, 8 aa, BK virus
TSTSEAIA

SEQ ID NO: 8553 - protein, 8 aa, BK virus
STSEAIAA

SEQ ID NO: 8554 - protein, 8 aa, BK virus
TSEAIAAI

SEQ ID NO: 8555 - protein, 8 aa, BK virus
SEAIAAIG

SEQ ID NO: 8556 - protein, 8 aa, BK virus
EAIAAIGL

SEQ ID NO: 8557 - protein, 8 aa, BK virus
AIAAIGLT

SEQ ID NO: 8558 - protein, 8 aa, BK virus
IAAIGLTP

SEQ ID NO: 8559 - protein, 8 aa, BK virus
AAIGLTPQ

SEQ ID NO: 8560 - protein, 8 aa, BK virus
AIGLTPQT

SEQ ID NO: 8561 - protein, 8 aa, BK virus
IGLTPQTY

SEQ ID NO: 8562 - protein, 8 aa, BK virus
GLTPQTYA

SEQ ID NO: 8563 - protein, 8 aa, BK virus
LTPQTYAV

SEQ ID NO: 8564 - protein, 8 aa, BK virus
TPQTYAVI

SEQ ID NO: 8565 - protein, 8 aa, BK virus
PQTYAVIA

SEQ ID NO: 8566 - protein, 8 aa, BK virus
QTYAVIAG

SEQ ID NO: 8567 - protein, 8 aa, BK virus
TYAVIAGA

SEQ ID NO: 8568 - protein, 8 aa, BK virus
YAVIAGAP

SEQ ID NO: 8569 - protein, 8 aa, BK virus
AVIAGAPG

SEQ ID NO: 8570 - protein, 8 aa, BK virus
VIAGAPGA

SEQ ID NO: 8571 - protein, 8 aa, BK virus
IAGAPGAI

SEQ ID NO: 8572 - protein, 8 aa, BK virus
AGAPGAIA

SEQ ID NO: 8573 - protein, 8 aa, BK virus
GAPGAIAG

SEQ ID NO: 8574 - protein, 8 aa, BK virus
APGAIAGF

SEQ ID NO: 8575 - protein, 8 aa, BK virus
PGAIAGFA

SEQ ID NO: 8576 - protein, 8 aa, BK virus
GAIAGFAA

SEQ ID NO: 8577 - protein, 8 aa, BK virus
AIAGFAAL

SEQ ID NO: 8578 - protein, 8 aa, BK virus
IAGFAALI

SEQ ID NO: 8579 - protein, 8 aa, BK virus
AGFAALIQ

SEQ ID NO: 8580 - protein, 8 aa, BK virus
GFAALIQT

SEQ ID NO: 8581 - protein, 8 aa, BK virus
FAALIQTV

SEQ ID NO: 8582 - protein, 8 aa, BK virus
AALIQTVS

SEQ ID NO: 8583 - protein, 8 aa, BK virus
ALIQTVSG

SEQ ID NO: 8584 - protein, 8 aa, BK virus
LIQTVSGI

SEQ ID NO: 8585 - protein, 8 aa, BK virus
IQTVSGIS

SEQ ID NO: 8586 - protein, 8 aa, BK virus
QTVSGISS

SEQ ID NO: 8587 - protein, 8 aa, BK virus
TVSGISSL

SEQ ID NO: 8588 - protein, 8 aa, BK virus
VSGISSLA

SEQ ID NO: 8589 - protein, 8 aa, BK virus
SGISSLAQ

SEQ ID NO: 8590 - protein, 8 aa, BK virus
GISSLAQV

SEQ ID NO: 8591 - protein, 8 aa, BK virus
ISSLAQVG

SEQ ID NO: 8592 - protein, 8 aa, BK virus
SSLAQVGY

SEQ ID NO: 8593 - protein, 8 aa, BK virus
SLAQVGYK

SEQ ID NO: 8594 - protein, 8 aa, BK virus
LAQVGYKF

SEQ ID NO: 8595 - protein, 8 aa, BK virus
AQVGYKFF

SEQ ID NO: 8596 - protein, 8 aa, BK virus
QVGYKFFD

SEQ ID NO: 8597 - protein, 8 aa, BK virus
VGYKFFDD

SEQ ID NO: 8598 - protein, 8 aa, BK virus
GYKFFDDW

SEQ ID NO: 8599 - protein, 8 aa, BK virus
YKFFDDWD

SEQ ID NO: 8600 - protein, 8 aa, BK virus
KFFDDWDH

SEQ ID NO: 8601 - protein, 8 aa, BK virus
FFDDWDHK

SEQ ID NO: 8602 - protein, 8 aa, BK virus
FDDWDHKV

SEQ ID NO: 8603 - protein, 8 aa, BK virus
DDWDHKVS

SEQ ID NO: 8604 - protein, 8 aa, BK virus
DWDHKVST

SEQ ID NO: 8605 - protein, 8 aa, BK virus
WDHKVSTV

SEQ ID NO: 8606 - protein, 8 aa, BK virus
DHKVSTVG

SEQ ID NO: 8607 - protein, 8 aa, BK virus
HKVSTVGL

SEQ ID NO: 8608 - protein, 8 aa, BK virus
KVSTVGLY

SEQ ID NO: 8609 - protein, 8 aa, BK virus
VSTVGLYQ

SEQ ID NO: 8610 - protein, 8 aa, BK virus
STVGLYQQ

SEQ ID NO: 8611 - protein, 8 aa, BK virus
TVGLYQQS

SEQ ID NO: 8612 - protein, 8 aa, BK virus
VGLYQQSG

SEQ ID NO: 8613 - protein, 8 aa, BK virus
GLYQQSGM

SEQ ID NO: 8614 - protein, 8 aa, BK virus
LYQQSGMA

SEQ ID NO: 8615 - protein, 8 aa, BK virus
YQQSGMAL

SEQ ID NO: 8616 - protein, 8 aa, BK virus
QQSGMALE

SEQ ID NO: 8617 - protein, 8 aa, BK virus
QSGMALEL

SEQ ID NO: 8618 - protein, 8 aa, BK virus
SGMALELF

SEQ ID NO: 8619 - protein, 8 aa, BK virus
GMALELFN

SEQ ID NO: 8620 - protein, 8 aa, BK virus
MALELFNP

SEQ ID NO: 8621 - protein, 8 aa, BK virus
ALELFNPD

SEQ ID NO: 8622 - protein, 8 aa, BK virus
LELFNPDE

SEQ ID NO: 8623 - protein, 8 aa, BK virus
ELFNPDEY

SEQ ID NO: 8624 - protein, 8 aa, BK virus
LFNPDEYY

SEQ ID NO: 8625 - protein, 8 aa, BK virus
FNPDEYYD

SEQ ID NO: 8626 - protein, 8 aa, BK virus
NPDEYYDI

SEQ ID NO: 8627 - protein, 8 aa, BK virus
PDEYYDIL

SEQ ID NO: 8628 - protein, 8 aa, BK virus
DEYYDILF

SEQ ID NO: 8629 - protein, 8 aa, BK virus
EYYDILFP

SEQ ID NO: 8630 - protein, 8 aa, BK virus
YYDILFPG

SEQ ID NO: 8631 - protein, 8 aa, BK virus
YDILFPGV

SEQ ID NO: 8632 - protein, 8 aa, BK virus
DILFPGVN

SEQ ID NO: 8633 - protein, 8 aa, BK virus
ILFPGVNT

SEQ ID NO: 8634 - protein, 8 aa, BK virus
LFPGVNTF

SEQ ID NO: 8635 - protein, 8 aa, BK virus
FPGVNTFV

SEQ ID NO: 8636 - protein, 8 aa, BK virus
PGVNTFVN

SEQ ID NO: 8637 - protein, 8 aa, BK virus
GVNTFVNN

SEQ ID NO: 8638 - protein, 8 aa, BK virus
VNTFVNNI

SEQ ID NO: 8639 - protein, 8 aa, BK virus
NTFVNNIQ

SEQ ID NO: 8640 - protein, 8 aa, BK virus
TFVNNIQY

SEQ ID NO: 8641 - protein, 8 aa, BK virus
FVNNIQYL

SEQ ID NO: 8642 - protein, 8 aa, BK virus
VNNIQYLD

SEQ ID NO: 8643 - protein, 8 aa, BK virus
NNIQYLDP

SEQ ID NO: 8644 - protein, 8 aa, BK virus
NIQYLDPR

SEQ ID NO: 8645 - protein, 8 aa, BK virus
IQYLDPRH

SEQ ID NO: 8646 - protein, 8 aa, BK virus
QYLDPRHW

SEQ ID NO: 8647 - protein, 8 aa, BK virus
YLDPRHWG

SEQ ID NO: 8648 - protein, 8 aa, BK virus
LDPRHWGP

SEQ ID NO: 8649 - protein, 8 aa, BK virus
DPRHWGPS

SEQ ID NO: 8650 - protein, 8 aa, BK virus
PRHWGPSL

SEQ ID NO: 8651 - protein, 8 aa, BK virus
RHWGPSLF

SEQ ID NO: 8652 - protein, 8 aa, BK virus
HWGPSLFA

SEQ ID NO: 8653 - protein, 8 aa, BK virus
WGPSLFAT

SEQ ID NO: 8654 - protein, 8 aa, BK virus
GPSLFATI

SEQ ID NO: 8655 - protein, 8 aa, BK virus
PSLFATIS

SEQ ID NO: 8656 - protein, 8 aa, BK virus
SLFATISQ

SEQ ID NO: 8657 - protein, 8 aa, BK virus
LFATISQA

SEQ ID NO: 8658 - protein, 8 aa, BK virus
FATISQAL

SEQ ID NO: 8659 - protein, 8 aa, BK virus
ATISQALW

SEQ ID NO: 8660 - protein, 8 aa, BK virus
TISQALWH

SEQ ID NO: 8661 - protein, 8 aa, BK virus
ISQALWHV

SEQ ID NO: 8662 - protein, 8 aa, BK virus
SQALWHVI

SEQ ID NO: 8663 - protein, 8 aa, BK virus
QALWHVIR

SEQ ID NO: 8664 - protein, 8 aa, BK virus
ALWHVIRD

SEQ ID NO: 8665 - protein, 8 aa, BK virus
LWHVIRDD

SEQ ID NO: 8666 - protein, 8 aa, BK virus
WHVIRDDI

SEQ ID NO: 8667 - protein, 8 aa, BK virus
HVIRDDIP

SEQ ID NO: 8668 - protein, 8 aa, BK virus
VIRDDIPS

SEQ ID NO: 8669 - protein, 8 aa, BK virus
IRDDIPSI

SEQ ID NO: 8670 - protein, 8 aa, BK virus
RDDIPSIT

SEQ ID NO: 8671 - protein, 8 aa, BK virus
DDIPSITS

SEQ ID NO: 8672 - protein, 8 aa, BK virus
DIPSITSQ

SEQ ID NO: 8673 - protein, 8 aa, BK virus
IPSITSQE

SEQ ID NO: 8674 - protein, 8 aa, BK virus
PSITSQEL

SEQ ID NO: 8675 - protein, 8 aa, BK virus
SITSQELQ

SEQ ID NO: 8676 - protein, 8 aa, BK virus
ITSQELQR

SEQ ID NO: 8677 - protein, 8 aa, BK virus
TSQELQRR

SEQ ID NO: 8678 - protein, 8 aa, BK virus
SQELQRRT

SEQ ID NO: 8679 - protein, 8 aa, BK virus
QELQRRTE

SEQ ID NO: 8680 - protein, 8 aa, BK virus
ELQRRTER

SEQ ID NO: 8681 - protein, 8 aa, BK virus
LQRRTERF

SEQ ID NO: 8682 - protein, 8 aa, BK virus
QRRTERFF

SEQ ID NO: 8683 - protein, 8 aa, BK virus
RRTERFFR

SEQ ID NO: 8684 - protein, 8 aa, BK virus
RTERFFRD

SEQ ID NO: 8685 - protein, 8 aa, BK virus
TERFFRDS

SEQ ID NO: 8686 - protein, 8 aa, BK virus
ERFFRDSL

SEQ ID NO: 8687 - protein, 8 aa, BK virus
RFFRDSLA

SEQ ID NO: 8688 - protein, 8 aa, BK virus
FFRDSLAR

SEQ ID NO: 8689 - protein, 8 aa, BK virus
FRDSLARF

SEQ ID NO: 8690 - protein, 8 aa, BK virus
RDSLARFL

SEQ ID NO: 8691 - protein, 8 aa, BK virus
DSLARFLE

SEQ ID NO: 8692 - protein, 8 aa, BK virus
SLARFLEE

SEQ ID NO: 8693 - protein, 8 aa, BK virus
LARFLEET

SEQ ID NO: 8694 - protein, 8 aa, BK virus
ARFLEETT

SEQ ID NO: 8695 - protein, 8 aa, BK virus
RFLEETTW

SEQ ID NO: 8696 - protein, 8 aa, BK virus
FLEETTWT

SEQ ID NO: 8697 - protein, 8 aa, BK virus
LEETTWTI

SEQ ID NO: 8698 - protein, 8 aa, BK virus
EETTWTIV

SEQ ID NO: 8699 - protein, 8 aa, BK virus
ETTWTIVN

SEQ ID NO: 8700 - protein, 8 aa, BK virus
TTWTIVNA

SEQ ID NO: 8701 - protein, 8 aa, BK virus
TWTIVNAP

SEQ ID NO: 8702 - protein, 8 aa, BK virus
WTIVNAPI

SEQ ID NO: 8703 - protein, 8 aa, BK virus
TIVNAPIN

SEQ ID NO: 8704 - protein, 8 aa, BK virus
IVNAPINF

SEQ ID NO: 8705 - protein, 8 aa, BK virus
VNAPINFY

SEQ ID NO: 8706 - protein, 8 aa, BK virus
NAPINFYN

SEQ ID NO: 8707 - protein, 8 aa, BK virus
APINFYNY

SEQ ID NO: 8708 - protein, 8 aa, BK virus
PINFYNYI

SEQ ID NO: 8709 - protein, 8 aa, BK virus
INFYNYIQ

SEQ ID NO: 8710 - protein, 8 aa, BK virus
NFYNYIQQ

SEQ ID NO: 8711 - protein, 8 aa, BK virus
FYNYIQQY

SEQ ID NO: 8712 - protein, 8 aa, BK virus
YNYIQQYY

SEQ ID NO: 8713 - protein, 8 aa, BK virus
NYIQQYYS

SEQ ID NO: 8714 - protein, 8 aa, BK virus
YIQQYYSD

SEQ ID NO: 8715 - protein, 8 aa, BK virus
IQQYYSDL

SEQ ID NO: 8716 - protein, 8 aa, BK virus
QQYYSDLS

SEQ ID NO: 8717 - protein, 8 aa, BK virus
QYYSDLSP

SEQ ID NO: 8718 - protein, 8 aa, BK virus
YYSDLSPI

SEQ ID NO: 8719 - protein, 8 aa, BK virus
YSDLSPIR

SEQ ID NO: 8720 - protein, 8 aa, BK virus
SDLSPIRP

SEQ ID NO: 8721 - protein, 8 aa, BK virus
DLSPIRPS

SEQ ID NO: 8722 - protein, 8 aa, BK virus
LSPIRPSM

SEQ ID NO: 8723 - protein, 8 aa, BK virus
SPIRPSMV

SEQ ID NO: 8724 - protein, 8 aa, BK virus
PIRPSMVR

SEQ ID NO: 8725 - protein, 8 aa, BK virus
IRPSMVRQ

SEQ ID NO: 8726 - protein, 8 aa, BK virus
RPSMVRQV

SEQ ID NO: 8727 - protein, 8 aa, BK virus
PSMVRQVA

SEQ ID NO: 8728 - protein, 8 aa, BK virus
SMVRQVAE

SEQ ID NO: 8729 - protein, 8 aa, BK virus
MVRQVAER

SEQ ID NO: 8730 - protein, 8 aa, BK virus
VRQVAERE

SEQ ID NO: 8731 - protein, 8 aa, BK virus
RQVAEREG

SEQ ID NO: 8732 - protein, 8 aa, BK virus
QVAEREGT

SEQ ID NO: 8733 - protein, 8 aa, BK virus
VAEREGTR

SEQ ID NO: 8734 - protein, 8 aa, BK virus
AEREGTRV

SEQ ID NO: 8735 - protein, 8 aa, BK virus
EREGTRVH

SEQ ID NO: 8736 - protein, 8 aa, BK virus
REGTRVHF

SEQ ID NO: 8737 - protein, 8 aa, BK virus
EGTRVHFG

SEQ ID NO: 8738 - protein, 8 aa, BK virus
GTRVHFGH

SEQ ID NO: 8739 - protein, 8 aa, BK virus
TRVHFGHT

SEQ ID NO: 8740 - protein, 8 aa, BK virus
RVHFGHTY

SEQ ID NO: 8741 - protein, 8 aa, BK virus
VHFGHTYS

SEQ ID NO: 8742 - protein, 8 aa, BK virus
HFGHTYSI

SEQ ID NO: 8743 - protein, 8 aa, BK virus
FGHTYSID

SEQ ID NO: 8744 - protein, 8 aa, BK virus
GHTYSIDD

SEQ ID NO: 8745 - protein, 8 aa, BK virus
HTYSIDDA

SEQ ID NO: 8746 - protein, 8 aa, BK virus
TYSIDDAD

SEQ ID NO: 8747 - protein, 8 aa, BK virus
YSIDDADS

SEQ ID NO: 8748 - protein, 8 aa, BK virus
SIDDADSI

SEQ ID NO: 8749 - protein, 8 aa, BK virus
IDDADSIE

SEQ ID NO: 8750 - protein, 8 aa, BK virus
DDADSIEE

SEQ ID NO: 8751 - protein, 8 aa, BK virus
DADSIEEV

SEQ ID NO: 8752 - protein, 8 aa, BK virus
ADSIEEVT

SEQ ID NO: 8753 - protein, 8 aa, BK virus
DSIEEVTQ

SEQ ID NO: 8754 - protein, 8 aa, BK virus
SIEEVTQR

SEQ ID NO: 8755 - protein, 8 aa, BK virus
IEEVTQRM

SEQ ID NO: 8756 - protein, 8 aa, BK virus
EEVTQRMD

SEQ ID NO: 8757 - protein, 8 aa, BK virus
EVTQRMDL

SEQ ID NO: 8758 - protein, 8 aa, BK virus
VTQRMDLR

SEQ ID NO: 8759 - protein, 8 aa, BK virus
TQRMDLRN

SEQ ID NO: 8760 - protein, 8 aa, BK virus
QRMDLRNQ

SEQ ID NO: 8761 - protein, 8 aa, BK virus
RMDLRNQQ

SEQ ID NO: 8762 - protein, 8 aa, BK virus
MDLRNQQS

SEQ ID NO: 8763 - protein, 8 aa, BK virus
DLRNQQSV

SEQ ID NO: 8764 - protein, 8 aa, BK virus
LRNQQSVH

SEQ ID NO: 8765 - protein, 8 aa, BK virus
RNQQSVHS

SEQ ID NO: 8766 - protein, 8 aa, BK virus
NQQSVHSG

SEQ ID NO: 8767 - protein, 8 aa, BK virus
QQSVHSGE

SEQ ID NO: 8768 - protein, 8 aa, BK virus
QSVHSGEF

SEQ ID NO: 8769 - protein, 8 aa, BK virus
SVHSGEFI

SEQ ID NO: 8770 - protein, 8 aa, BK virus
VHSGEFIE

SEQ ID NO: 8771 - protein, 8 aa, BK virus
HSGEFIEK

SEQ ID NO: 8772 - protein, 8 aa, BK virus
SGEFIEKT

SEQ ID NO: 8773 - protein, 8 aa, BK virus
GEFIEKTI

SEQ ID NO: 8774 - protein, 8 aa, BK virus
EFIEKTIA

SEQ ID NO: 8775 - protein, 8 aa, BK virus
FIEKTIAP

SEQ ID NO: 8776 - protein, 8 aa, BK virus
IEKTIAPG

SEQ ID NO: 8777 - protein, 8 aa, BK virus
EKTIAPGG

SEQ ID NO: 8778 - protein, 8 aa, BK virus
KTIAPGGA

SEQ ID NO: 8779 - protein, 8 aa, BK virus
TIAPGGAN

SEQ ID NO: 8780 - protein, 8 aa, BK virus
IAPGGANQ

SEQ ID NO: 8781 - protein, 8 aa, BK virus
APGGANQR

SEQ ID NO: 8782 - protein, 8 aa, BK virus
PGGANQRT

SEQ ID NO: 8783 - protein, 8 aa, BK virus
GGANQRTA

SEQ ID NO: 8784 - protein, 8 aa, BK virus
GANQRTAP

SEQ ID NO: 8785 - protein, 8 aa, BK virus
ANQRTAPQ

SEQ ID NO: 8786 - protein, 8 aa, BK virus
NQRTAPQW

SEQ ID NO: 8787 - protein, 8 aa, BK virus
QRTAPQWM

SEQ ID NO: 8788 - protein, 8 aa, BK virus
RTAPQWML

SEQ ID NO: 8789 - protein, 8 aa, BK virus
TAPQWMLP

SEQ ID NO: 8790 - protein, 8 aa, BK virus
APQWMLPL

SEQ ID NO: 8791 - protein, 8 aa, BK virus
PQWMLPLL

SEQ ID NO: 8792 - protein, 8 aa, BK virus
QWMLPLLL

SEQ ID NO: 8793 - protein, 8 aa, BK virus
WMLPLLLG

SEQ ID NO: 8794 - protein, 8 aa, BK virus
MLPLLLGL

SEQ ID NO: 8795 - protein, 8 aa, BK virus
LPLLLGLY

SEQ ID NO: 8796 - protein, 8 aa, BK virus
PLLLGLYG

SEQ ID NO: 8797 - protein, 8 aa, BK virus
LLLGLYGT

SEQ ID NO: 8798 - protein, 8 aa, BK virus
LLGLYGTV

SEQ ID NO: 8799 - protein, 8 aa, BK virus
LGLYGTVT

SEQ ID NO: 8800 - protein, 8 aa, BK virus
GLYGTVTP

SEQ ID NO: 8801 - protein, 8 aa, BK virus
LYGTVTPA

SEQ ID NO: 8802 - protein, 8 aa, BK virus
YGTVTPAL

SEQ ID NO: 8803 - protein, 8 aa, BK virus
GTVTPALE

SEQ ID NO: 8804 - protein, 8 aa, BK virus
TVTPALEA

SEQ ID NO: 8805 - protein, 8 aa, BK virus
VTPALEAY

SEQ ID NO: 8806 - protein, 8 aa, BK virus
TPALEAYE

SEQ ID NO: 8807 - protein, 8 aa, BK virus
PALEAYED

SEQ ID NO: 8808 - protein, 8 aa, BK virus
ALEAYEDG

SEQ ID NO: 8809 - protein, 8 aa, BK virus
LEAYEDGP

SEQ ID NO: 8810 - protein, 8 aa, BK virus
EAYEDGPN

SEQ ID NO: 8811 - protein, 8 aa, BK virus
AYEDGPNQ

SEQ ID NO: 8812 - protein, 8 aa, BK virus
YEDGPNQK

SEQ ID NO: 8813 - protein, 8 aa, BK virus
EDGPNQKK

SEQ ID NO: 8814 - protein, 8 aa, BK virus
DGPNQKKR

SEQ ID NO: 8815 - protein, 8 aa, BK virus
GPNQKKRR

SEQ ID NO: 8816 - protein, 8 aa, BK virus
PNQKKRRV

SEQ ID NO: 8817 - protein, 8 aa, BK virus
NQKKRRVS

SEQ ID NO: 8818 - protein, 8 aa, BK virus
QKKRRVSR

SEQ ID NO: 8819 - protein, 8 aa, BK virus
KKRRVSRG

SEQ ID NO: 8820 - protein, 8 aa, BK virus
KRRVSRGS

SEQ ID NO: 8821 - protein, 8 aa, BK virus
RRVSRGSS

SEQ ID NO: 8822 - protein, 8 aa, BK virus
RVSRGSSQ

SEQ ID NO: 8823 - protein, 8 aa, BK virus
VSRGSSQK

SEQ ID NO: 8824 - protein, 8 aa, BK virus
SRGSSQKA

SEQ ID NO: 8825 - protein, 8 aa, BK virus
RGSSQKAK

SEQ ID NO: 8826 - protein, 8 aa, BK virus
GSSQKAKG

SEQ ID NO: 8827 - protein, 8 aa, BK virus
SSQKAKGT

SEQ ID NO: 8828 - protein, 8 aa, BK virus
SQKAKGTR

SEQ ID NO: 8829 - protein, 8 aa, BK virus
QKAKGTRA

SEQ ID NO: 8830 - protein, 8 aa, BK virus
KAKGTRAS

SEQ ID NO: 8831 - protein, 8 aa, BK virus
AKGTRASA

SEQ ID NO: 8832 - protein, 8 aa, BK virus
KGTRASAK

SEQ ID NO: 8833 - protein, 8 aa, BK virus
GTRASAKT

SEQ ID NO: 8834 - protein, 8 aa, BK virus
TRASAKTT

SEQ ID NO: 8835 - protein, 8 aa, BK virus
RASAKTTN

SEQ ID NO: 8836 - protein, 8 aa, BK virus
ASAKTTNK

SEQ ID NO: 8837 - protein, 8 aa, BK virus
SAKTTNKR

SEQ ID NO: 8838 - protein, 8 aa, BK virus
AKTTNKRR

SEQ ID NO: 8839 - protein, 8 aa, BK virus
KTTNKRRS

SEQ ID NO: 8840 - protein, 8 aa, BK virus
TTNKRRSR

SEQ ID NO: 8841 - protein, 8 aa, BK virus
TNKRRSRS

SEQ ID NO: 8842 - protein, 8 aa, BK virus
NKRRSRSS

SEQ ID NO: 8843 - protein, 8 aa, BK virus
KRRSRSSR

SEQ ID NO: 8844 - protein, 8 aa, BK virus
RRSRSSRS

SEQ ID NO: 8845 - protein, 8 aa, BK virus
NWGRCYYR

SEQ ID NO: 8846 - protein, 8 aa, BK virus
WGRCYYRG

SEQ ID NO: 8847 - protein, 8 aa, BK virus
GRCYYRGR

SEQ ID NO: 8848 - protein, 8 aa, BK virus
RCYYRGRM

SEQ ID NO: 8849 - protein, 8 aa, BK virus
CYYRGRML

SEQ ID NO: 8850 - protein, 8 aa, BK virus
YYRGRMLP

SEQ ID NO: 8851 - protein, 8 aa, BK virus
YRGRMLPK

SEQ ID NO: 8852 - protein, 8 aa, BK virus
RGRMLPKP

SEQ ID NO: 8853 - protein, 8 aa, BK virus
GRMLPKPR

SEQ ID NO: 8854 - protein, 8 aa, BK virus
RMLPKPRN

SEQ ID NO: 8855 - protein, 8 aa, BK virus
MLPKPRNG

SEQ ID NO: 8856 - protein, 8 aa, BK virus
LPKPRNGG

SEQ ID NO: 8857 - protein, 8 aa, BK virus
PKPRNGGS

SEQ ID NO: 8858 - protein, 8 aa, BK virus
KPRNGGSR

SEQ ID NO: 8859 - protein, 8 aa, BK virus
PREKNASL

SEQ ID NO: 8860 - protein, 8 aa, BK virus
REKNASLL

SEQ ID NO: 8861 - protein, 8 aa, BK virus
EKNASLLQ

SEQ ID NO: 8862 - protein, 8 aa, BK virus
KNASLLQH

SEQ ID NO: 8863 - protein, 8 aa, BK virus
NASLLQHS

SEQ ID NO: 8864 - protein, 8 aa, BK virus
ASLLQHSK

SEQ ID NO: 8865 - protein, 8 aa, BK virus
SLLQHSKN

SEQ ID NO: 8866 - protein, 8 aa, BK virus
LLQHSKNS

SEQ ID NO: 8867 - protein, 8 aa, BK virus
LQHSKNSP

SEQ ID NO: 8868 - protein, 8 aa, BK virus
QHSKNSPP

SEQ ID NO: 8869 - protein, 8 aa, BK virus
HSKNSPPQ

SEQ ID NO: 8870 - protein, 8 aa, BK virus
SKNSPPQF

SEQ ID NO: 8871 - protein, 8 aa, BK virus
KNSPPQFK

SEQ ID NO: 8872 - protein, 8 aa, BK virus
GPNLWKST

SEQ ID NO: 8873 - protein, 8 aa, BK virus
PNLWKSTD

SEQ ID NO: 8874 - protein, 8 aa, BK virus
NLWKSTDV

SEQ ID NO: 8875 - protein, 8 aa, BK virus
LWKSTDVG

SEQ ID NO: 8876 - protein, 8 aa, BK virus
WKSTDVGG

SEQ ID NO: 8877 - protein, 8 aa, BK virus
KSTDVGGC

SEQ ID NO: 8878 - protein, 8 aa, BK virus
STDVGGCN

SEQ ID NO: 8879 - protein, 8 aa, BK virus
TDVGGCNC

SEQ ID NO: 8880 - protein, 8 aa, BK virus
DVGGCNCT

SEQ ID NO: 8881 - protein, 8 aa, BK virus
VGGCNCTN

SEQ ID NO: 8882 - protein, 8 aa, BK virus
GGCNCTNR

SEQ ID NO: 8883 - protein, 8 aa, BK virus
GCNCTNRG

SEQ ID NO: 8884 - protein, 8 aa, BK virus
CNCTNRGY

SEQ ID NO: 8885 - protein, 8 aa, BK virus
NCTNRGYW

SEQ ID NO: 8886 - protein, 8 aa, BK virus
CTNRGYWN

SEQ ID NO: 8887 - protein, 8 aa, BK virus
TNRGYWNN

SEQ ID NO: 8888 - protein, 8 aa, BK virus
PSCRVTKS

SEQ ID NO: 8889 - protein, 8 aa, BK virus
SCRVTKSA

SEQ ID NO: 8890 - protein, 8 aa, BK virus
AWWRKTYS

SEQ ID NO: 8891 - protein, 8 aa, BK virus
WWRKTYSR

SEQ ID NO: 8892 - protein, 8 aa, BK virus
WRKTYSRQ

SEQ ID NO: 8893 - protein, 8 aa, BK virus
FPLLCCRW

SEQ ID NO: 8894 - protein, 8 aa, BK virus
PLLCCRWR

SEQ ID NO: 8895 - protein, 8 aa, BK virus
LLCCRWRT

SEQ ID NO: 8896 - protein, 8 aa, BK virus
LCCRWRTL

SEQ ID NO: 8897 - protein, 8 aa, BK virus
CCRWRTLG

SEQ ID NO: 8898 - protein, 8 aa, BK virus
CRWRTLGN

SEQ ID NO: 8899 - protein, 8 aa, BK virus
RWRTLGNA

SEQ ID NO: 8900 - protein, 8 aa, BK virus
WRTLGNAG

SEQ ID NO: 8901 - protein, 8 aa, BK virus
RTLGNAGS

SEQ ID NO: 8902 - protein, 8 aa, BK virus
TLGNAGSA

SEQ ID NO: 8903 - protein, 8 aa, BK virus
LGNAGSAN

SEQ ID NO: 8904 - protein, 8 aa, BK virus
GNAGSANE

SEQ ID NO: 8905 - protein, 8 aa, BK virus
NAGSANEL

SEQ ID NO: 8906 - protein, 8 aa, BK virus
AGSANELQ

SEQ ID NO: 8907 - protein, 8 aa, BK virus
GSANELQV

SEQ ID NO: 8908 - protein, 8 aa, BK virus
SANELQVK

SEQ ID NO: 8909 - protein, 8 aa, BK virus
ANELQVKV

SEQ ID NO: 8910 - protein, 8 aa, BK virus
NELQVKVP

SEQ ID NO: 8911 - protein, 8 aa, BK virus
KPNSPVPG

SEQ ID NO: 8912 - protein, 8 aa, BK virus
PNSPVPGN

SEQ ID NO: 8913 - protein, 8 aa, BK virus
NSPVPGNE

SEQ ID NO: 8914 - protein, 8 aa, BK virus
SPVPGNEY

SEQ ID NO: 8915 - protein, 8 aa, BK virus
GLFGQKQC

SEQ ID NO: 8916 - protein, 8 aa, BK virus
LFGQKQCL

SEQ ID NO: 8917 - protein, 8 aa, BK virus
FGQKQCLS

SEQ ID NO: 8918 - protein, 8 aa, BK virus
GQKQCLSS

SEQ ID NO: 8919 - protein, 8 aa, BK virus
VFWDFHRR

SEQ ID NO: 8920 - protein, 8 aa, BK virus
FWDFHRRG

SEQ ID NO: 8921 - protein, 8 aa, BK virus
WDFHRRGK

SEQ ID NO: 8922 - protein, 8 aa, BK virus
DFHRRGKC

SEQ ID NO: 8923 - protein, 8 aa, BK virus
FHRRGKCS

SEQ ID NO: 8924 - protein, 8 aa, BK virus
HRRGKCSP

SEQ ID NO: 8925 - protein, 8 aa, BK virus
RRGKCSPS

SEQ ID NO: 8926 - protein, 8 aa, BK virus
RGKCSPST

SEQ ID NO: 8927 - protein, 8 aa, BK virus
GKCSPSTS

SEQ ID NO: 8928 - protein, 8 aa, BK virus
KCSPSTSC

SEQ ID NO: 8929 - protein, 8 aa, BK virus
CSPSTSCD

SEQ ID NO: 8930 - protein, 8 aa, BK virus
SPSTSCDQ

SEQ ID NO: 8931 - protein, 8 aa, BK virus
PSTSCDQH

SEQ ID NO: 8932 - protein, 8 aa, BK virus
STSCDQHS

SEQ ID NO: 8933 - protein, 8 aa, BK virus
TSCDQHSY

SEQ ID NO: 8934 - protein, 8 aa, BK virus
SCDQHSYH

SEQ ID NO: 8935 - protein, 8 aa, BK virus
CDQHSYHS

SEQ ID NO: 8936 - protein, 8 aa, BK virus
DQHSYHSV

SEQ ID NO: 8937 - protein, 8 aa, BK virus
QHSYHSVA

SEQ ID NO: 8938 - protein, 8 aa, BK virus
HSYHSVAR

SEQ ID NO: 8939 - protein, 8 aa, BK virus
QLWNTTVE

SEQ ID NO: 8940 - protein, 8 aa, BK virus
LWNTTVER

SEQ ID NO: 8941 - protein, 8 aa, BK virus
WNTTVERP

SEQ ID NO: 8942 - protein, 8 aa, BK virus
NTTVERPC

SEQ ID NO: 8943 - protein, 8 aa, BK virus
TTVERPCK

SEQ ID NO: 8944 - protein, 8 aa, BK virus
TVERPCKI

SEQ ID NO: 8945 - protein, 8 aa, BK virus
VERPCKIF

SEQ ID NO: 8946 - protein, 8 aa, BK virus
DPPEKKIC

SEQ ID NO: 8947 - protein, 8 aa, BK virus
PPEKKICK

SEQ ID NO: 8948 - protein, 8 aa, BK virus
PEKKICKE

SEQ ID NO: 8949 - protein, 8 aa, BK virus
EKKICKES

SEQ ID NO: 8950 - protein, 8 aa, BK virus
KKICKESL

SEQ ID NO: 8951 - protein, 8 aa, BK virus
KICKESLP

SEQ ID NO: 8952 - protein, 8 aa, BK virus
ICKESLPN

SEQ ID NO: 8953 - protein, 8 aa, BK virus
CKESLPNF

SEQ ID NO: 8954 - protein, 8 aa, BK virus
KESLPNFL

SEQ ID NO: 8955 - protein, 8 aa, BK virus
ESLPNFLF

SEQ ID NO: 8956 - protein, 8 aa, BK virus
SLPNFLFA

SEQ ID NO: 8957 - protein, 8 aa, BK virus
LPNFLFAK

SEQ ID NO: 8958 - protein, 8 aa, BK virus
PYKQENPE

SEQ ID NO: 8959 - protein, 8 aa, BK virus
YKQENPES

SEQ ID NO: 8960 - protein, 8 aa, BK virus
KQENPESG

SEQ ID NO: 8961 - protein, 8 aa, BK virus
QENPESGW

SEQ ID NO: 8962 - protein, 8 aa, BK virus
ENPESGWA

SEQ ID NO: 8963 - protein, 8 aa, BK virus
NPESGWAA

SEQ ID NO: 8964 - protein, 8 aa, BK virus
PESGWAAY

SEQ ID NO: 8965 - protein, 8 aa, BK virus
ESGWAAYV

SEQ ID NO: 8966 - protein, 8 aa, BK virus
SGWAAYVW

SEQ ID NO: 8967 - protein, 8 aa, BK virus
GWAAYVWY

SEQ ID NO: 8968 - protein, 8 aa, BK virus
WAAYVWYG

SEQ ID NO: 8969 - protein, 8 aa, BK virus
AAYVWYGI

SEQ ID NO: 8970 - protein, 8 aa, BK virus
AYVWYGIP

SEQ ID NO: 8971 - protein, 8 aa, BK virus
YVWYGIPG

SEQ ID NO: 8972 - protein, 8 aa, BK virus
VWYGIPGR

SEQ ID NO: 8973 - protein, 8 aa, BK virus
WYGIPGRR

SEQ ID NO: 8974 - protein, 8 aa, BK virus
YGIPGRRG

SEQ ID NO: 8975 - protein, 8 aa, BK virus
WHRKTSRG

SEQ ID NO: 8976 - protein, 8 aa, BK virus
HRKTSRGP

SEQ ID NO: 8977 - protein, 8 aa, BK virus
RKTSRGPR

SEQ ID NO: 8978 - protein, 8 aa, BK virus
KTSRGPRY

SEQ ID NO: 8979 - protein, 8 aa, BK virus
TSRGPRYD

SEQ ID NO: 8980 - protein, 8 aa, BK virus
SRGPRYDK

SEQ ID NO: 8981 - protein, 8 aa, BK virus
RGPRYDKI

SEQ ID NO: 8982 - protein, 8 aa, BK virus
GPRYDKIY

SEQ ID NO: 8983 - protein, 8 aa, BK virus
QTGTIANQ

SEQ ID NO: 8984 - protein, 8 aa, BK virus
TGTIANQN

SEQ ID NO: 8985 - protein, 8 aa, BK virus
GTIANQNA

SEQ ID NO: 8986 - protein, 8 aa, BK virus
TIANQNAL

SEQ ID NO: 8987 - protein, 8 aa, BK virus
IANQNALN

SEQ ID NO: 8988 - protein, 8 aa, BK virus
ANQNALNR

SEQ ID NO: 8989 - protein, 8 aa, BK virus
NQNALNRC

SEQ ID NO: 8990 - protein, 8 aa, BK virus
QNALNRCF

SEQ ID NO: 8991 - protein, 8 aa, BK virus
NALNRCFY

SEQ ID NO: 8992 - protein, 8 aa, BK virus
ALNRCFYC

SEQ ID NO: 8993 - protein, 8 aa, BK virus
LNRCFYCT

SEQ ID NO: 8994 - protein, 8 aa, BK virus
NRCFYCTY

SEQ ID NO: 8995 - protein, 8 aa, BK virus
RCFYCTYT

SEQ ID NO: 8996 - protein, 8 aa, BK virus
CFYCTYTF

SEQ ID NO: 8997 - protein, 8 aa, BK virus
FYCTYTFN

SEQ ID NO: 8998 - protein, 8 aa, BK virus
YCTYTFNK

SEQ ID NO: 8999 - protein, 8 aa, BK virus
CTYTFNKC

SEQ ID NO: 9000 - protein, 8 aa, BK virus
TYTFNKCC

SEQ ID NO: 9001 - protein, 8 aa, BK virus
YTFNKCCF

SEQ ID NO: 9002 - protein, 8 aa, BK virus
TFNKCCFC

SEQ ID NO: 9003 - protein, 8 aa, BK virus
FNKCCFCI

SEQ ID NO: 9004 - protein, 8 aa, BK virus
NKCCFCIS

SEQ ID NO: 9005 - protein, 8 aa, BK virus
KCCFCISH

SEQ ID NO: 9006 - protein, 8 aa, BK virus
CCFCISHF

SEQ ID NO: 9007 - protein, 8 aa, BK virus
ACVILGVV

SEQ ID NO: 9008 - protein, 8 aa, BK virus
CVILGVVF

SEQ ID NO: 9009 - protein, 8 aa, BK virus
NTESLYTN

SEQ ID NO: 9010 - protein, 8 aa, BK virus
TESLYTNA

SEQ ID NO: 9011 - protein, 8 aa, BK virus
ESLYTNAT

SEQ ID NO: 9012 - protein, 8 aa, BK virus
SLYTNATL

SEQ ID NO: 9013 - protein, 8 aa, BK virus
LYTNATLD

SEQ ID NO: 9014 - protein, 8 aa, BK virus
YTNATLDY

SEQ ID NO: 9015 - protein, 8 aa, BK virus
TNATLDYG

SEQ ID NO: 9016 - protein, 8 aa, BK virus
NATLDYGG

SEQ ID NO: 9017 - protein, 8 aa, BK virus
ATLDYGGL

SEQ ID NO: 9018 - protein, 8 aa, BK virus
TLDYGGLT

SEQ ID NO: 9019 - protein, 8 aa, BK virus
LDYGGLTF

SEQ ID NO: 9020 - protein, 8 aa, BK virus
DYGGLTFG

SEQ ID NO: 9021 - protein, 8 aa, BK virus
YGGLTFGN

SEQ ID NO: 9022 - protein, 8 aa, BK virus
GGLTFGNL

SEQ ID NO: 9023 - protein, 8 aa, BK virus
GLTFGNLQ

SEQ ID NO: 9024 - protein, 8 aa, BK virus
LTFGNLQQ

SEQ ID NO: 9025 - protein, 8 aa, BK virus
TFGNLQQG

SEQ ID NO: 9026 - protein, 8 aa, BK virus
FGNLQQGL

SEQ ID NO: 9027 - protein, 8 aa, BK virus
GNLQQGLK

SEQ ID NO: 9028 - protein, 8 aa, BK virus
NLQQGLKY

SEQ ID NO: 9029 - protein, 8 aa, BK virus
LQQGLKYL

SEQ ID NO: 9030 - protein, 8 aa, BK virus
QQGLKYLR

SEQ ID NO: 9031 - protein, 8 aa, BK virus
QGLKYLRL

SEQ ID NO: 9032 - protein, 8 aa, BK virus
GLKYLRLG

SEQ ID NO: 9033 - protein, 8 aa, BK virus
LKYLRLGK

SEQ ID NO: 9034 - protein, 8 aa, BK virus
KYLRLGKS

SEQ ID NO: 9035 - protein, 8 aa, BK virus
YLRLGKSI

SEQ ID NO: 9036 - protein, 8 aa, BK virus
LRLGKSIV

SEQ ID NO: 9037 - protein, 8 aa, BK virus
RLGKSIVI

SEQ ID NO: 9038 - protein, 8 aa, BK virus
LGKSIVIG

SEQ ID NO: 9039 - protein, 8 aa, BK virus
GKSIVIGI

SEQ ID NO: 9040 - protein, 8 aa, BK virus
KSIVIGIQ

SEQ ID NO: 9041 - protein, 8 aa, BK virus
SIVIGIQC

SEQ ID NO: 9042 - protein, 8 aa, BK virus
IVIGIQCL

SEQ ID NO: 9043 - protein, 8 aa, BK virus
VIGIQCLI

SEQ ID NO: 9044 - protein, 8 aa, BK virus
IGIQCLIH

SEQ ID NO: 9045 - protein, 8 aa, BK virus
GIQCLIHV

SEQ ID NO: 9046 - protein, 8 aa, BK virus
IQCLIHVQ

SEQ ID NO: 9047 - protein, 8 aa, BK virus
QCLIHVQS

SEQ ID NO: 9048 - protein, 8 aa, BK virus
CLIHVQSL

SEQ ID NO: 9049 - protein, 8 aa, BK virus
LIHVQSLQ

SEQ ID NO: 9050 - protein, 8 aa, BK virus
IHVQSLQF

SEQ ID NO: 9051 - protein, 8 aa, BK virus
HVQSLQFL

SEQ ID NO: 9052 - protein, 8 aa, BK virus
VQSLQFLN

SEQ ID NO: 9053 - protein, 8 aa, BK virus
QSLQFLNP

SEQ ID NO: 9054 - protein, 8 aa, BK virus
SLQFLNPL

SEQ ID NO: 9055 - protein, 8 aa, BK virus
LQFLNPLL

SEQ ID NO: 9056 - protein, 8 aa, BK virus
QFLNPLLL

SEQ ID NO: 9057 - protein, 8 aa, BK virus
YQEYISPC

SEQ ID NO: 9058 - protein, 8 aa, BK virus
QEYISPCI

SEQ ID NO: 9059 - protein, 8 aa, BK virus
EYISPCIY

SEQ ID NO: 9060 - protein, 8 aa, BK virus
YISPCIYY

SEQ ID NO: 9061 - protein, 8 aa, BK virus
ISPCIYYI

SEQ ID NO: 9062 - protein, 8 aa, BK virus
SPCIYYIS

SEQ ID NO: 9063 - protein, 8 aa, BK virus
PCIYYISS

SEQ ID NO: 9064 - protein, 8 aa, BK virus
CIYYISSL

SEQ ID NO: 9065 - protein, 8 aa, BK virus
IYYISSLK

SEQ ID NO: 9066 - protein, 8 aa, BK virus
YYISSLKK

SEQ ID NO: 9067 - protein, 8 aa, BK virus
YISSLKKY

SEQ ID NO: 9068 - protein, 8 aa, BK virus
ISSLKKYT

SEQ ID NO: 9069 - protein, 8 aa, BK virus
SSLKKYTY

SEQ ID NO: 9070 - protein, 8 aa, BK virus
SLKKYTYL

SEQ ID NO: 9071 - protein, 8 aa, BK virus
LKKYTYLS

SEQ ID NO: 9072 - protein, 8 aa, BK virus
KKYTYLSQ

SEQ ID NO: 9073 - protein, 8 aa, BK virus
KYTYLSQN

SEQ ID NO: 9074 - protein, 8 aa, BK virus
YTYLSQNP

SEQ ID NO: 9075 - protein, 8 aa, BK virus
TYLSQNPA

SEQ ID NO: 9076 - protein, 8 aa, BK virus
YLSQNPAF

SEQ ID NO: 9077 - protein, 8 aa, BK virus
LSQNPAFP

SEQ ID NO: 9078 - protein, 8 aa, BK virus
SQNPAFPS

SEQ ID NO: 9079 - protein, 8 aa, BK virus
QNPAFPSI

SEQ ID NO: 9080 - protein, 8 aa, BK virus
NPAFPSIQ

SEQ ID NO: 9081 - protein, 8 aa, BK virus
PAFPSIQQ

SEQ ID NO: 9082 - protein, 8 aa, BK virus
AFPSIQQF

SEQ ID NO: 9083 - protein, 8 aa, BK virus
IVYQLQNQ

SEQ ID NO: 9084 - protein, 8 aa, BK virus
VYQLQNQL

SEQ ID NO: 9085 - protein, 8 aa, BK virus
YQLQNQLQ

SEQ ID NO: 9086 - protein, 8 aa, BK virus
QLQNQLQA

SEQ ID NO: 9087 - protein, 8 aa, BK virus
TKLAVATR

SEQ ID NO: 9088 - protein, 8 aa, BK virus
KLAVATRS

SEQ ID NO: 9089 - protein, 8 aa, BK virus
LAVATRSF

SEQ ID NO: 9090 - protein, 8 aa, BK virus
AVATRSFH

SEQ ID NO: 9091 - protein, 8 aa, BK virus
VATRSFHF

SEQ ID NO: 9092 - protein, 8 aa, BK virus
ATRSFHFV

SEQ ID NO: 9093 - protein, 8 aa, BK virus
TRSFHFVK

SEQ ID NO: 9094 - protein, 8 aa, BK virus
RSFHFVKF

SEQ ID NO: 9095 - protein, 8 aa, BK virus
SFHFVKFF

SEQ ID NO: 9096 - protein, 8 aa, BK virus
FHFVKFFF

SEQ ID NO: 9097 - protein, 8 aa, BK virus
HFVKFFFQ

SEQ ID NO: 9098 - protein, 8 aa, BK virus
FVKFFFQV

SEQ ID NO: 9099 - protein, 8 aa, BK virus
VKFFFQVR

SEQ ID NO: 9100 - protein, 8 aa, BK virus
KFFFQVRT

SEQ ID NO: 9101 - protein, 8 aa, BK virus
FFFQVRTL

SEQ ID NO: 9102 - protein, 8 aa, BK virus
FFQVRTLS

SEQ ID NO: 9103 - protein, 8 aa, BK virus
FQVRTLSF

SEQ ID NO: 9104 - protein, 8 aa, BK virus
QVRTLSFV

SEQ ID NO: 9105 - protein, 8 aa, BK virus
VRTLSFVR

SEQ ID NO: 9106 - protein, 8 aa, BK virus
RTLSFVRI

SEQ ID NO: 9107 - protein, 8 aa, BK virus
TLSFVRIF

SEQ ID NO: 9108 - protein, 8 aa, BK virus
LSFVRIFL

SEQ ID NO: 9109 - protein, 8 aa, BK virus
SFVRIFLN

SEQ ID NO: 9110 - protein, 8 aa, BK virus
FVRIFLNI

SEQ ID NO: 9111 - protein, 8 aa, BK virus
VRIFLNIF

SEQ ID NO: 9112 - protein, 8 aa, BK virus
RIFLNIFW

SEQ ID NO: 9113 - protein, 8 aa, BK virus
IFLNIFWA

SEQ ID NO: 9114 - protein, 8 aa, BK virus
PSLVEIFG

SEQ ID NO: 9115 - protein, 8 aa, BK virus
SLVEIFGF

SEQ ID NO: 9116 - protein, 8 aa, BK virus
LVEIFGFF

SEQ ID NO: 9117 - protein, 8 aa, BK virus
VEIFGFFC

SEQ ID NO: 9118 - protein, 8 aa, BK virus
EIFGFFCL

SEQ ID NO: 9119 - protein, 8 aa, BK virus
IFGFFCLN

SEQ ID NO: 9120 - protein, 8 aa, BK virus
FGFFCLNV

SEQ ID NO: 9121 - protein, 8 aa, BK virus
GFFCLNVS

SEQ ID NO: 9122 - protein, 8 aa, BK virus
FFCLNVSF

SEQ ID NO: 9123 - protein, 8 aa, BK virus
FCLNVSFL

SEQ ID NO: 9124 - protein, 8 aa, BK virus
CLNVSFLN

SEQ ID NO: 9125 - protein, 8 aa, BK virus
LNVSFLNL

SEQ ID NO: 9126 - protein, 8 aa, BK virus
NVSFLNLP

SEQ ID NO: 9127 - protein, 8 aa, BK virus
HFHLNNLS

SEQ ID NO: 9128 - protein, 8 aa, BK virus
FHLNNLSN

SEQ ID NO: 9129 - protein, 8 aa, BK virus
HLNNLSNC

SEQ ID NO: 9130 - protein, 8 aa, BK virus
LNNLSNCL

SEQ ID NO: 9131 - protein, 8 aa, BK virus
NNLSNCLN

SEQ ID NO: 9132 - protein, 8 aa, BK virus
NLSNCLNC

SEQ ID NO: 9133 - protein, 8 aa, BK virus
LSNCLNCL

SEQ ID NO: 9134 - protein, 8 aa, BK virus
SNCLNCLF

SEQ ID NO: 9135 - protein, 8 aa, BK virus
NCLNCLFH

SEQ ID NO: 9136 - protein, 8 aa, BK virus
CLNCLFHV

SEQ ID NO: 9137 - protein, 8 aa, BK virus
LNCLFHVL

SEQ ID NO: 9138 - protein, 8 aa, BK virus
NCLFHVLK

SEQ ID NO: 9139 - protein, 8 aa, BK virus
CLFHVLKA

SEQ ID NO: 9140 - protein, 8 aa, BK virus
LFHVLKAN

SEQ ID NO: 9141 - protein, 8 aa, BK virus
FHVLKANP

SEQ ID NO: 9142 - protein, 8 aa, BK virus
HVLKANPL

SEQ ID NO: 9143 - protein, 8 aa, BK virus
VLKANPLI

SEQ ID NO: 9144 - protein, 8 aa, BK virus
LKANPLIQ

SEQ ID NO: 9145 - protein, 8 aa, BK virus
KANPLIQL

SEQ ID NO: 9146 - protein, 8 aa, BK virus
ANPLIQLL

SEQ ID NO: 9147 - protein, 8 aa, BK virus
NPLIQLLS

SEQ ID NO: 9148 - protein, 8 aa, BK virus
PLIQLLSL

SEQ ID NO: 9149 - protein, 8 aa, BK virus
LIQLLSLL

SEQ ID NO: 9150 - protein, 8 aa, BK virus
IQLLSLLH

SEQ ID NO: 9151 - protein, 8 aa, BK virus
QLLSLLHL

SEQ ID NO: 9152 - protein, 8 aa, BK virus
LLSLLHLQ

SEQ ID NO: 9153 - protein, 8 aa, BK virus
LSLLHLQK

SEQ ID NO: 9154 - protein, 8 aa, BK virus
SLLHLQKQ

SEQ ID NO: 9155 - protein, 8 aa, BK virus
LLHLQKQP

SEQ ID NO: 9156 - protein, 8 aa, BK virus
LHLQKQPC

SEQ ID NO: 9157 - protein, 8 aa, BK virus
HLQKQPCT

SEQ ID NO: 9158 - protein, 8 aa, BK virus
LQKQPCTD

SEQ ID NO: 9159 - protein, 8 aa, BK virus
QKQPCTDL

SEQ ID NO: 9160 - protein, 8 aa, BK virus
LHLAQRLA

SEQ ID NO: 9161 - protein, 8 aa, BK virus
HLAQRLAF

SEQ ID NO: 9162 - protein, 8 aa, BK virus
LAQRLAFP

SEQ ID NO: 9163 - protein, 8 aa, BK virus
AQRLAFPW

SEQ ID NO: 9164 - protein, 8 aa, BK virus
QRLAFPWV

SEQ ID NO: 9165 - protein, 8 aa, BK virus
RLAFPWVG

SEQ ID NO: 9166 - protein, 8 aa, BK virus
LAFPWVGL

SEQ ID NO: 9167 - protein, 8 aa, BK virus
AFPWVGLH

SEQ ID NO: 9168 - protein, 8 aa, BK virus
FPWVGLHL

SEQ ID NO: 9169 - protein, 8 aa, BK virus
PWVGLHLR

SEQ ID NO: 9170 - protein, 8 aa, BK virus
WVGLHLRL

SEQ ID NO: 9171 - protein, 8 aa, BK virus
VGLHLRLY

SEQ ID NO: 9172 - protein, 8 aa, BK virus
GLHLRLYH

SEQ ID NO: 9173 - protein, 8 aa, BK virus
LHLRLYHH

SEQ ID NO: 9174 - protein, 8 aa, BK virus
HLRLYHHT

SEQ ID NO: 9175 - protein, 8 aa, BK virus
LRLYHHTN

SEQ ID NO: 9176 - protein, 8 aa, BK virus
RLYHHTNL

SEQ ID NO: 9177 - protein, 8 aa, BK virus
LYHHTNLI

SEQ ID NO: 9178 - protein, 8 aa, BK virus
YHHTNLIT

SEQ ID NO: 9179 - protein, 8 aa, BK virus
HHTNLITL

SEQ ID NO: 9180 - protein, 8 aa, BK virus
HTNLITLQ

SEQ ID NO: 9181 - protein, 8 aa, BK virus
TNLITLQL

SEQ ID NO: 9182 - protein, 8 aa, BK virus
NLITLQLV

SEQ ID NO: 9183 - protein, 8 aa, BK virus
LITLQLVL

SEQ ID NO: 9184 - protein, 8 aa, BK virus
ITLQLVLF

SEQ ID NO: 9185 - protein, 8 aa, BK virus
TLQLVLFF

SEQ ID NO: 9186 - protein, 8 aa, BK virus
LQLVLFFH

SEQ ID NO: 9187 - protein, 8 aa, BK virus
QLVLFFHY

SEQ ID NO: 9188 - protein, 8 aa, BK virus
LVLFFHYQ

SEQ ID NO: 9189 - protein, 8 aa, BK virus
VLFFHYQW

SEQ ID NO: 9190 - protein, 8 aa, BK virus
LFFHYQWD

SEQ ID NO: 9191 - protein, 8 aa, BK virus
FFHYQWDL

SEQ ID NO: 9192 - protein, 8 aa, BK virus
KQYSAKNQ

SEQ ID NO: 9193 - protein, 8 aa, BK virus
QYSAKNQI

SEQ ID NO: 9194 - protein, 8 aa, BK virus
YSAKNQIL

SEQ ID NO: 9195 - protein, 8 aa, BK virus
SAKNQILQ

SEQ ID NO: 9196 - protein, 8 aa, BK virus
AKNQILQN

SEQ ID NO: 9197 - protein, 8 aa, BK virus
KNQILQNP

SEQ ID NO: 9198 - protein, 8 aa, BK virus
NQILQNPF

SEQ ID NO: 9199 - protein, 8 aa, BK virus
VANSAAKQ

SEQ ID NO: 9200 - protein, 8 aa, BK virus
ANSAAKQH

SEQ ID NO: 9201 - protein, 8 aa, BK virus
NSAAKQHL

SEQ ID NO: 9202 - protein, 8 aa, BK virus
SAAKQHLP

SEQ ID NO: 9203 - protein, 8 aa, BK virus
AAKQHLPY

SEQ ID NO: 9204 - protein, 8 aa, BK virus
AKQHLPYI

SEQ ID NO: 9205 - protein, 8 aa, BK virus
KQHLPYIV

SEQ ID NO: 9206 - protein, 8 aa, BK virus
QHLPYIVL

SEQ ID NO: 9207 - protein, 8 aa, BK virus
HLPYIVLV

SEQ ID NO: 9208 - protein, 8 aa, BK virus
LPYIVLVQ

SEQ ID NO: 9209 - protein, 8 aa, BK virus
PYIVLVQH

SEQ ID NO: 9210 - protein, 8 aa, BK virus
YIVLVQHF

SEQ ID NO: 9211 - protein, 8 aa, BK virus
IVLVQHFH

SEQ ID NO: 9212 - protein, 8 aa, BK virus
VLVQHFHE

SEQ ID NO: 9213 - protein, 8 aa, BK virus
LVQHFHEL

SEQ ID NO: 9214 - protein, 8 aa, BK virus
VQHFHELQ

SEQ ID NO: 9215 - protein, 8 aa, BK virus
QHFHELQI

SEQ ID NO: 9216 - protein, 8 aa, BK virus
HFHELQIL

SEQ ID NO: 9217 - protein, 8 aa, BK virus
FHELQILN

SEQ ID NO: 9218 - protein, 8 aa, BK virus
HELQILNP

SEQ ID NO: 9219 - protein, 8 aa, BK virus
ELQILNPF

SEQ ID NO: 9220 - protein, 8 aa, BK virus
LQILNPFY

SEQ ID NO: 9221 - protein, 8 aa, BK virus
QILNPFYL

SEQ ID NO: 9222 - protein, 8 aa, BK virus
ILNPFYLI

SEQ ID NO: 9223 - protein, 8 aa, BK virus
LNPFYLIY

SEQ ID NO: 9224 - protein, 8 aa, BK virus
NPFYLIYD

SEQ ID NO: 9225 - protein, 8 aa, BK virus
IFLLAFLP

SEQ ID NO: 9226 - protein, 8 aa, BK virus
FLLAFLPW

SEQ ID NO: 9227 - protein, 8 aa, BK virus
LLAFLPWS

SEQ ID NO: 9228 - protein, 8 aa, BK virus
LAFLPWSY

SEQ ID NO: 9229 - protein, 8 aa, BK virus
AFLPWSYE

SEQ ID NO: 9230 - protein, 8 aa, BK virus
FLPWSYEG

SEQ ID NO: 9231 - protein, 8 aa, BK virus
LPWSYEGY

SEQ ID NO: 9232 - protein, 8 aa, BK virus
PWSYEGYL

SEQ ID NO: 9233 - protein, 8 aa, BK virus
WSYEGYLL

SEQ ID NO: 9234 - protein, 8 aa, BK virus
SYEGYLLF

SEQ ID NO: 9235 - protein, 8 aa, BK virus
YEGYLLFF

SEQ ID NO: 9236 - protein, 8 aa, BK virus
LKLYLLLA

SEQ ID NO: 9237 - protein, 8 aa, BK virus
KLYLLLAD

SEQ ID NO: 9238 - protein, 8 aa, BK virus
LYLLLADK

SEQ ID NO: 9239 - protein, 8 aa, BK virus
YLLLADKY

SEQ ID NO: 9240 - protein, 8 aa, BK virus
LLLADKYF

SEQ ID NO: 9241 - protein, 8 aa, BK virus
LLADKYFF

SEQ ID NO: 9242 - protein, 8 aa, BK virus
LADKYFFD

SEQ ID NO: 9243 - protein, 8 aa, BK virus
ADKYFFDF

SEQ ID NO: 9244 - protein, 8 aa, BK virus
DKYFFDFY

SEQ ID NO: 9245 - protein, 8 aa, BK virus
KYFFDFYF

SEQ ID NO: 9246 - protein, 8 aa, BK virus
YFFDFYFL

SEQ ID NO: 9247 - protein, 8 aa, BK virus
FFDFYFLQ

SEQ ID NO: 9248 - protein, 8 aa, BK virus
FDFYFLQK

SEQ ID NO: 9249 - protein, 8 aa, BK virus
HLQSAFHD

SEQ ID NO: 9250 - protein, 8 aa, BK virus
LQSAFHDT

SEQ ID NO: 9251 - protein, 8 aa, BK virus
SDKAGLFS

SEQ ID NO: 9252 - protein, 8 aa, BK virus
DKAGLFSD

SEQ ID NO: 9253 - protein, 8 aa, BK virus
KAGLFSDT

SEQ ID NO: 9254 - protein, 8 aa, BK virus
AGLFSDTF

SEQ ID NO: 9255 - protein, 8 aa, BK virus
GLFSDTFY

SEQ ID NO: 9256 - protein, 8 aa, BK virus
LFSDTFYT

SEQ ID NO: 9257 - protein, 8 aa, BK virus
FSDTFYTP

SEQ ID NO: 9258 - protein, 8 aa, BK virus
SDTFYTPL

SEQ ID NO: 9259 - protein, 8 aa, BK virus
DTFYTPLH

SEQ ID NO: 9260 - protein, 8 aa, BK virus
TFYTPLHC

SEQ ID NO: 9261 - protein, 8 aa, BK virus
FYTPLHCI

SEQ ID NO: 9262 - protein, 8 aa, BK virus
YTPLHCIE

SEQ ID NO: 9263 - protein, 8 aa, BK virus
TPLHCIEI

SEQ ID NO: 9264 - protein, 8 aa, BK virus
PLHCIEIL

SEQ ID NO: 9265 - protein, 8 aa, BK virus
LHCIEILN

SEQ ID NO: 9266 - protein, 8 aa, BK virus
HCIEILNT

SEQ ID NO: 9267 - protein, 8 aa, BK virus
CIEILNTY

SEQ ID NO: 9268 - protein, 8 aa, BK virus
IEILNTYL

SEQ ID NO: 9269 - protein, 8 aa, BK virus
EILNTYLI

SEQ ID NO: 9270 - protein, 8 aa, BK virus
ILNTYLII

SEQ ID NO: 9271 - protein, 8 aa, BK virus
LNTYLIIK

SEQ ID NO: 9272 - protein, 8 aa, BK virus
NTYLIIKT

SEQ ID NO: 9273 - protein, 8 aa, BK virus
TYLIIKTH

SEQ ID NO: 9274 - protein, 8 aa, BK virus
YLIIKTHP

SEQ ID NO: 9275 - protein, 8 aa, BK virus
LIIKTHPH

SEQ ID NO: 9276 - protein, 8 aa, BK virus
IIKTHPHT

SEQ ID NO: 9277 - protein, 8 aa, BK virus
IKTHPHTL

SEQ ID NO: 9278 - protein, 8 aa, BK virus
KTHPHTLS

SEQ ID NO: 9279 - protein, 8 aa, BK virus
THPHTLSL

SEQ ID NO: 9280 - protein, 8 aa, BK virus
HPHTLSLL

SEQ ID NO: 9281 - protein, 8 aa, BK virus
PHTLSLLH

SEQ ID NO: 9282 - protein, 8 aa, BK virus
HTLSLLHT

SEQ ID NO: 9283 - protein, 8 aa, BK virus
TLSLLHTQ

SEQ ID NO: 9284 - protein, 8 aa, BK virus
LISKTPAL

SEQ ID NO: 9285 - protein, 8 aa, BK virus
ISKTPALF

SEQ ID NO: 9286 - protein, 8 aa, BK virus
SKTPALFL

SEQ ID NO: 9287 - protein, 8 aa, BK virus
KTPALFLQ

SEQ ID NO: 9288 - protein, 8 aa, BK virus
TPALFLQA

SEQ ID NO: 9289 - protein, 8 aa, BK virus
PALFLQAL

SEQ ID NO: 9290 - protein, 8 aa, BK virus
ALFLQALL

SEQ ID NO: 9291 - protein, 8 aa, BK virus
LFLQALLG

SEQ ID NO: 9292 - protein, 8 aa, BK virus
NHAPLSPL

SEQ ID NO: 9293 - protein, 8 aa, BK virus
HAPLSPLE

SEQ ID NO: 9294 - protein, 8 aa, BK virus
APLSPLEC

SEQ ID NO: 9295 - protein, 8 aa, BK virus
PLSPLECF

SEQ ID NO: 9296 - protein, 8 aa, BK virus
LSPLECFL

SEQ ID NO: 9297 - protein, 8 aa, BK virus
SPLECFLL

SEQ ID NO: 9298 - protein, 8 aa, BK virus
LRHYIVSI

SEQ ID NO: 9299 - protein, 8 aa, BK virus
RHYIVSIP

SEQ ID NO: 9300 - protein, 8 aa, BK virus
HYIVSIPY

SEQ ID NO: 9301 - protein, 8 aa, BK virus
RYTAFDRN

SEQ ID NO: 9302 - protein, 8 aa, BK virus
YTAFDRNY

SEQ ID NO: 9303 - protein, 8 aa, BK virus
LQKLYVYV

SEQ ID NO: 9304 - protein, 8 aa, BK virus
QKLYVYVE

SEQ ID NO: 9305 - protein, 8 aa, BK virus
KLYVYVEL

SEQ ID NO: 9306 - protein, 8 aa, BK virus
LYVYVELK

SEQ ID NO: 9307 - protein, 8 aa, BK virus
YVYVELKR

SEQ ID NO: 9308 - protein, 8 aa, BK virus
VYVELKRI

SEQ ID NO: 9309 - protein, 8 aa, BK virus
YYAQHTCV

SEQ ID NO: 9310 - protein, 8 aa, BK virus
YAQHTCVY

SEQ ID NO: 9311 - protein, 8 aa, BK virus
VFYTEFEL

SEQ ID NO: 9312 - protein, 8 aa, BK virus
FYTEFELF

SEQ ID NO: 9313 - protein, 8 aa, BK virus
YTEFELFL

SEQ ID NO: 9314 - protein, 8 aa, BK virus
YTQQSRQG

SEQ ID NO: 9315 - protein, 8 aa, BK virus
TQQSRQGF

SEQ ID NO: 9316 - protein, 8 aa, BK virus
QQSRQGFY

SEQ ID NO: 9317 - protein, 8 aa, BK virus
QSRQGFYY

SEQ ID NO: 9318 - protein, 8 aa, BK virus
ETGVDQRE

SEQ ID NO: 9319 - protein, 8 aa, BK virus
TGVDQRES

SEQ ID NO: 9320 - protein, 8 aa, BK virus
GVDQRESL

SEQ ID NO: 9321 - protein, 8 aa, BK virus
GLLPFFFF

SEQ ID NO: 9322 - protein, 8 aa, BK virus
LLPFFFFW

SEQ ID NO: 9323 - protein, 8 aa, BK virus
LPFFFFWV

SEQ ID NO: 9324 - protein, 8 aa, BK virus
PFFFFWVV

SEQ ID NO: 9325 - protein, 8 aa, BK virus
FFFFWVVL

SEQ ID NO: 9326 - protein, 8 aa, BK virus
FFFWVVLS

SEQ ID NO: 9327 - protein, 8 aa, BK virus
FFWVVLSV

SEQ ID NO: 9328 - protein, 8 aa, BK virus
FWVVLSVE

SEQ ID NO: 9329 - protein, 8 aa, BK virus
WVVLSVEN

SEQ ID NO: 9330 - protein, 8 aa, BK virus
VVLSVENL

SEQ ID NO: 9331 - protein, 8 aa, BK virus
VLSVENLL

SEQ ID NO: 9332 - protein, 8 aa, BK virus
LSVENLLL

SEQ ID NO: 9333 - protein, 8 aa, BK virus
SVENLLLL

SEQ ID NO: 9334 - protein, 8 aa, BK virus
VENLLLLL

SEQ ID NO: 9335 - protein, 8 aa, BK virus
ENLLLLLH

SEQ ID NO: 9336 - protein, 8 aa, BK virus
NLLLLLHH

SEQ ID NO: 9337 - protein, 8 aa, BK virus
LLLLLHHW

SEQ ID NO: 9338 - protein, 8 aa, BK virus
LLLLHHWQ

SEQ ID NO: 9339 - protein, 8 aa, BK virus
LLLHHWQT

SEQ ID NO: 9340 - protein, 8 aa, BK virus
LLHHWQTY

SEQ ID NO: 9341 - protein, 8 aa, BK virus
LHHWQTYL

SEQ ID NO: 9342 - protein, 8 aa, BK virus
HHWQTYLH

SEQ ID NO: 9343 - protein, 8 aa, BK virus
HWQTYLHG

SEQ ID NO: 9344 - protein, 8 aa, BK virus
WQTYLHGK

SEQ ID NO: 9345 - protein, 8 aa, BK virus
QTYLHGKI

SEQ ID NO: 9346 - protein, 8 aa, BK virus
TYLHGKIN

SEQ ID NO: 9347 - protein, 8 aa, BK virus
YLHGKINL

SEQ ID NO: 9348 - protein, 8 aa, BK virus
LHGKINLH

SEQ ID NO: 9349 - protein, 8 aa, BK virus
HGKINLHP

SEQ ID NO: 9350 - protein, 8 aa, BK virus
GKINLHPI

SEQ ID NO: 9351 - protein, 8 aa, BK virus
KINLHPIF

SEQ ID NO: 9352 - protein, 8 aa, BK virus
INLHPIFH

SEQ ID NO: 9353 - protein, 8 aa, BK virus
RNSTRTPT

SEQ ID NO: 9354 - protein, 8 aa, BK virus
NSTRTPTL

SEQ ID NO: 9355 - protein, 8 aa, BK virus
STRTPTLL

SEQ ID NO: 9356 - protein, 8 aa, BK virus
TRTPTLLF

SEQ ID NO: 9357 - protein, 8 aa, BK virus
RTPTLLFH

SEQ ID NO: 9358 - protein, 8 aa, BK virus
TPTLLFHR

SEQ ID NO: 9359 - protein, 8 aa, BK virus
PTLLFHRL

SEQ ID NO: 9360 - protein, 8 aa, BK virus
TLLFHRLA

SEQ ID NO: 9361 - protein, 8 aa, BK virus
LLFHRLAP

SEQ ID NO: 9362 - protein, 8 aa, BK virus
LFHRLAPI

SEQ ID NO: 9363 - protein, 8 aa, BK virus
FHRLAPIK

SEQ ID NO: 9364 - protein, 8 aa, BK virus
HRLAPIKK

SEQ ID NO: 9365 - protein, 8 aa, BK virus
RLAPIKKI

SEQ ID NO: 9366 - protein, 8 aa, BK virus
LAPIKKII

SEQ ID NO: 9367 - protein, 8 aa, BK virus
APIKKIIT

SEQ ID NO: 9368 - protein, 8 aa, BK virus
GLLIFYYL

SEQ ID NO: 9369 - protein, 8 aa, BK virus
LLIFYYLS

SEQ ID NO: 9370 - protein, 8 aa, BK virus
LIFYYLSK

SEQ ID NO: 9371 - protein, 8 aa, BK virus
IFYYLSKY

SEQ ID NO: 9372 - protein, 8 aa, BK virus
FYYLSKYK

SEQ ID NO: 9373 - protein, 8 aa, BK virus
YYLSKYKL

SEQ ID NO: 9374 - protein, 8 aa, BK virus
YLSKYKLV

SEQ ID NO: 9375 - protein, 8 aa, BK virus
LSKYKLVT

SEQ ID NO: 9376 - protein, 8 aa, BK virus
SKYKLVTL

SEQ ID NO: 9377 - protein, 8 aa, BK virus
KYKLVTLK

SEQ ID NO: 9378 - protein, 8 aa, BK virus
YKLVTLKL

SEQ ID NO: 9379 - protein, 8 aa, BK virus
ISEGSFSN

SEQ ID NO: 9380 - protein, 8 aa, BK virus
SEGSFSNY

SEQ ID NO: 9381 - protein, 8 aa, BK virus
EGSFSNYL

SEQ ID NO: 9382 - protein, 8 aa, BK virus
GSFSNYLD

SEQ ID NO: 9383 - protein, 8 aa, BK virus
SFSNYLDP

SEQ ID NO: 9384 - protein, 8 aa, BK virus
FSNYLDPP

SEQ ID NO: 9385 - protein, 8 aa, BK virus
SNYLDPPL

SEQ ID NO: 9386 - protein, 8 aa, BK virus
NYLDPPLQ

SEQ ID NO: 9387 - protein, 8 aa, BK virus
YLDPPLQS

SEQ ID NO: 9388 - protein, 8 aa, BK virus
LDPPLQSF

SEQ ID NO: 9389 - protein, 8 aa, BK virus
DPPLQSFF

SEQ ID NO: 9390 - protein, 8 aa, BK virus
PPLQSFFS

SEQ ID NO: 9391 - protein, 8 aa, BK virus
AKPLCEAV

SEQ ID NO: 9392 - protein, 8 aa, BK virus
KPLCEAVN

SEQ ID NO: 9393 - protein, 8 aa, BK virus
PLCEAVNA

SEQ ID NO: 9394 - protein, 8 aa, BK virus
LCEAVNAV

SEQ ID NO: 9395 - protein, 8 aa, BK virus
CEAVNAVA

SEQ ID NO: 9396 - protein, 8 aa, BK virus
EAVNAVAI

SEQ ID NO: 9397 - protein, 8 aa, BK virus
AVNAVAIY

SEQ ID NO: 9398 - protein, 8 aa, BK virus
VNAVAIYP

SEQ ID NO: 9399 - protein, 8 aa, BK virus
NAVAIYPN

SEQ ID NO: 9400 - protein, 8 aa, BK virus
AVAIYPNQ

SEQ ID NO: 9401 - protein, 8 aa, BK virus
VAIYPNQG

SEQ ID NO: 9402 - protein, 8 aa, BK virus
AIYPNQGL

SEQ ID NO: 9403 - protein, 8 aa, BK virus
IYPNQGLF

SEQ ID NO: 9404 - protein, 8 aa, BK virus
YPNQGLFS

SEQ ID NO: 9405 - protein, 8 aa, BK virus
HARAVHRR

SEQ ID NO: 9406 - protein, 8 aa, BK virus
ARAVHRRL

SEQ ID NO: 9407 - protein, 8 aa, BK virus
RAVHRRLF

SEQ ID NO: 9408 - protein, 8 aa, BK virus
AVHRRLFG

SEQ ID NO: 9409 - protein, 8 aa, BK virus
VHRRLFGT

SEQ ID NO: 9410 - protein, 8 aa, BK virus
HRRLFGTN

SEQ ID NO: 9411 - protein, 8 aa, BK virus
RRLFGTNR

SEQ ID NO: 9412 - protein, 8 aa, BK virus
RLFGTNRP

SEQ ID NO: 9413 - protein, 8 aa, BK virus
LFGTNRPF

SEQ ID NO: 9414 - protein, 8 aa, BK virus
FGTNRPFL

SEQ ID NO: 9415 - protein, 8 aa, BK virus
GTNRPFLA

SEQ ID NO: 9416 - protein, 8 aa, BK virus
TNRPFLAV

SEQ ID NO: 9417 - protein, 8 aa, BK virus
NRPFLAVQ

SEQ ID NO: 9418 - protein, 8 aa, BK virus
RPFLAVQG

SEQ ID NO: 9419 - protein, 8 aa, BK virus
PFLAVQGI

SEQ ID NO: 9420 - protein, 8 aa, BK virus
FLAVQGIW

SEQ ID NO: 9421 - protein, 8 aa, BK virus
LAVQGIWA

SEQ ID NO: 9422 - protein, 8 aa, BK virus
AVQGIWAK

SEQ ID NO: 9423 - protein, 8 aa, BK virus
VQGIWAKR

SEQ ID NO: 9424 - protein, 8 aa, BK virus
QGIWAKRK

SEQ ID NO: 9425 - protein, 8 aa, BK virus
GIWAKRKI

SEQ ID NO: 9426 - protein, 8 aa, BK virus
IWAKRKIS

SEQ ID NO: 9427 - protein, 8 aa, BK virus
WAKRKIST

SEQ ID NO: 9428 - protein, 8 aa, BK virus
AKRKISTN

SEQ ID NO: 9429 - protein, 8 aa, BK virus
KRKISTNL

SEQ ID NO: 9430 - protein, 8 aa, BK virus
ATPGSKIR

SEQ ID NO: 9431 - protein, 8 aa, BK virus
TPGSKIRL

SEQ ID NO: 9432 - protein, 8 aa, BK virus
PGSKIRLM

SEQ ID NO: 9433 - protein, 8 aa, BK virus
GSKIRLMS

SEQ ID NO: 9434 - protein, 8 aa, BK virus
SKIRLMSY

SEQ ID NO: 9435 - protein, 8 aa, BK virus
KIRLMSYL

SEQ ID NO: 9436 - protein, 8 aa, BK virus
IRLMSYLY

SEQ ID NO: 9437 - protein, 8 aa, BK virus
RLMSYLYI

SEQ ID NO: 9438 - protein, 8 aa, BK virus
LMSYLYIL

SEQ ID NO: 9439 - protein, 8 aa, BK virus
MSYLYILL

SEQ ID NO: 9440 - protein, 8 aa, BK virus
SYLYILLH

SEQ ID NO: 9441 - protein, 8 aa, BK virus
YLYILLHF

SEQ ID NO: 9442 - protein, 8 aa, BK virus
LYILLHFF

SEQ ID NO: 9443 - protein, 8 aa, BK virus
YILLHFFI

SEQ ID NO: 9444 - protein, 8 aa, BK virus
ILLHFFIQ

SEQ ID NO: 9445 - protein, 8 aa, BK virus
LLHFFIQS

SEQ ID NO: 9446 - protein, 8 aa, BK virus
LHFFIQSI

SEQ ID NO: 9447 - protein, 8 aa, BK virus
HFFIQSIH

SEQ ID NO: 9448 - protein, 8 aa, BK virus
FFIQSIHS

SEQ ID NO: 9449 - protein, 8 aa, BK virus
FIQSIHSL

SEQ ID NO: 9450 - protein, 8 aa, BK virus
IQSIHSLH

SEQ ID NO: 9451 - protein, 8 aa, BK virus
QSIHSLHF

SEQ ID NO: 9452 - protein, 8 aa, BK virus
SIHSLHFI

SEQ ID NO: 9453 - protein, 8 aa, BK virus
IHSLHFIL

SEQ ID NO: 9454 - protein, 8 aa, BK virus
HSLHFILV

SEQ ID NO: 9455 - protein, 8 aa, BK virus
SLHFILVA

SEQ ID NO: 9456 - protein, 8 aa, BK virus
LHFILVAP

SEQ ID NO: 9457 - protein, 8 aa, BK virus
HFILVAPF

SEQ ID NO: 9458 - protein, 8 aa, BK virus
FILVAPFV

SEQ ID NO: 9459 - protein, 8 aa, BK virus
ILVAPFVR

SEQ ID NO: 9460 - protein, 8 aa, BK virus
LVAPFVRV

SEQ ID NO: 9461 - protein, 8 aa, BK virus
VAPFVRVK

SEQ ID NO: 9462 - protein, 8 aa, BK virus
APFVRVKF

SEQ ID NO: 9463 - protein, 8 aa, BK virus
PFVRVKFL

SEQ ID NO: 9464 - protein, 8 aa, BK virus
FVRVKFLT

SEQ ID NO: 9465 - protein, 8 aa, BK virus
VRVKFLTL

SEQ ID NO: 9466 - protein, 8 aa, BK virus
RVKFLTLP

SEQ ID NO: 9467 - protein, 8 aa, BK virus
GKISPGSS

SEQ ID NO: 9468 - protein, 8 aa, BK virus
KISPGSSF

SEQ ID NO: 9469 - protein, 8 aa, BK virus
ISPGSSFK

SEQ ID NO: 9470 - protein, 8 aa, BK virus
SPGSSFKA

SEQ ID NO: 9471 - protein, 8 aa, BK virus
KVHELHGF

SEQ ID NO: 9472 - protein, 8 aa, BK virus
VHELHGFF

SEQ ID NO: 9473 - protein, 8 aa, BK virus
HELHGFFP

SEQ ID NO: 9474 - protein, 8 aa, BK virus
ELHGFFPV

SEQ ID NO: 9475 - protein, 8 aa, BK virus
LHGFFPVK

SEQ ID NO: 9476 - protein, 8 aa, BK virus
HGFFPVKN

SEQ ID NO: 9477 - protein, 8 aa, BK virus
GFFPVKNF

SEQ ID NO: 9478 - protein, 8 aa, BK virus
FFPVKNFI

SEQ ID NO: 9479 - protein, 8 aa, BK virus
FPVKNFIH

SEQ ID NO: 9480 - protein, 9 aa, BK virus
LQKLQKNRD

SEQ ID NO: 9481 - protein, 9 aa, BK virus
QKLQKNRDF

SEQ ID NO: 9482 - protein, 9 aa, BK virus
KLQKNRDFP

SEQ ID NO: 9483 - protein, 9 aa, BK virus
LQKNRDFPK

SEQ ID NO: 9484 - protein, 9 aa, BK virus
ASEKASTPL

SEQ ID NO: 9485 - protein, 9 aa, BK virus
SEKASTPLL

SEQ ID NO: 9486 - protein, 9 aa, BK virus
EKASTPLLL

SEQ ID NO: 9487 - protein, 9 aa, BK virus
KASTPLLLE

SEQ ID NO: 9488 - protein, 9 aa, BK virus
ASTPLLLER

SEQ ID NO: 9489 - protein, 9 aa, BK virus
STPLLLERK

SEQ ID NO: 9490 - protein, 9 aa, BK virus
TPLLLERKG

SEQ ID NO: 9491 - protein, 9 aa, BK virus
PLLLERKGG

SEQ ID NO: 9492 - protein, 9 aa, BK virus
LLLERKGGG

SEQ ID NO: 9493 - protein, 9 aa, BK virus
LLERKGGGR

SEQ ID NO: 9494 - protein, 9 aa, BK virus
LERKGGGRG

SEQ ID NO: 9495 - protein, 9 aa, BK virus
ERKGGGRGG

SEQ ID NO: 9496 - protein, 9 aa, BK virus
RKGGGRGGL

SEQ ID NO: 9497 - protein, 9 aa, BK virus
KGGGRGGLG

SEQ ID NO: 9498 - protein, 9 aa, BK virus
GGGRGGLGL

SEQ ID NO: 9499 - protein, 9 aa, BK virus
GGRGGLGLL

SEQ ID NO: 9500 - protein, 9 aa, BK virus
GRGGLGLLY

SEQ ID NO: 9501 - protein, 9 aa, BK virus
RGGLGLLYI

SEQ ID NO: 9502 - protein, 9 aa, BK virus
GGLGLLYII

SEQ ID NO: 9503 - protein, 9 aa, BK virus
GLGLLYIIK

SEQ ID NO: 9504 - protein, 9 aa, BK virus
LGLLYIIKK

SEQ ID NO: 9505 - protein, 9 aa, BK virus
GLLYIIKKK

SEQ ID NO: 9506 - protein, 9 aa, BK virus
LLYIIKKKA

SEQ ID NO: 9507 - protein, 9 aa, BK virus
LYIIKKKAT

SEQ ID NO: 9508 - protein, 9 aa, BK virus
YIIKKKATG

SEQ ID NO: 9509 - protein, 9 aa, BK virus
IIKKKATGR

SEQ ID NO: 9510 - protein, 9 aa, BK virus
IKKKATGRS

SEQ ID NO: 9511 - protein, 9 aa, BK virus
KKKATGRSC

SEQ ID NO: 9512 - protein, 9 aa, BK virus
KKATGRSCL

SEQ ID NO: 9513 - protein, 9 aa, BK virus
KATGRSCLP

SEQ ID NO: 9514 - protein, 9 aa, BK virus
ATGRSCLPM

SEQ ID NO: 9515 - protein, 9 aa, BK virus
TGRSCLPME

SEQ ID NO: 9516 - protein, 9 aa, BK virus
GRSCLPMEC

SEQ ID NO: 9517 - protein, 9 aa, BK virus
RSCLPMECS

SEQ ID NO: 9518 - protein, 9 aa, BK virus
SCLPMECSQ

SEQ ID NO: 9519 - protein, 9 aa, BK virus
CLPMECSQT

SEQ ID NO: 9520 - protein, 9 aa, BK virus
LPMECSQTM

SEQ ID NO: 9521 - protein, 9 aa, BK virus
PMECSQTMT

SEQ ID NO: 9522 - protein, 9 aa, BK virus
MECSQTMTS

SEQ ID NO: 9523 - protein, 9 aa, BK virus
ECSQTMTSG

SEQ ID NO: 9524 - protein, 9 aa, BK virus
CSQTMTSGR

SEQ ID NO: 9525 - protein, 9 aa, BK virus
SQTMTSGRK

SEQ ID NO: 9526 - protein, 9 aa, BK virus
QTMTSGRKV

SEQ ID NO: 9527 - protein, 9 aa, BK virus
TMTSGRKVH

SEQ ID NO: 9528 - protein, 9 aa, BK virus
MTSGRKVHD

SEQ ID NO: 9529 - protein, 9 aa, BK virus
TSGRKVHDS

SEQ ID NO: 9530 - protein, 9 aa, BK virus
SGRKVHDSQ

SEQ ID NO: 9531 - protein, 9 aa, BK virus
GRKVHDSQG

SEQ ID NO: 9532 - protein, 9 aa, BK virus
RKVHDSQGN

SEQ ID NO: 9533 - protein, 9 aa, BK virus
KVHDSQGNA

SEQ ID NO: 9534 - protein, 9 aa, BK virus
VHDSQGNAA

SEQ ID NO: 9535 - protein, 9 aa, BK virus
HDSQGNAAK

SEQ ID NO: 9536 - protein, 9 aa, BK virus
DSQGNAAKP

SEQ ID NO: 9537 - protein, 9 aa, BK virus
PQEGKCMTH

SEQ ID NO: 9538 - protein, 9 aa, BK virus
QEGKCMTHR

SEQ ID NO: 9539 - protein, 9 aa, BK virus
EGKCMTHRE

SEQ ID NO: 9540 - protein, 9 aa, BK virus
GKCMTHREE

SEQ ID NO: 9541 - protein, 9 aa, BK virus
KCMTHREEL

SEQ ID NO: 9542 - protein, 9 aa, BK virus
CMTHREELL

SEQ ID NO: 9543 - protein, 9 aa, BK virus
MTHREELLT

SEQ ID NO: 9544 - protein, 9 aa, BK virus
THREELLTH

SEQ ID NO: 9545 - protein, 9 aa, BK virus
HREELLTHG

SEQ ID NO: 9546 - protein, 9 aa, BK virus
REELLTHGM

SEQ ID NO: 9547 - protein, 9 aa, BK virus
EELLTHGMQ

SEQ ID NO: 9548 - protein, 9 aa, BK virus
ELLTHGMQP

SEQ ID NO: 9549 - protein, 9 aa, BK virus
LLTHGMQPN

SEQ ID NO: 9550 - protein, 9 aa, BK virus
LTHGMQPNH

SEQ ID NO: 9551 - protein, 9 aa, BK virus
THGMQPNHD

SEQ ID NO: 9552 - protein, 9 aa, BK virus
HGMQPNHDL

SEQ ID NO: 9553 - protein, 9 aa, BK virus
GMQPNHDLR

SEQ ID NO: 9554 - protein, 9 aa, BK virus
MQPNHDLRK

SEQ ID NO: 9555 - protein, 9 aa, BK virus
QPNHDLRKE

SEQ ID NO: 9556 - protein, 9 aa, BK virus
PNHDLRKES

SEQ ID NO: 9557 - protein, 9 aa, BK virus
NHDLRKESA

SEQ ID NO: 9558 - protein, 9 aa, BK virus
QTCFASLGI

SEQ ID NO: 9559 - protein, 9 aa, BK virus
TCFASLGIL

SEQ ID NO: 9560 - protein, 9 aa, BK virus
CFASLGILA

SEQ ID NO: 9561 - protein, 9 aa, BK virus
FASLGILAL

SEQ ID NO: 9562 - protein, 9 aa, BK virus
ASLGILALS

SEQ ID NO: 9563 - protein, 9 aa, BK virus
SLGILALSP

SEQ ID NO: 9564 - protein, 9 aa, BK virus
LGILALSPV

SEQ ID NO: 9565 - protein, 9 aa, BK virus
GILALSPVK

SEQ ID NO: 9566 - protein, 9 aa, BK virus
ILALSPVKL

SEQ ID NO: 9567 - protein, 9 aa, BK virus
LALSPVKLD

SEQ ID NO: 9568 - protein, 9 aa, BK virus
ALSPVKLDK

SEQ ID NO: 9569 - protein, 9 aa, BK virus
LSPVKLDKG

SEQ ID NO: 9570 - protein, 9 aa, BK virus
SPVKLDKGH

SEQ ID NO: 9571 - protein, 9 aa, BK virus
PVKLDKGHG

SEQ ID NO: 9572 - protein, 9 aa, BK virus
VKLDKGHGS

SEQ ID NO: 9573 - protein, 9 aa, BK virus
KLDKGHGSA

SEQ ID NO: 9574 - protein, 9 aa, BK virus
LDKGHGSAP

SEQ ID NO: 9575 - protein, 9 aa, BK virus
DKGHGSAPA

SEQ ID NO: 9576 - protein, 9 aa, BK virus
KGHGSAPAV

SEQ ID NO: 9577 - protein, 9 aa, BK virus
GHGSAPAVT

SEQ ID NO: 9578 - protein, 9 aa, BK virus
HGSAPAVTT

SEQ ID NO: 9579 - protein, 9 aa, BK virus
GSAPAVTTS

SEQ ID NO: 9580 - protein, 9 aa, BK virus
SAPAVTTSF

SEQ ID NO: 9581 - protein, 9 aa, BK virus
APAVTTSFS

SEQ ID NO: 9582 - protein, 9 aa, BK virus
PAVTTSFSE

SEQ ID NO: 9583 - protein, 9 aa, BK virus
AVTTSFSES

SEQ ID NO: 9584 - protein, 9 aa, BK virus
VTTSFSESW

SEQ ID NO: 9585 - protein, 9 aa, BK virus
NLDWNKKKS

SEQ ID NO: 9586 - protein, 9 aa, BK virus
LDWNKKKSS

SEQ ID NO: 9587 - protein, 9 aa, BK virus
DWNKKKSSE

SEQ ID NO: 9588 - protein, 9 aa, BK virus
WNKKKSSED

SEQ ID NO: 9589 - protein, 9 aa, BK virus
NKKKSSEDF

SEQ ID NO: 9590 - protein, 9 aa, BK virus
KKKSSEDFY

SEQ ID NO: 9591 - protein, 9 aa, BK virus
KKSSEDFYF

SEQ ID NO: 9592 - protein, 9 aa, BK virus
KSSEDFYFY

SEQ ID NO: 9593 - protein, 9 aa, BK virus
SSEDFYFYF

SEQ ID NO: 9594 - protein, 9 aa, BK virus
SEDFYFYFR

SEQ ID NO: 9595 - protein, 9 aa, BK virus
EDFYFYFRA

SEQ ID NO: 9596 - protein, 9 aa, BK virus
DFYFYFRAF

SEQ ID NO: 9597 - protein, 9 aa, BK virus
FYFYFRAFA

SEQ ID NO: 9598 - protein, 9 aa, BK virus
YFYFRAFAG

SEQ ID NO: 9599 - protein, 9 aa, BK virus
FYFRAFAGI

SEQ ID NO: 9600 - protein, 9 aa, BK virus
YFRAFAGIL

SEQ ID NO: 9601 - protein, 9 aa, BK virus
RQCRREKQK

SEQ ID NO: 9602 - protein, 9 aa, BK virus
QCRREKQKY

SEQ ID NO: 9603 - protein, 9 aa, BK virus
CRREKQKYH

SEQ ID NO: 9604 - protein, 9 aa, BK virus
RREKQKYHC

SEQ ID NO: 9605 - protein, 9 aa, BK virus
REKQKYHCF

SEQ ID NO: 9606 - protein, 9 aa, BK virus
EKQKYHCFT

SEQ ID NO: 9607 - protein, 9 aa, BK virus
KQKYHCFTC

SEQ ID NO: 9608 - protein, 9 aa, BK virus
QKYHCFTCC

SEQ ID NO: 9609 - protein, 9 aa, BK virus
KYHCFTCCK

SEQ ID NO: 9610 - protein, 9 aa, BK virus
YHCFTCCKR

SEQ ID NO: 9611 - protein, 9 aa, BK virus
HCFTCCKRL

SEQ ID NO: 9612 - protein, 9 aa, BK virus
CFTCCKRLC

SEQ ID NO: 9613 - protein, 9 aa, BK virus
FTCCKRLCK

SEQ ID NO: 9614 - protein, 9 aa, BK virus
TCCKRLCKR

SEQ ID NO: 9615 - protein, 9 aa, BK virus
CCKRLCKRL

SEQ ID NO: 9616 - protein, 9 aa, BK virus
CKRLCKRLL

SEQ ID NO: 9617 - protein, 9 aa, BK virus
KRLCKRLLG

SEQ ID NO: 9618 - protein, 9 aa, BK virus
RLCKRLLGK

SEQ ID NO: 9619 - protein, 9 aa, BK virus
SLFFCISRF

SEQ ID NO: 9620 - protein, 9 aa, BK virus
LFFCISRFM

SEQ ID NO: 9621 - protein, 9 aa, BK virus
FFCISRFMG

SEQ ID NO: 9622 - protein, 9 aa, BK virus
FCISRFMGA

SEQ ID NO: 9623 - protein, 9 aa, BK virus
CISRFMGAA

SEQ ID NO: 9624 - protein, 9 aa, BK virus
ISRFMGAAL

SEQ ID NO: 9625 - protein, 9 aa, BK virus
SRFMGAALA

SEQ ID NO: 9626 - protein, 9 aa, BK virus
RFMGAALAL

SEQ ID NO: 9627 - protein, 9 aa, BK virus
FMGAALALL

SEQ ID NO: 9628 - protein, 9 aa, BK virus
MGAALALLG

SEQ ID NO: 9629 - protein, 9 aa, BK virus
GAALALLGD

SEQ ID NO: 9630 - protein, 9 aa, BK virus
AALALLGDL

SEQ ID NO: 9631 - protein, 9 aa, BK virus
ALALLGDLV

SEQ ID NO: 9632 - protein, 9 aa, BK virus
LALLGDLVA

SEQ ID NO: 9633 - protein, 9 aa, BK virus
ALLGDLVAS

SEQ ID NO: 9634 - protein, 9 aa, BK virus
LLGDLVASV

SEQ ID NO: 9635 - protein, 9 aa, BK virus
LGDLVASVS

SEQ ID NO: 9636 - protein, 9 aa, BK virus
GDLVASVSE

SEQ ID NO: 9637 - protein, 9 aa, BK virus
DLVASVSEA

SEQ ID NO: 9638 - protein, 9 aa, BK virus
LVASVSEAA

SEQ ID NO: 9639 - protein, 9 aa, BK virus
VASVSEAAA

SEQ ID NO: 9640 - protein, 9 aa, BK virus
ASVSEAAAA

SEQ ID NO: 9641 - protein, 9 aa, BK virus
SVSEAAAAT

SEQ ID NO: 9642 - protein, 9 aa, BK virus
VSEAAAATG

SEQ ID NO: 9643 - protein, 9 aa, BK virus
SEAAAATGF

SEQ ID NO: 9644 - protein, 9 aa, BK virus
EAAAATGFS

SEQ ID NO: 9645 - protein, 9 aa, BK virus
AAAATGFSV

SEQ ID NO: 9646 - protein, 9 aa, BK virus
AAATGFSVA

SEQ ID NO: 9647 - protein, 9 aa, BK virus
AATGFSVAE

SEQ ID NO: 9648 - protein, 9 aa, BK virus
ATGFSVAEI

SEQ ID NO: 9649 - protein, 9 aa, BK virus
TGFSVAEIA

SEQ ID NO: 9650 - protein, 9 aa, BK virus
GFSVAEIAA

SEQ ID NO: 9651 - protein, 9 aa, BK virus
FSVAEIAAG

SEQ ID NO: 9652 - protein, 9 aa, BK virus
SVAEIAAGE

SEQ ID NO: 9653 - protein, 9 aa, BK virus
VAEIAAGEA

SEQ ID NO: 9654 - protein, 9 aa, BK virus
AEIAAGEAA

SEQ ID NO: 9655 - protein, 9 aa, BK virus
EIAAGEAAA

SEQ ID NO: 9656 - protein, 9 aa, BK virus
IAAGEAAAA

SEQ ID NO: 9657 - protein, 9 aa, BK virus
AAGEAAAAI

SEQ ID NO: 9658 - protein, 9 aa, BK virus
AGEAAAAIE

SEQ ID NO: 9659 - protein, 9 aa, BK virus
GEAAAAIEV

SEQ ID NO: 9660 - protein, 9 aa, BK virus
EAAAAIEVQ

SEQ ID NO: 9661 - protein, 9 aa, BK virus
AAAAIEVQI

SEQ ID NO: 9662 - protein, 9 aa, BK virus
AAAIEVQIA

SEQ ID NO: 9663 - protein, 9 aa, BK virus
AAIEVQIAS

SEQ ID NO: 9664 - protein, 9 aa, BK virus
AIEVQIASL

SEQ ID NO: 9665 - protein, 9 aa, BK virus
IEVQIASLA

SEQ ID NO: 9666 - protein, 9 aa, BK virus
EVQIASLAT

SEQ ID NO: 9667 - protein, 9 aa, BK virus
VQIASLATV

SEQ ID NO: 9668 - protein, 9 aa, BK virus
QIASLATVE

SEQ ID NO: 9669 - protein, 9 aa, BK virus
IASLATVEG

SEQ ID NO: 9670 - protein, 9 aa, BK virus
ASLATVEGI

SEQ ID NO: 9671 - protein, 9 aa, BK virus
SLATVEGIT

SEQ ID NO: 9672 - protein, 9 aa, BK virus
LATVEGITS

SEQ ID NO: 9673 - protein, 9 aa, BK virus
ATVEGITST

SEQ ID NO: 9674 - protein, 9 aa, BK virus
TVEGITSTS

SEQ ID NO: 9675 - protein, 9 aa, BK virus
VEGITSTSE

SEQ ID NO: 9676 - protein, 9 aa, BK virus
EGITSTSEA

SEQ ID NO: 9677 - protein, 9 aa, BK virus
GITSTSEAI

SEQ ID NO: 9678 - protein, 9 aa, BK virus
ITSTSEAIA

SEQ ID NO: 9679 - protein, 9 aa, BK virus
TSTSEAIAA

SEQ ID NO: 9680 - protein, 9 aa, BK virus
STSEAIAAI

SEQ ID NO: 9681 - protein, 9 aa, BK virus
TSEAIAAIG

SEQ ID NO: 9682 - protein, 9 aa, BK virus
SEAIAAIGL

SEQ ID NO: 9683 - protein, 9 aa, BK virus
EAIAAIGLT

SEQ ID NO: 9684 - protein, 9 aa, BK virus
AIAAIGLTP

SEQ ID NO: 9685 - protein, 9 aa, BK virus
IAAIGLTPQ

SEQ ID NO: 9686 - protein, 9 aa, BK virus
AAIGLTPQT

SEQ ID NO: 9687 - protein, 9 aa, BK virus
AIGLTPQTY

SEQ ID NO: 9688 - protein, 9 aa, BK virus
IGLTPQTYA

SEQ ID NO: 9689 - protein, 9 aa, BK virus
GLTPQTYAV

SEQ ID NO: 9690 - protein, 9 aa, BK virus
LTPQTYAVI

SEQ ID NO: 9691 - protein, 9 aa, BK virus
TPQTYAVIA

SEQ ID NO: 9692 - protein, 9 aa, BK virus
PQTYAVIAG

SEQ ID NO: 9693 - protein, 9 aa, BK virus
QTYAVIAGA

SEQ ID NO: 9694 - protein, 9 aa, BK virus
TYAVIAGAP

SEQ ID NO: 9695 - protein, 9 aa, BK virus
YAVIAGAPG

SEQ ID NO: 9696 - protein, 9 aa, BK virus
AVIAGAPGA

SEQ ID NO: 9697 - protein, 9 aa, BK virus
VIAGAPGAI

SEQ ID NO: 9698 - protein, 9 aa, BK virus
IAGAPGAIA

SEQ ID NO: 9699 - protein, 9 aa, BK virus
AGAPGAIAG

SEQ ID NO: 9700 - protein, 9 aa, BK virus
GAPGAIAGF

SEQ ID NO: 9701 - protein, 9 aa, BK virus
APGAIAGFA

SEQ ID NO: 9702 - protein, 9 aa, BK virus
PGAIAGFAA

SEQ ID NO: 9703 - protein, 9 aa, BK virus
GAIAGFAAL

SEQ ID NO: 9704 - protein, 9 aa, BK virus
AIAGFAALI

SEQ ID NO: 9705 - protein, 9 aa, BK virus
IAGFAALIQ

SEQ ID NO: 9706 - protein, 9 aa, BK virus
AGFAALIQT

SEQ ID NO: 9707 - protein, 9 aa, BK virus
GFAALIQTV

SEQ ID NO: 9708 - protein, 9 aa, BK virus
FAALIQTVS

SEQ ID NO: 9709 - protein, 9 aa, BK virus
AALIQTVSG

SEQ ID NO: 9710 - protein, 9 aa, BK virus
ALIQTVSGI

SEQ ID NO: 9711 - protein, 9 aa, BK virus
LIQTVSGIS

SEQ ID NO: 9712 - protein, 9 aa, BK virus
IQTVSGISS

SEQ ID NO: 9713 - protein, 9 aa, BK virus
QTVSGISSL

SEQ ID NO: 9714 - protein, 9 aa, BK virus
TVSGISSLA

SEQ ID NO: 9715 - protein, 9 aa, BK virus
VSGISSLAQ

SEQ ID NO: 9716 - protein, 9 aa, BK virus
SGISSLAQV

SEQ ID NO: 9717 - protein, 9 aa, BK virus
GISSLAQVG

SEQ ID NO: 9718 - protein, 9 aa, BK virus
ISSLAQVGY

SEQ ID NO: 9719 - protein, 9 aa, BK virus
SSLAQVGYK

SEQ ID NO: 9720 - protein, 9 aa, BK virus
SLAQVGYKF

SEQ ID NO: 9721 - protein, 9 aa, BK virus
LAQVGYKFF

SEQ ID NO: 9722 - protein, 9 aa, BK virus
AQVGYKFFD

SEQ ID NO: 9723 - protein, 9 aa, BK virus
QVGYKFFDD

SEQ ID NO: 9724 - protein, 9 aa, BK virus
VGYKFFDDW

SEQ ID NO: 9725 - protein, 9 aa, BK virus
GYKFFDDWD

SEQ ID NO: 9726 - protein, 9 aa, BK virus
YKFFDDWDH

SEQ ID NO: 9727 - protein, 9 aa, BK virus
KFFDDWDHK

SEQ ID NO: 9728 - protein, 9 aa, BK virus
FFDDWDHKV

SEQ ID NO: 9729 - protein, 9 aa, BK virus
FDDWDHKVS

SEQ ID NO: 9730 - protein, 9 aa, BK virus
DDWDHKVST

SEQ ID NO: 9731 - protein, 9 aa, BK virus
DWDHKVSTV

SEQ ID NO: 9732 - protein, 9 aa, BK virus
WDHKVSTVG

SEQ ID NO: 9733 - protein, 9 aa, BK virus
DHKVSTVGL

SEQ ID NO: 9734 - protein, 9 aa, BK virus
HKVSTVGLY

SEQ ID NO: 9735 - protein, 9 aa, BK virus
KVSTVGLYQ

SEQ ID NO: 9736 - protein, 9 aa, BK virus
VSTVGLYQQ

SEQ ID NO: 9737 - protein, 9 aa, BK virus
STVGLYQQS

SEQ ID NO: 9738 - protein, 9 aa, BK virus
TVGLYQQSG

SEQ ID NO: 9739 - protein, 9 aa, BK virus
VGLYQQSGM

SEQ ID NO: 9740 - protein, 9 aa, BK virus
GLYQQSGMA

SEQ ID NO: 9741 - protein, 9 aa, BK virus
LYQQSGMAL

SEQ ID NO: 9742 - protein, 9 aa, BK virus
YQQSGMALE

SEQ ID NO: 9743 - protein, 9 aa, BK virus
QQSGMALEL

SEQ ID NO: 9744 - protein, 9 aa, BK virus
QSGMALELF

SEQ ID NO: 9745 - protein, 9 aa, BK virus
SGMALELFN

SEQ ID NO: 9746 - protein, 9 aa, BK virus
GMALELFNP

SEQ ID NO: 9747 - protein, 9 aa, BK virus
MALELFNPD

SEQ ID NO: 9748 - protein, 9 aa, BK virus
ALELFNPDE

SEQ ID NO: 9749 - protein, 9 aa, BK virus
LELFNPDEY

SEQ ID NO: 9750 - protein, 9 aa, BK virus
ELFNPDEYY

SEQ ID NO: 9751 - protein, 9 aa, BK virus
LFNPDEYYD

SEQ ID NO: 9752 - protein, 9 aa, BK virus
FNPDEYYDI

SEQ ID NO: 9753 - protein, 9 aa, BK virus
NPDEYYDIL

SEQ ID NO: 9754 - protein, 9 aa, BK virus
PDEYYDILF

SEQ ID NO: 9755 - protein, 9 aa, BK virus
DEYYDILFP

SEQ ID NO: 9756 - protein, 9 aa, BK virus
EYYDILFPG

SEQ ID NO: 9757 - protein, 9 aa, BK virus
YYDILFPGV

SEQ ID NO: 9758 - protein, 9 aa, BK virus
YDILFPGVN

SEQ ID NO: 9759 - protein, 9 aa, BK virus
DILFPGVNT

SEQ ID NO: 9760 - protein, 9 aa, BK virus
ILFPGVNTF

SEQ ID NO: 9761 - protein, 9 aa, BK virus
LFPGVNTFV

SEQ ID NO: 9762 - protein, 9 aa, BK virus
FPGVNTFVN

SEQ ID NO: 9763 - protein, 9 aa, BK virus
PGVNTFVNN

SEQ ID NO: 9764 - protein, 9 aa, BK virus
GVNTFVNNI

SEQ ID NO: 9765 - protein, 9 aa, BK virus
VNTFVNNIQ

SEQ ID NO: 9766 - protein, 9 aa, BK virus
NTFVNNIQY

SEQ ID NO: 9767 - protein, 9 aa, BK virus
TFVNNIQYL

SEQ ID NO: 9768 - protein, 9 aa, BK virus
FVNNIQYLD

SEQ ID NO: 9769 - protein, 9 aa, BK virus
VNNIQYLDP

SEQ ID NO: 9770 - protein, 9 aa, BK virus
NNIQYLDPR

SEQ ID NO: 9771 - protein, 9 aa, BK virus
NIQYLDPRH

SEQ ID NO: 9772 - protein, 9 aa, BK virus
IQYLDPRHW

SEQ ID NO: 9773 - protein, 9 aa, BK virus
QYLDPRHWG

SEQ ID NO: 9774 - protein, 9 aa, BK virus
YLDPRHWGP

SEQ ID NO: 9775 - protein, 9 aa, BK virus
LDPRHWGPS

SEQ ID NO: 9776 - protein, 9 aa, BK virus
DPRHWGPSL

SEQ ID NO: 9777 - protein, 9 aa, BK virus
PRHWGPSLF

SEQ ID NO: 9778 - protein, 9 aa, BK virus
RHWGPSLFA

SEQ ID NO: 9779 - protein, 9 aa, BK virus
HWGPSLFAT

SEQ ID NO: 9780 - protein, 9 aa, BK virus
WGPSLFATI

SEQ ID NO: 9781 - protein, 9 aa, BK virus
GPSLFATIS

SEQ ID NO: 9782 - protein, 9 aa, BK virus
PSLFATISQ

SEQ ID NO: 9783 - protein, 9 aa, BK virus
SLFATISQA

SEQ ID NO: 9784 - protein, 9 aa, BK virus
LFATISQAL

SEQ ID NO: 9785 - protein, 9 aa, BK virus
FATISQALW

SEQ ID NO: 9786 - protein, 9 aa, BK virus
ATISQALWH

SEQ ID NO: 9787 - protein, 9 aa, BK virus
TISQALWHV

SEQ ID NO: 9788 - protein, 9 aa, BK virus
ISQALWHVI

SEQ ID NO: 9789 - protein, 9 aa, BK virus
SQALWHVIR

SEQ ID NO: 9790 - protein, 9 aa, BK virus
QALWHVIRD

SEQ ID NO: 9791 - protein, 9 aa, BK virus
ALWHVIRDD

SEQ ID NO: 9792 - protein, 9 aa, BK virus
LWHVIRDDI

SEQ ID NO: 9793 - protein, 9 aa, BK virus
WHVIRDDIP

SEQ ID NO: 9794 - protein, 9 aa, BK virus
HVIRDDIPS

SEQ ID NO: 9795 - protein, 9 aa, BK virus
VIRDDIPSI

SEQ ID NO: 9796 - protein, 9 aa, BK virus
IRDDIPSIT

SEQ ID NO: 9797 - protein, 9 aa, BK virus
RDDIPSITS

SEQ ID NO: 9798 - protein, 9 aa, BK virus
DDIPSITSQ

SEQ ID NO: 9799 - protein, 9 aa, BK virus
DIPSITSQE

SEQ ID NO: 9800 - protein, 9 aa, BK virus
IPSITSQEL

SEQ ID NO: 9801 - protein, 9 aa, BK virus
PSITSQELQ

SEQ ID NO: 9802 - protein, 9 aa, BK virus
SITSQELQR

SEQ ID NO: 9803 - protein, 9 aa, BK virus
ITSQELQRR

SEQ ID NO: 9804 - protein, 9 aa, BK virus
TSQELQRRT

SEQ ID NO: 9805 - protein, 9 aa, BK virus
SQELQRRTE

SEQ ID NO: 9806 - protein, 9 aa, BK virus
QELQRRTER

SEQ ID NO: 9807 - protein, 9 aa, BK virus
ELQRRTERF

SEQ ID NO: 9808 - protein, 9 aa, BK virus
LQRRTERFF

SEQ ID NO: 9809 - protein, 9 aa, BK virus
QRRTERFFR

SEQ ID NO: 9810 - protein, 9 aa, BK virus
RRTERFFRD

SEQ ID NO: 9811 - protein, 9 aa, BK virus
RTERFFRDS

SEQ ID NO: 9812 - protein, 9 aa, BK virus
TERFFRDSL

SEQ ID NO: 9813 - protein, 9 aa, BK virus
ERFFRDSLA

SEQ ID NO: 9814 - protein, 9 aa, BK virus
RFFRDSLAR

SEQ ID NO: 9815 - protein, 9 aa, BK virus
FFRDSLARF

SEQ ID NO: 9816 - protein, 9 aa, BK virus
FRDSLARFL

SEQ ID NO: 9817 - protein, 9 aa, BK virus
RDSLARFLE

SEQ ID NO: 9818 - protein, 9 aa, BK virus
DSLARFLEE

SEQ ID NO: 9819 - protein, 9 aa, BK virus
SLARFLEET

SEQ ID NO: 9820 - protein, 9 aa, BK virus
LARFLEETT

SEQ ID NO: 9821 - protein, 9 aa, BK virus
ARFLEETTW

SEQ ID NO: 9822 - protein, 9 aa, BK virus
RFLEETTWT

SEQ ID NO: 9823 - protein, 9 aa, BK virus
FLEETTWTI

SEQ ID NO: 9824 - protein, 9 aa, BK virus
LEETTWTIV

SEQ ID NO: 9825 - protein, 9 aa, BK virus
EETTWTIVN

SEQ ID NO: 9826 - protein, 9 aa, BK virus
ETTWTIVNA

SEQ ID NO: 9827 - protein, 9 aa, BK virus
TTWTIVNAP

SEQ ID NO: 9828 - protein, 9 aa, BK virus
TWTIVNAPI

SEQ ID NO: 9829 - protein, 9 aa, BK virus
WTIVNAPIN

SEQ ID NO: 9830 - protein, 9 aa, BK virus
TIVNAPINF

SEQ ID NO: 9831 - protein, 9 aa, BK virus
IVNAPINFY

SEQ ID NO: 9832 - protein, 9 aa, BK virus
VNAPINFYN

SEQ ID NO: 9833 - protein, 9 aa, BK virus
NAPINFYNY

SEQ ID NO: 9834 - protein, 9 aa, BK virus
APINFYNYI

SEQ ID NO: 9835 - protein, 9 aa, BK virus
PINFYNYIQ

SEQ ID NO: 9836 - protein, 9 aa, BK virus
INFYNYIQQ

SEQ ID NO: 9837 - protein, 9 aa, BK virus
NFYNYIQQY

SEQ ID NO: 9838 - protein, 9 aa, BK virus
FYNYIQQYY

SEQ ID NO: 9839 - protein, 9 aa, BK virus
YNYIQQYYS

SEQ ID NO: 9840 - protein, 9 aa, BK virus
NYIQQYYSD

SEQ ID NO: 9841 - protein, 9 aa, BK virus
YIQQYYSDL

SEQ ID NO: 9842 - protein, 9 aa, BK virus
IQQYYSDLS

SEQ ID NO: 9843 - protein, 9 aa, BK virus
QQYYSDLSP

SEQ ID NO: 9844 - protein, 9 aa, BK virus
QYYSDLSPI

SEQ ID NO: 9845 - protein, 9 aa, BK virus
YYSDLSPIR

SEQ ID NO: 9846 - protein, 9 aa, BK virus
YSDLSPIRP

SEQ ID NO: 9847 - protein, 9 aa, BK virus
SDLSPIRPS

SEQ ID NO: 9848 - protein, 9 aa, BK virus
DLSPIRPSM

SEQ ID NO: 9849 - protein, 9 aa, BK virus
LSPIRPSMV

SEQ ID NO: 9850 - protein, 9 aa, BK virus
SPIRPSMVR

SEQ ID NO: 9851 - protein, 9 aa, BK virus
PIRPSMVRQ

SEQ ID NO: 9852 - protein, 9 aa, BK virus
IRPSMVRQV

SEQ ID NO: 9853 - protein, 9 aa, BK virus
RPSMVRQVA

SEQ ID NO: 9854 - protein, 9 aa, BK virus
PSMVRQVAE

SEQ ID NO: 9855 - protein, 9 aa, BK virus
SMVRQVAER

SEQ ID NO: 9856 - protein, 9 aa, BK virus
MVRQVAERE

SEQ ID NO: 9857 - protein, 9 aa, BK virus
VRQVAEREG

SEQ ID NO: 9858 - protein, 9 aa, BK virus
RQVAEREGT

SEQ ID NO: 9859 - protein, 9 aa, BK virus
QVAEREGTR

SEQ ID NO: 9860 - protein, 9 aa, BK virus
VAEREGTRV

SEQ ID NO: 9861 - protein, 9 aa, BK virus
AEREGTRVH

SEQ ID NO: 9862 - protein, 9 aa, BK virus
EREGTRVHF

SEQ ID NO: 9863 - protein, 9 aa, BK virus
REGTRVHFG

SEQ ID NO: 9864 - protein, 9 aa, BK virus
EGTRVHFGH

SEQ ID NO: 9865 - protein, 9 aa, BK virus
GTRVHFGHT

SEQ ID NO: 9866 - protein, 9 aa, BK virus
TRVHFGHTY

SEQ ID NO: 9867 - protein, 9 aa, BK virus
RVHFGHTYS

SEQ ID NO: 9868 - protein, 9 aa, BK virus
VHFGHTYSI

SEQ ID NO: 9869 - protein, 9 aa, BK virus
HFGHTYSID

SEQ ID NO: 9870 - protein, 9 aa, BK virus
FGHTYSIDD

SEQ ID NO: 9871 - protein, 9 aa, BK virus
GHTYSIDDA

SEQ ID NO: 9872 - protein, 9 aa, BK virus
HTYSIDDAD

SEQ ID NO: 9873 - protein, 9 aa, BK virus
TYSIDDADS

SEQ ID NO: 9874 - protein, 9 aa, BK virus
YSIDDADSI

SEQ ID NO: 9875 - protein, 9 aa, BK virus
SIDDADSIE

SEQ ID NO: 9876 - protein, 9 aa, BK virus
IDDADSIEE

SEQ ID NO: 9877 - protein, 9 aa, BK virus
DDADSIEEV

SEQ ID NO: 9878 - protein, 9 aa, BK virus
DADSIEEVT

SEQ ID NO: 9879 - protein, 9 aa, BK virus
ADSIEEVTQ

SEQ ID NO: 9880 - protein, 9 aa, BK virus
DSIEEVTQR

SEQ ID NO: 9881 - protein, 9 aa, BK virus
SIEEVTQRM

SEQ ID NO: 9882 - protein, 9 aa, BK virus
IEEVTQRMD

SEQ ID NO: 9883 - protein, 9 aa, BK virus
EEVTQRMDL

SEQ ID NO: 9884 - protein, 9 aa, BK virus
EVTQRMDLR

SEQ ID NO: 9885 - protein, 9 aa, BK virus
VTQRMDLRN

SEQ ID NO: 9886 - protein, 9 aa, BK virus
TQRMDLRNQ

SEQ ID NO: 9887 - protein, 9 aa, BK virus
QRMDLRNQQ

SEQ ID NO: 9888 - protein, 9 aa, BK virus
RMDLRNQQS

SEQ ID NO: 9889 - protein, 9 aa, BK virus
MDLRNQQSV

SEQ ID NO: 9890 - protein, 9 aa, BK virus
DLRNQQSVH

SEQ ID NO: 9891 - protein, 9 aa, BK virus
LRNQQSVHS

SEQ ID NO: 9892 - protein, 9 aa, BK virus
RNQQSVHSG

SEQ ID NO: 9893 - protein, 9 aa, BK virus
NQQSVHSGE

SEQ ID NO: 9894 - protein, 9 aa, BK virus
QQSVHSGEF

SEQ ID NO: 9895 - protein, 9 aa, BK virus
QSVHSGEFI

SEQ ID NO: 9896 - protein, 9 aa, BK virus
SVHSGEFIE

SEQ ID NO: 9897 - protein, 9 aa, BK virus
VHSGEFIEK

SEQ ID NO: 9898 - protein, 9 aa, BK virus
HSGEFIEKT

SEQ ID NO: 9899 - protein, 9 aa, BK virus
SGEFIEKTI

SEQ ID NO: 9900 - protein, 9 aa, BK virus
GEFIEKTIA

SEQ ID NO: 9901 - protein, 9 aa, BK virus
EFIEKTIAP

SEQ ID NO: 9902 - protein, 9 aa, BK virus
FIEKTIAPG

SEQ ID NO: 9903 - protein, 9 aa, BK virus
IEKTIAPGG

SEQ ID NO: 9904 - protein, 9 aa, BK virus
EKTIAPGGA

SEQ ID NO: 9905 - protein, 9 aa, BK virus
KTIAPGGAN

SEQ ID NO: 9906 - protein, 9 aa, BK virus
TIAPGGANQ

SEQ ID NO: 9907 - protein, 9 aa, BK virus
IAPGGANQR

SEQ ID NO: 9908 - protein, 9 aa, BK virus
APGGANQRT

SEQ ID NO: 9909 - protein, 9 aa, BK virus
PGGANQRTA

SEQ ID NO: 9910 - protein, 9 aa, BK virus
GGANQRTAP

SEQ ID NO: 9911 - protein, 9 aa, BK virus
GANQRTAPQ

SEQ ID NO: 9912 - protein, 9 aa, BK virus
ANQRTAPQW

SEQ ID NO: 9913 - protein, 9 aa, BK virus
NQRTAPQWM

SEQ ID NO: 9914 - protein, 9 aa, BK virus
QRTAPQWML

SEQ ID NO: 9915 - protein, 9 aa, BK virus
RTAPQWMLP

SEQ ID NO: 9916 - protein, 9 aa, BK virus
TAPQWMLPL

SEQ ID NO: 9917 - protein, 9 aa, BK virus
APQWMLPLL

SEQ ID NO: 9918 - protein, 9 aa, BK virus
PQWMLPLLL

SEQ ID NO: 9919 - protein, 9 aa, BK virus
QWMLPLLLG

SEQ ID NO: 9920 - protein, 9 aa, BK virus
WMLPLLLGL

SEQ ID NO: 9921 - protein, 9 aa, BK virus
MLPLLLGLY

SEQ ID NO: 9922 - protein, 9 aa, BK virus
LPLLLGLYG

SEQ ID NO: 9923 - protein, 9 aa, BK virus
PLLLGLYGT

SEQ ID NO: 9924 - protein, 9 aa, BK virus
LLLGLYGTV

SEQ ID NO: 9925 - protein, 9 aa, BK virus
LLGLYGTVT

SEQ ID NO: 9926 - protein, 9 aa, BK virus
LGLYGTVTP

SEQ ID NO: 9927 - protein, 9 aa, BK virus
GLYGTVTPA

SEQ ID NO: 9928 - protein, 9 aa, BK virus
LYGTVTPAL

SEQ ID NO: 9929 - protein, 9 aa, BK virus
YGTVTPALE

SEQ ID NO: 9930 - protein, 9 aa, BK virus
GTVTPALEA

SEQ ID NO: 9931 - protein, 9 aa, BK virus
TVTPALEAY

SEQ ID NO: 9932 - protein, 9 aa, BK virus
VTPALEAYE

SEQ ID NO: 9933 - protein, 9 aa, BK virus
TPALEAYED

SEQ ID NO: 9934 - protein, 9 aa, BK virus
PALEAYEDG

SEQ ID NO: 9935 - protein, 9 aa, BK virus
ALEAYEDGP

SEQ ID NO: 9936 - protein, 9 aa, BK virus
LEAYEDGPN

SEQ ID NO: 9937 - protein, 9 aa, BK virus
EAYEDGPNQ

SEQ ID NO: 9938 - protein, 9 aa, BK virus
AYEDGPNQK

SEQ ID NO: 9939 - protein, 9 aa, BK virus
YEDGPNQKK

SEQ ID NO: 9940 - protein, 9 aa, BK virus
EDGPNQKKR

SEQ ID NO: 9941 - protein, 9 aa, BK virus
DGPNQKKRR

SEQ ID NO: 9942 - protein, 9 aa, BK virus
GPNQKKRRV

SEQ ID NO: 9943 - protein, 9 aa, BK virus
PNQKKRRVS

SEQ ID NO: 9944 - protein, 9 aa, BK virus
NQKKRRVSR

SEQ ID NO: 9945 - protein, 9 aa, BK virus
QKKRRVSRG

SEQ ID NO: 9946 - protein, 9 aa, BK virus
KKRRVSRGS

SEQ ID NO: 9947 - protein, 9 aa, BK virus
KRRVSRGSS

SEQ ID NO: 9948 - protein, 9 aa, BK virus
RRVSRGSSQ

SEQ ID NO: 9949 - protein, 9 aa, BK virus
RVSRGSSQK

SEQ ID NO: 9950 - protein, 9 aa, BK virus
VSRGSSQKA

SEQ ID NO: 9951 - protein, 9 aa, BK virus
SRGSSQKAK

SEQ ID NO: 9952 - protein, 9 aa, BK virus
RGSSQKAKG

SEQ ID NO: 9953 - protein, 9 aa, BK virus
GSSQKAKGT

SEQ ID NO: 9954 - protein, 9 aa, BK virus
SSQKAKGTR

SEQ ID NO: 9955 - protein, 9 aa, BK virus
SQKAKGTRA

SEQ ID NO: 9956 - protein, 9 aa, BK virus
QKAKGTRAS

SEQ ID NO: 9957 - protein, 9 aa, BK virus
KAKGTRASA

SEQ ID NO: 9958 - protein, 9 aa, BK virus
AKGTRASAK

SEQ ID NO: 9959 - protein, 9 aa, BK virus
KGTRASAKT

SEQ ID NO: 9960 - protein, 9 aa, BK virus
GTRASAKTT

SEQ ID NO: 9961 - protein, 9 aa, BK virus
TRASAKTTN

SEQ ID NO: 9962 - protein, 9 aa, BK virus
RASAKTTNK

SEQ ID NO: 9963 - protein, 9 aa, BK virus
ASAKTTNKR

SEQ ID NO: 9964 - protein, 9 aa, BK virus
SAKTTNKRR

SEQ ID NO: 9965 - protein, 9 aa, BK virus
AKTTNKRRS

SEQ ID NO: 9966 - protein, 9 aa, BK virus
KTTNKRRSR

SEQ ID NO: 9967 - protein, 9 aa, BK virus
TTNKRRSRS

SEQ ID NO: 9968 - protein, 9 aa, BK virus
TNKRRSRSS

SEQ ID NO: 9969 - protein, 9 aa, BK virus
NKRRSRSSR

SEQ ID NO: 9970 - protein, 9 aa, BK virus
KRRSRSSRS

SEQ ID NO: 9971 - protein, 9 aa, BK virus
NWGRCYYRG

SEQ ID NO: 9972 - protein, 9 aa, BK virus
WGRCYYRGR

SEQ ID NO: 9973 - protein, 9 aa, BK virus
GRCYYRGRM

SEQ ID NO: 9974 - protein, 9 aa, BK virus
RCYYRGRML

SEQ ID NO: 9975 - protein, 9 aa, BK virus
CYYRGRMLP

SEQ ID NO: 9976 - protein, 9 aa, BK virus
YYRGRMLPK

SEQ ID NO: 9977 - protein, 9 aa, BK virus
YRGRMLPKP

SEQ ID NO: 9978 - protein, 9 aa, BK virus
RGRMLPKPR

SEQ ID NO: 9979 - protein, 9 aa, BK virus
GRMLPKPRN

SEQ ID NO: 9980 - protein, 9 aa, BK virus
RMLPKPRNG

SEQ ID NO: 9981 - protein, 9 aa, BK virus
MLPKPRNGG

SEQ ID NO: 9982 - protein, 9 aa, BK virus
LPKPRNGGS

SEQ ID NO: 9983 - protein, 9 aa, BK virus
PKPRNGGSR

SEQ ID NO: 9984 - protein, 9 aa, BK virus
PREKNASLL

SEQ ID NO: 9985 - protein, 9 aa, BK virus
REKNASLLQ

SEQ ID NO: 9986 - protein, 9 aa, BK virus
EKNASLLQH

SEQ ID NO: 9987 - protein, 9 aa, BK virus
KNASLLQHS

SEQ ID NO: 9988 - protein, 9 aa, BK virus
NASLLQHSK

SEQ ID NO: 9989 - protein, 9 aa, BK virus
ASLLQHSKN

SEQ ID NO: 9990 - protein, 9 aa, BK virus
SLLQHSKNS

SEQ ID NO: 9991 - protein, 9 aa, BK virus
LLQHSKNSP

SEQ ID NO: 9992 - protein, 9 aa, BK virus
LQHSKNSPP

SEQ ID NO: 9993 - protein, 9 aa, BK virus
QHSKNSPPQ

SEQ ID NO: 9994 - protein, 9 aa, BK virus
HSKNSPPQF

SEQ ID NO: 9995 - protein, 9 aa, BK virus
SKNSPPQFK

SEQ ID NO: 9996 - protein, 9 aa, BK virus
GPNLWKSTD

SEQ ID NO: 9997 - protein, 9 aa, BK virus
PNLWKSTDV

SEQ ID NO: 9998 - protein, 9 aa, BK virus
NLWKSTDVG

SEQ ID NO: 9999 - protein, 9 aa, BK virus
LWKSTDVGG

SEQ ID NO: 10000 - protein, 9 aa, BK virus
WKSTDVGGC

SEQ ID NO: 10001 - protein, 9 aa, BK virus
KSTDVGGCN

SEQ ID NO: 10002 - protein, 9 aa, BK virus
STDVGGCNC

SEQ ID NO: 10003 - protein, 9 aa, BK virus
TDVGGCNCT

SEQ ID NO: 10004 - protein, 9 aa, BK virus
DVGGCNCTN

SEQ ID NO: 10005 - protein, 9 aa, BK virus
VGGCNCTNR

SEQ ID NO: 10006 - protein, 9 aa, BK virus
GGCNCTNRG

SEQ ID NO: 10007 - protein, 9 aa, BK virus
GCNCTNRGY

SEQ ID NO: 10008 - protein, 9 aa, BK virus
CNCTNRGYW

SEQ ID NO: 10009 - protein, 9 aa, BK virus
NCTNRGYWN

SEQ ID NO: 10010 - protein, 9 aa, BK virus
CTNRGYWNN

SEQ ID NO: 10011 - protein, 9 aa, BK virus
PSCRVTKSA

SEQ ID NO: 10012 - protein, 9 aa, BK virus
AWWRKTYSR

SEQ ID NO: 10013 - protein, 9 aa, BK virus
WWRKTYSRQ

SEQ ID NO: 10014 - protein, 9 aa, BK virus
FPLLCCRWR

SEQ ID NO: 10015 - protein, 9 aa, BK virus
PLLCCRWRT

SEQ ID NO: 10016 - protein, 9 aa, BK virus
LLCCRWRTL

SEQ ID NO: 10017 - protein, 9 aa, BK virus
LCCRWRTLG

SEQ ID NO: 10018 - protein, 9 aa, BK virus
CCRWRTLGN

SEQ ID NO: 10019 - protein, 9 aa, BK virus
CRWRTLGNA

SEQ ID NO: 10020 - protein, 9 aa, BK virus
RWRTLGNAG

SEQ ID NO: 10021 - protein, 9 aa, BK virus
WRTLGNAGS

SEQ ID NO: 10022 - protein, 9 aa, BK virus
RTLGNAGSA

SEQ ID NO: 10023 - protein, 9 aa, BK virus
TLGNAGSAN

SEQ ID NO: 10024 - protein, 9 aa, BK virus
LGNAGSANE

SEQ ID NO: 10025 - protein, 9 aa, BK virus
GNAGSANEL

SEQ ID NO: 10026 - protein, 9 aa, BK virus
NAGSANELQ

SEQ ID NO: 10027 - protein, 9 aa, BK virus
AGSANELQV

SEQ ID NO: 10028 - protein, 9 aa, BK virus
GSANELQVK

SEQ ID NO: 10029 - protein, 9 aa, BK virus
SANELQVKV

SEQ ID NO: 10030 - protein, 9 aa, BK virus
ANELQVKVP

SEQ ID NO: 10031 - protein, 9 aa, BK virus
KPNSPVPGN

SEQ ID NO: 10032 - protein, 9 aa, BK virus
PNSPVPGNE

SEQ ID NO: 10033 - protein, 9 aa, BK virus
NSPVPGNEY

SEQ ID NO: 10034 - protein, 9 aa, BK virus
GLFGQKQCL

SEQ ID NO: 10035 - protein, 9 aa, BK virus
LFGQKQCLS

SEQ ID NO: 10036 - protein, 9 aa, BK virus
FGQKQCLSS

SEQ ID NO: 10037 - protein, 9 aa, BK virus
VFWDFHRRG

SEQ ID NO: 10038 - protein, 9 aa, BK virus
FWDFHRRGK

SEQ ID NO: 10039 - protein, 9 aa, BK virus
WDFHRRGKC

SEQ ID NO: 10040 - protein, 9 aa, BK virus
DFHRRGKCS

SEQ ID NO: 10041 - protein, 9 aa, BK virus
FHRRGKCSP

SEQ ID NO: 10042 - protein, 9 aa, BK virus
HRRGKCSPS

SEQ ID NO: 10043 - protein, 9 aa, BK virus
RRGKCSPST

SEQ ID NO: 10044 - protein, 9 aa, BK virus
RGKCSPSTS

SEQ ID NO: 10045 - protein, 9 aa, BK virus
GKCSPSTSC

SEQ ID NO: 10046 - protein, 9 aa, BK virus
KCSPSTSCD

SEQ ID NO: 10047 - protein, 9 aa, BK virus
CSPSTSCDQ

SEQ ID NO: 10048 - protein, 9 aa, BK virus
SPSTSCDQH

SEQ ID NO: 10049 - protein, 9 aa, BK virus
PSTSCDQHS

SEQ ID NO: 10050 - protein, 9 aa, BK virus
STSCDQHSY

SEQ ID NO: 10051 - protein, 9 aa, BK virus
TSCDQHSYH

SEQ ID NO: 10052 - protein, 9 aa, BK virus
SCDQHSYHS

SEQ ID NO: 10053 - protein, 9 aa, BK virus
CDQHSYHSV

SEQ ID NO: 10054 - protein, 9 aa, BK virus
DQHSYHSVA

SEQ ID NO: 10055 - protein, 9 aa, BK virus
QHSYHSVAR

SEQ ID NO: 10056 - protein, 9 aa, BK virus
QLWNTTVER

SEQ ID NO: 10057 - protein, 9 aa, BK virus
LWNTTVERP

SEQ ID NO: 10058 - protein, 9 aa, BK virus
WNTTVERPC

SEQ ID NO: 10059 - protein, 9 aa, BK virus
NTTVERPCK

SEQ ID NO: 10060 - protein, 9 aa, BK virus
TTVERPCKI

SEQ ID NO: 10061 - protein, 9 aa, BK virus
TVERPCKIF

SEQ ID NO: 10062 - protein, 9 aa, BK virus
DPPEKKICK

SEQ ID NO: 10063 - protein, 9 aa, BK virus
PPEKKICKE

SEQ ID NO: 10064 - protein, 9 aa, BK virus
PEKKICKES

SEQ ID NO: 10065 - protein, 9 aa, BK virus
EKKICKESL

SEQ ID NO: 10066 - protein, 9 aa, BK virus
KKICKESLP

SEQ ID NO: 10067 - protein, 9 aa, BK virus
KICKESLPN

SEQ ID NO: 10068 - protein, 9 aa, BK virus
ICKESLPNF

SEQ ID NO: 10069 - protein, 9 aa, BK virus
CKESLPNFL

SEQ ID NO: 10070 - protein, 9 aa, BK virus
KESLPNFLF

SEQ ID NO: 10071 - protein, 9 aa, BK virus
ESLPNFLFA

SEQ ID NO: 10072 - protein, 9 aa, BK virus
SLPNFLFAK

SEQ ID NO: 10073 - protein, 9 aa, BK virus
PYKQENPES

SEQ ID NO: 10074 - protein, 9 aa, BK virus
YKQENPESG

SEQ ID NO: 10075 - protein, 9 aa, BK virus
KQENPESGW

SEQ ID NO: 10076 - protein, 9 aa, BK virus
QENPESGWA

SEQ ID NO: 10077 - protein, 9 aa, BK virus
ENPESGWAA

SEQ ID NO: 10078 - protein, 9 aa, BK virus
NPESGWAAY

SEQ ID NO: 10079 - protein, 9 aa, BK virus
PESGWAAYV

SEQ ID NO: 10080 - protein, 9 aa, BK virus
ESGWAAYVW

SEQ ID NO: 10081 - protein, 9 aa, BK virus
SGWAAYVWY

SEQ ID NO: 10082 - protein, 9 aa, BK virus
GWAAYVWYG

SEQ ID NO: 10083 - protein, 9 aa, BK virus
WAAYVWYGI

SEQ ID NO: 10084 - protein, 9 aa, BK virus
AAYVWYGIP

SEQ ID NO: 10085 - protein, 9 aa, BK virus
AYVWYGIPG

SEQ ID NO: 10086 - protein, 9 aa, BK virus
YVWYGIPGR

SEQ ID NO: 10087 - protein, 9 aa, BK virus
VWYGIPGRR

SEQ ID NO: 10088 - protein, 9 aa, BK virus
WYGIPGRRG

SEQ ID NO: 10089 - protein, 9 aa, BK virus
WHRKTSRGP

SEQ ID NO: 10090 - protein, 9 aa, BK virus
HRKTSRGPR

SEQ ID NO: 10091 - protein, 9 aa, BK virus
RKTSRGPRY

SEQ ID NO: 10092 - protein, 9 aa, BK virus
KTSRGPRYD

SEQ ID NO: 10093 - protein, 9 aa, BK virus
TSRGPRYDK

SEQ ID NO: 10094 - protein, 9 aa, BK virus
SRGPRYDKI

SEQ ID NO: 10095 - protein, 9 aa, BK virus
RGPRYDKIY

SEQ ID NO: 10096 - protein, 9 aa, BK virus
QTGTIANQN

SEQ ID NO: 10097 - protein, 9 aa, BK virus
TGTIANQNA

SEQ ID NO: 10098 - protein, 9 aa, BK virus
GTIANQNAL

SEQ ID NO: 10099 - protein, 9 aa, BK virus
TIANQNALN

SEQ ID NO: 10100 - protein, 9 aa, BK virus
IANQNALNR

SEQ ID NO: 10101 - protein, 9 aa, BK virus
ANQNALNRC

SEQ ID NO: 10102 - protein, 9 aa, BK virus
NQNALNRCF

SEQ ID NO: 10103 - protein, 9 aa, BK virus
QNALNRCFY

SEQ ID NO: 10104 - protein, 9 aa, BK virus
NALNRCFYC

SEQ ID NO: 10105 - protein, 9 aa, BK virus
ALNRCFYCT

SEQ ID NO: 10106 - protein, 9 aa, BK virus
LNRCFYCTY

SEQ ID NO: 10107 - protein, 9 aa, BK virus
NRCFYCTYT

SEQ ID NO: 10108 - protein, 9 aa, BK virus
RCFYCTYTF

SEQ ID NO: 10109 - protein, 9 aa, BK virus
CFYCTYTFN

SEQ ID NO: 10110 - protein, 9 aa, BK virus
FYCTYTFNK

SEQ ID NO: 10111 - protein, 9 aa, BK virus
YCTYTFNKC

SEQ ID NO: 10112 - protein, 9 aa, BK virus
CTYTFNKCC

SEQ ID NO: 10113 - protein, 9 aa, BK virus
TYTFNKCCF

SEQ ID NO: 10114 - protein, 9 aa, BK virus
YTFNKCCFC

SEQ ID NO: 10115 - protein, 9 aa, BK virus
TFNKCCFCI

SEQ ID NO: 10116 - protein, 9 aa, BK virus
FNKCCFCIS

SEQ ID NO: 10117 - protein, 9 aa, BK virus
NKCCFCISH

SEQ ID NO: 10118 - protein, 9 aa, BK virus
KCCFCISHF

SEQ ID NO: 10119 - protein, 9 aa, BK virus
ACVILGVVF

SEQ ID NO: 10120 - protein, 9 aa, BK virus
NTESLYTNA

SEQ ID NO: 10121 - protein, 9 aa, BK virus
TESLYTNAT

SEQ ID NO: 10122 - protein, 9 aa, BK virus
ESLYTNATL

SEQ ID NO: 10123 - protein, 9 aa, BK virus
SLYTNATLD

SEQ ID NO: 10124 - protein, 9 aa, BK virus
LYTNATLDY

SEQ ID NO: 10125 - protein, 9 aa, BK virus
YTNATLDYG

SEQ ID NO: 10126 - protein, 9 aa, BK virus
TNATLDYGG

SEQ ID NO: 10127 - protein, 9 aa, BK virus
NATLDYGGL

SEQ ID NO: 10128 - protein, 9 aa, BK virus
ATLDYGGLT

SEQ ID NO: 10129 - protein, 9 aa, BK virus
TLDYGGLTF

SEQ ID NO: 10130 - protein, 9 aa, BK virus
LDYGGLTFG

SEQ ID NO: 10131 - protein, 9 aa, BK virus
DYGGLTFGN

SEQ ID NO: 10132 - protein, 9 aa, BK virus
YGGLTFGNL

SEQ ID NO: 10133 - protein, 9 aa, BK virus
GGLTFGNLQ

SEQ ID NO: 10134 - protein, 9 aa, BK virus
GLTFGNLQQ

SEQ ID NO: 10135 - protein, 9 aa, BK virus
LTFGNLQQG

SEQ ID NO: 10136 - protein, 9 aa, BK virus
TFGNLQQGL

SEQ ID NO: 10137 - protein, 9 aa, BK virus
FGNLQQGLK

SEQ ID NO: 10138 - protein, 9 aa, BK virus
GNLQQGLKY

SEQ ID NO: 10139 - protein, 9 aa, BK virus
NLQQGLKYL

SEQ ID NO: 10140 - protein, 9 aa, BK virus
LQQGLKYLR

SEQ ID NO: 10141 - protein, 9 aa, BK virus
QQGLKYLRL

SEQ ID NO: 10142 - protein, 9 aa, BK virus
QGLKYLRLG

SEQ ID NO: 10143 - protein, 9 aa, BK virus
GLKYLRLGK

SEQ ID NO: 10144 - protein, 9 aa, BK virus
LKYLRLGKS

SEQ ID NO: 10145 - protein, 9 aa, BK virus
KYLRLGKSI

SEQ ID NO: 10146 - protein, 9 aa, BK virus
YLRLGKSIV

SEQ ID NO: 10147 - protein, 9 aa, BK virus
LRLGKSIVI

SEQ ID NO: 10148 - protein, 9 aa, BK virus
RLGKSIVIG

SEQ ID NO: 10149 - protein, 9 aa, BK virus
LGKSIVIGI

SEQ ID NO: 10150 - protein, 9 aa, BK virus
GKSIVIGIQ

SEQ ID NO: 10151 - protein, 9 aa, BK virus
KSIVIGIQC

SEQ ID NO: 10152 - protein, 9 aa, BK virus
SIVIGIQCL

SEQ ID NO: 10153 - protein, 9 aa, BK virus
IVIGIQCLI

SEQ ID NO: 10154 - protein, 9 aa, BK virus
VIGIQCLIH

SEQ ID NO: 10155 - protein, 9 aa, BK virus
IGIQCLIHV

SEQ ID NO: 10156 - protein, 9 aa, BK virus
GIQCLIHVQ

SEQ ID NO: 10157 - protein, 9 aa, BK virus
IQCLIHVQS

SEQ ID NO: 10158 - protein, 9 aa, BK virus
QCLIHVQSL

SEQ ID NO: 10159 - protein, 9 aa, BK virus
CLIHVQSLQ

SEQ ID NO: 10160 - protein, 9 aa, BK virus
LIHVQSLQF

SEQ ID NO: 10161 - protein, 9 aa, BK virus
IHVQSLQFL

SEQ ID NO: 10162 - protein, 9 aa, BK virus
HVQSLQFLN

SEQ ID NO: 10163 - protein, 9 aa, BK virus
VQSLQFLNP

SEQ ID NO: 10164 - protein, 9 aa, BK virus
QSLQFLNPL

SEQ ID NO: 10165 - protein, 9 aa, BK virus
SLQFLNPLL

SEQ ID NO: 10166 - protein, 9 aa, BK virus
LQFLNPLLL

SEQ ID NO: 10167 - protein, 9 aa, BK virus
YQEYISPCI

SEQ ID NO: 10168 - protein, 9 aa, BK virus
QEYISPCIY

SEQ ID NO: 10169 - protein, 9 aa, BK virus
EYISPCIYY

SEQ ID NO: 10170 - protein, 9 aa, BK virus
YISPCIYYI

SEQ ID NO: 10171 - protein, 9 aa, BK virus
ISPCIYYIS

SEQ ID NO: 10172 - protein, 9 aa, BK virus
SPCIYYISS

SEQ ID NO: 10173 - protein, 9 aa, BK virus
PCIYYISSL

SEQ ID NO: 10174 - protein, 9 aa, BK virus
CIYYISSLK

SEQ ID NO: 10175 - protein, 9 aa, BK virus
IYYISSLKK

SEQ ID NO: 10176 - protein, 9 aa, BK virus
YYISSLKKY

SEQ ID NO: 10177 - protein, 9 aa, BK virus
YISSLKKYT

SEQ ID NO: 10178 - protein, 9 aa, BK virus
ISSLKKYTY

SEQ ID NO: 10179 - protein, 9 aa, BK virus
SSLKKYTYL

SEQ ID NO: 10180 - protein, 9 aa, BK virus
SLKKYTYLS

SEQ ID NO: 10181 - protein, 9 aa, BK virus
LKKYTYLSQ

SEQ ID NO: 10182 - protein, 9 aa, BK virus
KKYTYLSQN

SEQ ID NO: 10183 - protein, 9 aa, BK virus
KYTYLSQNP

SEQ ID NO: 10184 - protein, 9 aa, BK virus
YTYLSQNPA

SEQ ID NO: 10185 - protein, 9 aa, BK virus
TYLSQNPAF

SEQ ID NO: 10186 - protein, 9 aa, BK virus
YLSQNPAFP

SEQ ID NO: 10187 - protein, 9 aa, BK virus
LSQNPAFPS

SEQ ID NO: 10188 - protein, 9 aa, BK virus
SQNPAFPSI

SEQ ID NO: 10189 - protein, 9 aa, BK virus
QNPAFPSIQ

SEQ ID NO: 10190 - protein, 9 aa, BK virus
NPAFPSIQQ

SEQ ID NO: 10191 - protein, 9 aa, BK virus
PAFPSIQQF

SEQ ID NO: 10192 - protein, 9 aa, BK virus
IVYQLQNQL

SEQ ID NO: 10193 - protein, 9 aa, BK virus
VYQLQNQLQ

SEQ ID NO: 10194 - protein, 9 aa, BK virus
YQLQNQLQA

SEQ ID NO: 10195 - protein, 9 aa, BK virus
TKLAVATRS

SEQ ID NO: 10196 - protein, 9 aa, BK virus
KLAVATRSF

SEQ ID NO: 10197 - protein, 9 aa, BK virus
LAVATRSFH

SEQ ID NO: 10198 - protein, 9 aa, BK virus
AVATRSFHF

SEQ ID NO: 10199 - protein, 9 aa, BK virus
VATRSFHFV

SEQ ID NO: 10200 - protein, 9 aa, BK virus
ATRSFHFVK

SEQ ID NO: 10201 - protein, 9 aa, BK virus
TRSFHFVKF

SEQ ID NO: 10202 - protein, 9 aa, BK virus
RSFHFVKFF

SEQ ID NO: 10203 - protein, 9 aa, BK virus
SFHFVKFFF

SEQ ID NO: 10204 - protein, 9 aa, BK virus
FHFVKFFFQ

SEQ ID NO: 10205 - protein, 9 aa, BK virus
HFVKFFFQV

SEQ ID NO: 10206 - protein, 9 aa, BK virus
FVKFFFQVR

SEQ ID NO: 10207 - protein, 9 aa, BK virus
VKFFFQVRT

SEQ ID NO: 10208 - protein, 9 aa, BK virus
KFFFQVRTL

SEQ ID NO: 10209 - protein, 9 aa, BK virus
FFFQVRTLS

SEQ ID NO: 10210 - protein, 9 aa, BK virus
FFQVRTLSF

SEQ ID NO: 10211 - protein, 9 aa, BK virus
FQVRTLSFV

SEQ ID NO: 10212 - protein, 9 aa, BK virus
QVRTLSFVR

SEQ ID NO: 10213 - protein, 9 aa, BK virus
VRTLSFVRI

SEQ ID NO: 10214 - protein, 9 aa, BK virus
RTLSFVRIF

SEQ ID NO: 10215 - protein, 9 aa, BK virus
TLSFVRIFL

SEQ ID NO: 10216 - protein, 9 aa, BK virus
LSFVRIFLN

SEQ ID NO: 10217 - protein, 9 aa, BK virus
SFVRIFLNI

SEQ ID NO: 10218 - protein, 9 aa, BK virus
FVRIFLNIF

SEQ ID NO: 10219 - protein, 9 aa, BK virus
VRIFLNIFW

SEQ ID NO: 10220 - protein, 9 aa, BK virus
RIFLNIFWA

SEQ ID NO: 10221 - protein, 9 aa, BK virus
PSLVEIFGF

SEQ ID NO: 10222 - protein, 9 aa, BK virus
SLVEIFGFF

SEQ ID NO: 10223 - protein, 9 aa, BK virus
LVEIFGFFC

SEQ ID NO: 10224 - protein, 9 aa, BK virus
VEIFGFFCL

SEQ ID NO: 10225 - protein, 9 aa, BK virus
EIFGFFCLN

SEQ ID NO: 10226 - protein, 9 aa, BK virus
IFGFFCLNV

SEQ ID NO: 10227 - protein, 9 aa, BK virus
FGFFCLNVS

SEQ ID NO: 10228 - protein, 9 aa, BK virus
GFFCLNVSF

SEQ ID NO: 10229 - protein, 9 aa, BK virus
FFCLNVSFL

SEQ ID NO: 10230 - protein, 9 aa, BK virus
FCLNVSFLN

SEQ ID NO: 10231 - protein, 9 aa, BK virus
CLNVSFLNL

SEQ ID NO: 10232 - protein, 9 aa, BK virus
LNVSFLNLP

SEQ ID NO: 10233 - protein, 9 aa, BK virus
HFHLNNLSN

SEQ ID NO: 10234 - protein, 9 aa, BK virus
FHLNNLSNC

SEQ ID NO: 10235 - protein, 9 aa, BK virus
HLNNLSNCL

SEQ ID NO: 10236 - protein, 9 aa, BK virus
LNNLSNCLN

SEQ ID NO: 10237 - protein, 9 aa, BK virus
NNLSNCLNC

SEQ ID NO: 10238 - protein, 9 aa, BK virus
NLSNCLNCL

SEQ ID NO: 10239 - protein, 9 aa, BK virus
LSNCLNCLF

SEQ ID NO: 10240 - protein, 9 aa, BK virus
SNCLNCLFH

SEQ ID NO: 10241 - protein, 9 aa, BK virus
NCLNCLFHV

SEQ ID NO: 10242 - protein, 9 aa, BK virus
CLNCLFHVL

SEQ ID NO: 10243 - protein, 9 aa, BK virus
LNCLFHVLK

SEQ ID NO: 10244 - protein, 9 aa, BK virus
NCLFHVLKA

SEQ ID NO: 10245 - protein, 9 aa, BK virus
CLFHVLKAN

SEQ ID NO: 10246 - protein, 9 aa, BK virus
LFHVLKANP

SEQ ID NO: 10247 - protein, 9 aa, BK virus
FHVLKANPL

SEQ ID NO: 10248 - protein, 9 aa, BK virus
HVLKANPLI

SEQ ID NO: 10249 - protein, 9 aa, BK virus
VLKANPLIQ

SEQ ID NO: 10250 - protein, 9 aa, BK virus
LKANPLIQL

SEQ ID NO: 10251 - protein, 9 aa, BK virus
KANPLIQLL

SEQ ID NO: 10252 - protein, 9 aa, BK virus
ANPLIQLLS

SEQ ID NO: 10253 - protein, 9 aa, BK virus
NPLIQLLSL

SEQ ID NO: 10254 - protein, 9 aa, BK virus
PLIQLLSLL

SEQ ID NO: 10255 - protein, 9 aa, BK virus
LIQLLSLLH

SEQ ID NO: 10256 - protein, 9 aa, BK virus
IQLLSLLHL

SEQ ID NO: 10257 - protein, 9 aa, BK virus
QLLSLLHLQ

SEQ ID NO: 10258 - protein, 9 aa, BK virus
LLSLLHLQK

SEQ ID NO: 10259 - protein, 9 aa, BK virus
LSLLHLQKQ

SEQ ID NO: 10260 - protein, 9 aa, BK virus
SLLHLQKQP

SEQ ID NO: 10261 - protein, 9 aa, BK virus
LLHLQKQPC

SEQ ID NO: 10262 - protein, 9 aa, BK virus
LHLQKQPCT

SEQ ID NO: 10263 - protein, 9 aa, BK virus
HLQKQPCTD

SEQ ID NO: 10264 - protein, 9 aa, BK virus
LQKQPCTDL

SEQ ID NO: 10265 - protein, 9 aa, BK virus
LHLAQRLAF

SEQ ID NO: 10266 - protein, 9 aa, BK virus
HLAQRLAFP

SEQ ID NO: 10267 - protein, 9 aa, BK virus
LAQRLAFPW

SEQ ID NO: 10268 - protein, 9 aa, BK virus
AQRLAFPWV

SEQ ID NO: 10269 - protein, 9 aa, BK virus
QRLAFPWVG

SEQ ID NO: 10270 - protein, 9 aa, BK virus
RLAFPWVGL

SEQ ID NO: 10271 - protein, 9 aa, BK virus
LAFPWVGLH

SEQ ID NO: 10272 - protein, 9 aa, BK virus
AFPWVGLHL

SEQ ID NO: 10273 - protein, 9 aa, BK virus
FPWVGLHLR

SEQ ID NO: 10274 - protein, 9 aa, BK virus
PWVGLHLRL

SEQ ID NO: 10275 - protein, 9 aa, BK virus
WVGLHLRLY

SEQ ID NO: 10276 - protein, 9 aa, BK virus
VGLHLRLYH

SEQ ID NO: 10277 - protein, 9 aa, BK virus
GLHLRLYHH

SEQ ID NO: 10278 - protein, 9 aa, BK virus
LHLRLYHHT

SEQ ID NO: 10279 - protein, 9 aa, BK virus
HLRLYHHTN

SEQ ID NO: 10280 - protein, 9 aa, BK virus
LRLYHHTNL

SEQ ID NO: 10281 - protein, 9 aa, BK virus
RLYHHTNLI

SEQ ID NO: 10282 - protein, 9 aa, BK virus
LYHHTNLIT

SEQ ID NO: 10283 - protein, 9 aa, BK virus
YHHTNLITL

SEQ ID NO: 10284 - protein, 9 aa, BK virus
HHTNLITLQ

SEQ ID NO: 10285 - protein, 9 aa, BK virus
HTNLITLQL

SEQ ID NO: 10286 - protein, 9 aa, BK virus
TNLITLQLV

SEQ ID NO: 10287 - protein, 9 aa, BK virus
NLITLQLVL

SEQ ID NO: 10288 - protein, 9 aa, BK virus
LITLQLVLF

SEQ ID NO: 10289 - protein, 9 aa, BK virus
ITLQLVLFF

SEQ ID NO: 10290 - protein, 9 aa, BK virus
TLQLVLFFH

SEQ ID NO: 10291 - protein, 9 aa, BK virus
LQLVLFFHY

SEQ ID NO: 10292 - protein, 9 aa, BK virus
QLVLFFHYQ

SEQ ID NO: 10293 - protein, 9 aa, BK virus
LVLFFHYQW

SEQ ID NO: 10294 - protein, 9 aa, BK virus
VLFFHYQWD

SEQ ID NO: 10295 - protein, 9 aa, BK virus
LFFHYQWDL

SEQ ID NO: 10296 - protein, 9 aa, BK virus
KQYSAKNQI

SEQ ID NO: 10297 - protein, 9 aa, BK virus
QYSAKNQIL

SEQ ID NO: 10298 - protein, 9 aa, BK virus
YSAKNQILQ

SEQ ID NO: 10299 - protein, 9 aa, BK virus
SAKNQILQN

SEQ ID NO: 10300 - protein, 9 aa, BK virus
AKNQILQNP

SEQ ID NO: 10301 - protein, 9 aa, BK virus
KNQILQNPF

SEQ ID NO: 10302 - protein, 9 aa, BK virus
VANSAAKQH

SEQ ID NO: 10303 - protein, 9 aa, BK virus
ANSAAKQHL

SEQ ID NO: 10304 - protein, 9 aa, BK virus
NSAAKQHLP

SEQ ID NO: 10305 - protein, 9 aa, BK virus
SAAKQHLPY

SEQ ID NO: 10306 - protein, 9 aa, BK virus
AAKQHLPYI

SEQ ID NO: 10307 - protein, 9 aa, BK virus
AKQHLPYIV

SEQ ID NO: 10308 - protein, 9 aa, BK virus
KQHLPYIVL

SEQ ID NO: 10309 - protein, 9 aa, BK virus
QHLPYIVLV

SEQ ID NO: 10310 - protein, 9 aa, BK virus
HLPYIVLVQ

SEQ ID NO: 10311 - protein, 9 aa, BK virus
LPYIVLVQH

SEQ ID NO: 10312 - protein, 9 aa, BK virus
PYIVLVQHF

SEQ ID NO: 10313 - protein, 9 aa, BK virus
YIVLVQHFH

SEQ ID NO: 10314 - protein, 9 aa, BK virus
IVLVQHFHE

SEQ ID NO: 10315 - protein, 9 aa, BK virus
VLVQHFHEL

SEQ ID NO: 10316 - protein, 9 aa, BK virus
LVQHFHELQ

SEQ ID NO: 10317 - protein, 9 aa, BK virus
VQHFHELQI

SEQ ID NO: 10318 - protein, 9 aa, BK virus
QHFHELQIL

SEQ ID NO: 10319 - protein, 9 aa, BK virus
HFHELQILN

SEQ ID NO: 10320 - protein, 9 aa, BK virus
FHELQILNP

SEQ ID NO: 10321 - protein, 9 aa, BK virus
HELQILNPF

SEQ ID NO: 10322 - protein, 9 aa, BK virus
ELQILNPFY

SEQ ID NO: 10323 - protein, 9 aa, BK virus
LQILNPFYL

SEQ ID NO: 10324 - protein, 9 aa, BK virus
QILNPFYLI

SEQ ID NO: 10325 - protein, 9 aa, BK virus
ILNPFYLIY

SEQ ID NO: 10326 - protein, 9 aa, BK virus
LNPFYLIYD

SEQ ID NO: 10327 - protein, 9 aa, BK virus
IFLLAFLPW

SEQ ID NO: 10328 - protein, 9 aa, BK virus
FLLAFLPWS

SEQ ID NO: 10329 - protein, 9 aa, BK virus
LLAFLPWSY

SEQ ID NO: 10330 - protein, 9 aa, BK virus
LAFLPWSYE

SEQ ID NO: 10331 - protein, 9 aa, BK virus
AFLPWSYEG

SEQ ID NO: 10332 - protein, 9 aa, BK virus
FLPWSYEGY

SEQ ID NO: 10333 - protein, 9 aa, BK virus
LPWSYEGYL

SEQ ID NO: 10334 - protein, 9 aa, BK virus
PWSYEGYLL

SEQ ID NO: 10335 - protein, 9 aa, BK virus
WSYEGYLLF

SEQ ID NO: 10336 - protein, 9 aa, BK virus
SYEGYLLFF

SEQ ID NO: 10337 - protein, 9 aa, BK virus
LKLYLLLAD

SEQ ID NO: 10338 - protein, 9 aa, BK virus
KLYLLLADK

SEQ ID NO: 10339 - protein, 9 aa, BK virus
LYLLLADKY

SEQ ID NO: 10340 - protein, 9 aa, BK virus
YLLLADKYF

SEQ ID NO: 10341 - protein, 9 aa, BK virus
LLLADKYFF

SEQ ID NO: 10342 - protein, 9 aa, BK virus
LLADKYFFD

SEQ ID NO: 10343 - protein, 9 aa, BK virus
LADKYFFDF

SEQ ID NO: 10344 - protein, 9 aa, BK virus
ADKYFFDFY

SEQ ID NO: 10345 - protein, 9 aa, BK virus
DKYFFDFYF

SEQ ID NO: 10346 - protein, 9 aa, BK virus
KYFFDFYFL

SEQ ID NO: 10347 - protein, 9 aa, BK virus
YFFDFYFLQ

SEQ ID NO: 10348 - protein, 9 aa, BK virus
FFDFYFLQK

SEQ ID NO: 10349 - protein, 9 aa, BK virus
HLQSAFHDT

SEQ ID NO: 10350 - protein, 9 aa, BK virus
SDKAGLFSD

SEQ ID NO: 10351 - protein, 9 aa, BK virus
DKAGLFSDT

SEQ ID NO: 10352 - protein, 9 aa, BK virus
KAGLFSDTF

SEQ ID NO: 10353 - protein, 9 aa, BK virus
AGLFSDTFY

SEQ ID NO: 10354 - protein, 9 aa, BK virus
GLFSDTFYT

SEQ ID NO: 10355 - protein, 9 aa, BK virus
LFSDTFYTP

SEQ ID NO: 10356 - protein, 9 aa, BK virus
FSDTFYTPL

SEQ ID NO: 10357 - protein, 9 aa, BK virus
SDTFYTPLH

SEQ ID NO: 10358 - protein, 9 aa, BK virus
DTFYTPLHC

SEQ ID NO: 10359 - protein, 9 aa, BK virus
TFYTPLHCI

SEQ ID NO: 10360 - protein, 9 aa, BK virus
FYTPLHCIE

SEQ ID NO: 10361 - protein, 9 aa, BK virus
YTPLHCIEI

SEQ ID NO: 10362 - protein, 9 aa, BK virus
TPLHCIEIL

SEQ ID NO: 10363 - protein, 9 aa, BK virus
PLHCIEILN

SEQ ID NO: 10364 - protein, 9 aa, BK virus
LHCIEILNT

SEQ ID NO: 10365 - protein, 9 aa, BK virus
HCIEILNTY

SEQ ID NO: 10366 - protein, 9 aa, BK virus
CIEILNTYL

SEQ ID NO: 10367 - protein, 9 aa, BK virus
IEILNTYLI

SEQ ID NO: 10368 - protein, 9 aa, BK virus
EILNTYLII

SEQ ID NO: 10369 - protein, 9 aa, BK virus
ILNTYLIIK

SEQ ID NO: 10370 - protein, 9 aa, BK virus
LNTYLIIKT

SEQ ID NO: 10371 - protein, 9 aa, BK virus
NTYLIIKTH

SEQ ID NO: 10372 - protein, 9 aa, BK virus
TYLIIKTHP

SEQ ID NO: 10373 - protein, 9 aa, BK virus
YLIIKTHPH

SEQ ID NO: 10374 - protein, 9 aa, BK virus
LIIKTHPHT

SEQ ID NO: 10375 - protein, 9 aa, BK virus
IIKTHPHTL

SEQ ID NO: 10376 - protein, 9 aa, BK virus
IKTHPHTLS

SEQ ID NO: 10377 - protein, 9 aa, BK virus
KTHPHTLSL

SEQ ID NO: 10378 - protein, 9 aa, BK virus
THPHTLSLL

SEQ ID NO: 10379 - protein, 9 aa, BK virus
HPHTLSLLH

SEQ ID NO: 10380 - protein, 9 aa, BK virus
PHTLSLLHT

SEQ ID NO: 10381 - protein, 9 aa, BK virus
HTLSLLHTQ

SEQ ID NO: 10382 - protein, 9 aa, BK virus
LISKTPALF

SEQ ID NO: 10383 - protein, 9 aa, BK virus
ISKTPALFL

SEQ ID NO: 10384 - protein, 9 aa, BK virus
SKTPALFLQ

SEQ ID NO: 10385 - protein, 9 aa, BK virus
KTPALFLQA

SEQ ID NO: 10386 - protein, 9 aa, BK virus
TPALFLQAL

SEQ ID NO: 10387 - protein, 9 aa, BK virus
PALFLQALL

SEQ ID NO: 10388 - protein, 9 aa, BK virus
ALFLQALLG

SEQ ID NO: 10389 - protein, 9 aa, BK virus
NHAPLSPLE

SEQ ID NO: 10390 - protein, 9 aa, BK virus
HAPLSPLEC

SEQ ID NO: 10391 - protein, 9 aa, BK virus
APLSPLECF

SEQ ID NO: 10392 - protein, 9 aa, BK virus
PLSPLECFL

SEQ ID NO: 10393 - protein, 9 aa, BK virus
LSPLECFLL

SEQ ID NO: 10394 - protein, 9 aa, BK virus
LRHYIVSIP

SEQ ID NO: 10395 - protein, 9 aa, BK virus
RHYIVSIPY

SEQ ID NO: 10396 - protein, 9 aa, BK virus
RYTAFDRNY

SEQ ID NO: 10397 - protein, 9 aa, BK virus
LQKLYVYVE

SEQ ID NO: 10398 - protein, 9 aa, BK virus
QKLYVYVEL

SEQ ID NO: 10399 - protein, 9 aa, BK virus
KLYVYVELK

SEQ ID NO: 10400 - protein, 9 aa, BK virus
LYVYVELKR

SEQ ID NO: 10401 - protein, 9 aa, BK virus
YVYVELKRI

SEQ ID NO: 10402 - protein, 9 aa, BK virus
YYAQHTCVY

SEQ ID NO: 10403 - protein, 9 aa, BK virus
VFYTEFELF

SEQ ID NO: 10404 - protein, 9 aa, BK virus
FYTEFELFL

SEQ ID NO: 10405 - protein, 9 aa, BK virus
YTQQSRQGF

SEQ ID NO: 10406 - protein, 9 aa, BK virus
TQQSRQGFY

SEQ ID NO: 10407 - protein, 9 aa, BK virus
QQSRQGFYY

SEQ ID NO: 10408 - protein, 9 aa, BK virus
ETGVDQRES

SEQ ID NO: 10409 - protein, 9 aa, BK virus
TGVDQRESL

SEQ ID NO: 10410 - protein, 9 aa, BK virus
GLLPFFFFW

SEQ ID NO: 10411 - protein, 9 aa, BK virus
LLPFFFFWV

SEQ ID NO: 10412 - protein, 9 aa, BK virus
LPFFFFWVV

SEQ ID NO: 10413 - protein, 9 aa, BK virus
PFFFFWVVL

SEQ ID NO: 10414 - protein, 9 aa, BK virus
FFFFWVVLS

SEQ ID NO: 10415 - protein, 9 aa, BK virus
FFFWVVLSV

SEQ ID NO: 10416 - protein, 9 aa, BK virus
FFWVVLSVE

SEQ ID NO: 10417 - protein, 9 aa, BK virus
FWVVLSVEN

SEQ ID NO: 10418 - protein, 9 aa, BK virus
WVVLSVENL

SEQ ID NO: 10419 - protein, 9 aa, BK virus
VVLSVENLL

SEQ ID NO: 10420 - protein, 9 aa, BK virus
VLSVENLLL

SEQ ID NO: 10421 - protein, 9 aa, BK virus
LSVENLLLL

SEQ ID NO: 10422 - protein, 9 aa, BK virus
SVENLLLLL

SEQ ID NO: 10423 - protein, 9 aa, BK virus
VENLLLLLH

SEQ ID NO: 10424 - protein, 9 aa, BK virus
ENLLLLLHH

SEQ ID NO: 10425 - protein, 9 aa, BK virus
NLLLLLHHW

SEQ ID NO: 10426 - protein, 9 aa, BK virus
LLLLLHHWQ

SEQ ID NO: 10427 - protein, 9 aa, BK virus
LLLLHHWQT

SEQ ID NO: 10428 - protein, 9 aa, BK virus
LLLHHWQTY

SEQ ID NO: 10429 - protein, 9 aa, BK virus
LLHHWQTYL

SEQ ID NO: 10430 - protein, 9 aa, BK virus
LHHWQTYLH

SEQ ID NO: 10431 - protein, 9 aa, BK virus
HHWQTYLHG

SEQ ID NO: 10432 - protein, 9 aa, BK virus
HWQTYLHGK

SEQ ID NO: 10433 - protein, 9 aa, BK virus
WQTYLHGKI

SEQ ID NO: 10434 - protein, 9 aa, BK virus
QTYLHGKIN

SEQ ID NO: 10435 - protein, 9 aa, BK virus
TYLHGKINL

SEQ ID NO: 10436 - protein, 9 aa, BK virus
YLHGKINLH

SEQ ID NO: 10437 - protein, 9 aa, BK virus
LHGKINLHP

SEQ ID NO: 10438 - protein, 9 aa, BK virus
HGKINLHPI

SEQ ID NO: 10439 - protein, 9 aa, BK virus
GKINLHPIF

SEQ ID NO: 10440 - protein, 9 aa, BK virus
KINLHPIFH

SEQ ID NO: 10441 - protein, 9 aa, BK virus
RNSTRTPTL

SEQ ID NO: 10442 - protein, 9 aa, BK virus
NSTRTPTLL

SEQ ID NO: 10443 - protein, 9 aa, BK virus
STRTPTLLF

SEQ ID NO: 10444 - protein, 9 aa, BK virus
TRTPTLLFH

SEQ ID NO: 10445 - protein, 9 aa, BK virus
RTPTLLFHR

SEQ ID NO: 10446 - protein, 9 aa, BK virus
TPTLLFHRL

SEQ ID NO: 10447 - protein, 9 aa, BK virus
PTLLFHRLA

SEQ ID NO: 10448 - protein, 9 aa, BK virus
TLLFHRLAP

SEQ ID NO: 10449 - protein, 9 aa, BK virus
LLFHRLAPI

SEQ ID NO: 10450 - protein, 9 aa, BK virus
LFHRLAPIK

SEQ ID NO: 10451 - protein, 9 aa, BK virus
FHRLAPIKK

SEQ ID NO: 10452 - protein, 9 aa, BK virus
HRLAPIKKI

SEQ ID NO: 10453 - protein, 9 aa, BK virus
RLAPIKKII

SEQ ID NO: 10454 - protein, 9 aa, BK virus
LAPIKKIIT

SEQ ID NO: 10455 - protein, 9 aa, BK virus
GLLIFYYLS

SEQ ID NO: 10456 - protein, 9 aa, BK virus
LLIFYYLSK

SEQ ID NO: 10457 - protein, 9 aa, BK virus
LIFYYLSKY

SEQ ID NO: 10458 - protein, 9 aa, BK virus
IFYYLSKYK

SEQ ID NO: 10459 - protein, 9 aa, BK virus
FYYLSKYKL

SEQ ID NO: 10460 - protein, 9 aa, BK virus
YYLSKYKLV

SEQ ID NO: 10461 - protein, 9 aa, BK virus
YLSKYKLVT

SEQ ID NO: 10462 - protein, 9 aa, BK virus
LSKYKLVTL

SEQ ID NO: 10463 - protein, 9 aa, BK virus
SKYKLVTLK

SEQ ID NO: 10464 - protein, 9 aa, BK virus
KYKLVTLKL

SEQ ID NO: 10465 - protein, 9 aa, BK virus
ISEGSFSNY

SEQ ID NO: 10466 - protein, 9 aa, BK virus
SEGSFSNYL

SEQ ID NO: 10467 - protein, 9 aa, BK virus
EGSFSNYLD

SEQ ID NO: 10468 - protein, 9 aa, BK virus
GSFSNYLDP

SEQ ID NO: 10469 - protein, 9 aa, BK virus
SFSNYLDPP

SEQ ID NO: 10470 - protein, 9 aa, BK virus
FSNYLDPPL

SEQ ID NO: 10471 - protein, 9 aa, BK virus
SNYLDPPLQ

SEQ ID NO: 10472 - protein, 9 aa, BK virus
NYLDPPLQS

SEQ ID NO: 10473 - protein, 9 aa, BK virus
YLDPPLQSF

SEQ ID NO: 10474 - protein, 9 aa, BK virus
LDPPLQSFF

SEQ ID NO: 10475 - protein, 9 aa, BK virus
DPPLQSFFS

SEQ ID NO: 10476 - protein, 9 aa, BK virus
AKPLCEAVN

SEQ ID NO: 10477 - protein, 9 aa, BK virus
KPLCEAVNA

SEQ ID NO: 10478 - protein, 9 aa, BK virus
PLCEAVNAV

SEQ ID NO: 10479 - protein, 9 aa, BK virus
LCEAVNAVA

SEQ ID NO: 10480 - protein, 9 aa, BK virus
CEAVNAVAI

SEQ ID NO: 10481 - protein, 9 aa, BK virus
EAVNAVAIY

SEQ ID NO: 10482 - protein, 9 aa, BK virus
AVNAVAIYP

SEQ ID NO: 10483 - protein, 9 aa, BK virus
VNAVAIYPN

SEQ ID NO: 10484 - protein, 9 aa, BK virus
NAVAIYPNQ

SEQ ID NO: 10485 - protein, 9 aa, BK virus
AVAIYPNQG

SEQ ID NO: 10486 - protein, 9 aa, BK virus
VAIYPNQGL

SEQ ID NO: 10487 - protein, 9 aa, BK virus
AIYPNQGLF

SEQ ID NO: 10488 - protein, 9 aa, BK virus
IYPNQGLFS

SEQ ID NO: 10489 - protein, 9 aa, BK virus
HARAVHRRL

SEQ ID NO: 10490 - protein, 9 aa, BK virus
ARAVHRRLF

SEQ ID NO: 10491 - protein, 9 aa, BK virus
RAVHRRLFG

SEQ ID NO: 10492 - protein, 9 aa, BK virus
AVHRRLFGT

SEQ ID NO: 10493 - protein, 9 aa, BK virus
VHRRLFGTN

SEQ ID NO: 10494 - protein, 9 aa, BK virus
HRRLFGTNR

SEQ ID NO: 10495 - protein, 9 aa, BK virus
RRLFGTNRP

SEQ ID NO: 10496 - protein, 9 aa, BK virus
RLFGTNRPF

SEQ ID NO: 10497 - protein, 9 aa, BK virus
LFGTNRPFL

SEQ ID NO: 10498 - protein, 9 aa, BK virus
FGTNRPFLA

SEQ ID NO: 10499 - protein, 9 aa, BK virus
GTNRPFLAV

SEQ ID NO: 10500 - protein, 9 aa, BK virus
TNRPFLAVQ

SEQ ID NO: 10501 - protein, 9 aa, BK virus
NRPFLAVQG

SEQ ID NO: 10502 - protein, 9 aa, BK virus
RPFLAVQGI

SEQ ID NO: 10503 - protein, 9 aa, BK virus
PFLAVQGIW

SEQ ID NO: 10504 - protein, 9 aa, BK virus
FLAVQGIWA

SEQ ID NO: 10505 - protein, 9 aa, BK virus
LAVQGIWAK

SEQ ID NO: 10506 - protein, 9 aa, BK virus
AVQGIWAKR

SEQ ID NO: 10507 - protein, 9 aa, BK virus
VQGIWAKRK

SEQ ID NO: 10508 - protein, 9 aa, BK virus
QGIWAKRKI

SEQ ID NO: 10509 - protein, 9 aa, BK virus
GIWAKRKIS

SEQ ID NO: 10510 - protein, 9 aa, BK virus
IWAKRKIST

SEQ ID NO: 10511 - protein, 9 aa, BK virus
WAKRKISTN

SEQ ID NO: 10512 - protein, 9 aa, BK virus
AKRKISTNL

SEQ ID NO: 10513 - protein, 9 aa, BK virus
ATPGSKIRL

SEQ ID NO: 10514 - protein, 9 aa, BK virus
TPGSKIRLM

SEQ ID NO: 10515 - protein, 9 aa, BK virus
PGSKIRLMS

SEQ ID NO: 10516 - protein, 9 aa, BK virus
GSKIRLMSY

SEQ ID NO: 10517 - protein, 9 aa, BK virus
SKIRLMSYL

SEQ ID NO: 10518 - protein, 9 aa, BK virus
KIRLMSYLY

SEQ ID NO: 10519 - protein, 9 aa, BK virus
IRLMSYLYI

SEQ ID NO: 10520 - protein, 9 aa, BK virus
RLMSYLYIL

SEQ ID NO: 10521 - protein, 9 aa, BK virus
LMSYLYILL

SEQ ID NO: 10522 - protein, 9 aa, BK virus
MSYLYILLH

SEQ ID NO: 10523 - protein, 9 aa, BK virus
SYLYILLHF

SEQ ID NO: 10524 - protein, 9 aa, BK virus
YLYILLHFF

SEQ ID NO: 10525 - protein, 9 aa, BK virus
LYILLHFFI

SEQ ID NO: 10526 - protein, 9 aa, BK virus
YILLHFFIQ

SEQ ID NO: 10527 - protein, 9 aa, BK virus
ILLHFFIQS

SEQ ID NO: 10528 - protein, 9 aa, BK virus
LLHFFIQSI

SEQ ID NO: 10529 - protein, 9 aa, BK virus
LHFFIQSIH

SEQ ID NO: 10530 - protein, 9 aa, BK virus
HFFIQSIHS

SEQ ID NO: 10531 - protein, 9 aa, BK virus
FFIQSIHSL

SEQ ID NO: 10532 - protein, 9 aa, BK virus
FIQSIHSLH

SEQ ID NO: 10533 - protein, 9 aa, BK virus
IQSIHSLHF

SEQ ID NO: 10534 - protein, 9 aa, BK virus
QSIHSLHFI

SEQ ID NO: 10535 - protein, 9 aa, BK virus
SIHSLHFIL

SEQ ID NO: 10536 - protein, 9 aa, BK virus
IHSLHFILV

SEQ ID NO: 10537 - protein, 9 aa, BK virus
HSLHFILVA

SEQ ID NO: 10538 - protein, 9 aa, BK virus
SLHFILVAP

SEQ ID NO: 10539 - protein, 9 aa, BK virus
LHFILVAPF

SEQ ID NO: 10540 - protein, 9 aa, BK virus
HFILVAPFV

SEQ ID NO: 10541 - protein, 9 aa, BK virus
FILVAPFVR

SEQ ID NO: 10542 - protein, 9 aa, BK virus
ILVAPFVRV

SEQ ID NO: 10543 - protein, 9 aa, BK virus
LVAPFVRVK

SEQ ID NO: 10544 - protein, 9 aa, BK virus
VAPFVRVKF

SEQ ID NO: 10545 - protein, 9 aa, BK virus
APFVRVKFL

SEQ ID NO: 10546 - protein, 9 aa, BK virus
PFVRVKFLT

SEQ ID NO: 10547 - protein, 9 aa, BK virus
FVRVKFLTL

SEQ ID NO: 10548 - protein, 9 aa, BK virus
VRVKFLTLP

SEQ ID NO: 10549 - protein, 9 aa, BK virus
GKISPGSSF

SEQ ID NO: 10550 - protein, 9 aa, BK virus
KISPGSSFK

SEQ ID NO: 10551 - protein, 9 aa, BK virus
ISPGSSFKA

SEQ ID NO: 10552 - protein, 9 aa, BK virus
KVHELHGFF

SEQ ID NO: 10553 - protein, 9 aa, BK virus
VHELHGFFP

SEQ ID NO: 10554 - protein, 9 aa, BK virus
HELHGFFPV

SEQ ID NO: 10555 - protein, 9 aa, BK virus
ELHGFFPVK

SEQ ID NO: 10556 - protein, 9 aa, BK virus
LHGFFPVKN

SEQ ID NO: 10557 - protein, 9 aa, BK virus
HGFFPVKNF

SEQ ID NO: 10558 - protein, 9 aa, BK virus
GFFPVKNFI

SEQ ID NO: 10559 - protein, 9 aa, BK virus
FFPVKNFIH

SEQ ID NO: 10560 - protein, 10 aa, BK virus
LQKLQKNRDF

SEQ ID NO: 10561 - protein, 10 aa, BK virus
QKLQKNRDFP

SEQ ID NO: 10562 - protein, 10 aa, BK virus
KLQKNRDFPK

SEQ ID NO: 10563 - protein, 10 aa, BK virus
ASEKASTPLL

SEQ ID NO: 10564 - protein, 10 aa, BK virus
SEKASTPLLL

SEQ ID NO: 10565 - protein, 10 aa, BK virus
EKASTPLLLE

SEQ ID NO: 10566 - protein, 10 aa, BK virus
KASTPLLLER

SEQ ID NO: 10567 - protein, 10 aa, BK virus
ASTPLLLERK

SEQ ID NO: 10568 - protein, 10 aa, BK virus
STPLLLERKG

SEQ ID NO: 10569 - protein, 10 aa, BK virus
TPLLLERKGG

SEQ ID NO: 10570 - protein, 10 aa, BK virus
PLLLERKGGG

SEQ ID NO: 10571 - protein, 10 aa, BK virus
LLLERKGGGR

SEQ ID NO: 10572 - protein, 10 aa, BK virus
LLERKGGGRG

SEQ ID NO: 10573 - protein, 10 aa, BK virus
LERKGGGRGG

SEQ ID NO: 10574 - protein, 10 aa, BK virus
ERKGGGRGGL

SEQ ID NO: 10575 - protein, 10 aa, BK virus
RKGGGRGGLG

SEQ ID NO: 10576 - protein, 10 aa, BK virus
KGGGRGGLGL

SEQ ID NO: 10577 - protein, 10 aa, BK virus
GGGRGGLGLL

SEQ ID NO: 10578 - protein, 10 aa, BK virus
GGRGGLGLLY

SEQ ID NO: 10579 - protein, 10 aa, BK virus
GRGGLGLLYI

SEQ ID NO: 10580 - protein, 10 aa, BK virus
RGGLGLLYII

SEQ ID NO: 10581 - protein, 10 aa, BK virus
GGLGLLYIIK

SEQ ID NO: 10582 - protein, 10 aa, BK virus
GLGLLYIIKK

SEQ ID NO: 10583 - protein, 10 aa, BK virus
LGLLYIIKKK

SEQ ID NO: 10584 - protein, 10 aa, BK virus
GLLYIIKKKA

SEQ ID NO: 10585 - protein, 10 aa, BK virus
LLYIIKKKAT

SEQ ID NO: 10586 - protein, 10 aa, BK virus
LYIIKKKATG

SEQ ID NO: 10587 - protein, 10 aa, BK virus
YIIKKKATGR

SEQ ID NO: 10588 - protein, 10 aa, BK virus
IIKKKATGRS

SEQ ID NO: 10589 - protein, 10 aa, BK virus
IKKKATGRSC

SEQ ID NO: 10590 - protein, 10 aa, BK virus
KKKATGRSCL

SEQ ID NO: 10591 - protein, 10 aa, BK virus
KKATGRSCLP

SEQ ID NO: 10592 - protein, 10 aa, BK virus
KATGRSCLPM

SEQ ID NO: 10593 - protein, 10 aa, BK virus
ATGRSCLPME

SEQ ID NO: 10594 - protein, 10 aa, BK virus
TGRSCLPMEC

SEQ ID NO: 10595 - protein, 10 aa, BK virus
GRSCLPMECS

SEQ ID NO: 10596 - protein, 10 aa, BK virus
RSCLPMECSQ

SEQ ID NO: 10597 - protein, 10 aa, BK virus
SCLPMECSQT

SEQ ID NO: 10598 - protein, 10 aa, BK virus
CLPMECSQTM

SEQ ID NO: 10599 - protein, 10 aa, BK virus
LPMECSQTMT

SEQ ID NO: 10600 - protein, 10 aa, BK virus
PMECSQTMTS

SEQ ID NO: 10601 - protein, 10 aa, BK virus
MECSQTMTSG

SEQ ID NO: 10602 - protein, 10 aa, BK virus
ECSQTMTSGR

SEQ ID NO: 10603 - protein, 10 aa, BK virus
CSQTMTSGRK

SEQ ID NO: 10604 - protein, 10 aa, BK virus
SQTMTSGRKV

SEQ ID NO: 10605 - protein, 10 aa, BK virus
QTMTSGRKVH

SEQ ID NO: 10606 - protein, 10 aa, BK virus
TMTSGRKVHD

SEQ ID NO: 10607 - protein, 10 aa, BK virus
MTSGRKVHDS

SEQ ID NO: 10608 - protein, 10 aa, BK virus
TSGRKVHDSQ

SEQ ID NO: 10609 - protein, 10 aa, BK virus
SGRKVHDSQG

SEQ ID NO: 10610 - protein, 10 aa, BK virus
GRKVHDSQGN

SEQ ID NO: 10611 - protein, 10 aa, BK virus
RKVHDSQGNA

SEQ ID NO: 10612 - protein, 10 aa, BK virus
KVHDSQGNAA

SEQ ID NO: 10613 - protein, 10 aa, BK virus
VHDSQGNAAK

SEQ ID NO: 10614 - protein, 10 aa, BK virus
HDSQGNAAKP

SEQ ID NO: 10615 - protein, 10 aa, BK virus
PQEGKCMTHR

SEQ ID NO: 10616 - protein, 10 aa, BK virus
QEGKCMTHRE

SEQ ID NO: 10617 - protein, 10 aa, BK virus
EGKCMTHREE

SEQ ID NO: 10618 - protein, 10 aa, BK virus
GKCMTHREEL

SEQ ID NO: 10619 - protein, 10 aa, BK virus
KCMTHREELL

SEQ ID NO: 10620 - protein, 10 aa, BK virus
CMTHREELLT

SEQ ID NO: 10621 - protein, 10 aa, BK virus
MTHREELLTH

SEQ ID NO: 10622 - protein, 10 aa, BK virus
THREELLTHG

SEQ ID NO: 10623 - protein, 10 aa, BK virus
HREELLTHGM

SEQ ID NO: 10624 - protein, 10 aa, BK virus
REELLTHGMQ

SEQ ID NO: 10625 - protein, 10 aa, BK virus
EELLTHGMQP

SEQ ID NO: 10626 - protein, 10 aa, BK virus
ELLTHGMQPN

SEQ ID NO: 10627 - protein, 10 aa, BK virus
LLTHGMQPNH

SEQ ID NO: 10628 - protein, 10 aa, BK virus
LTHGMQPNHD

SEQ ID NO: 10629 - protein, 10 aa, BK virus
THGMQPNHDL

SEQ ID NO: 10630 - protein, 10 aa, BK virus
HGMQPNHDLR

SEQ ID NO: 10631 - protein, 10 aa, BK virus
GMQPNHDLRK

SEQ ID NO: 10632 - protein, 10 aa, BK virus
MQPNHDLRKE

SEQ ID NO: 10633 - protein, 10 aa, BK virus
QPNHDLRKES

SEQ ID NO: 10634 - protein, 10 aa, BK virus
PNHDLRKESA

SEQ ID NO: 10635 - protein, 10 aa, BK virus
QTCFASLGIL

SEQ ID NO: 10636 - protein, 10 aa, BK virus
TCFASLGILA

SEQ ID NO: 10637 - protein, 10 aa, BK virus
CFASLGILAL

SEQ ID NO: 10638 - protein, 10 aa, BK virus
FASLGILALS

SEQ ID NO: 10639 - protein, 10 aa, BK virus
ASLGILALSP

SEQ ID NO: 10640 - protein, 10 aa, BK virus
SLGILALSPV

SEQ ID NO: 10641 - protein, 10 aa, BK virus
LGILALSPVK

SEQ ID NO: 10642 - protein, 10 aa, BK virus
GILALSPVKL

SEQ ID NO: 10643 - protein, 10 aa, BK virus
ILALSPVKLD

SEQ ID NO: 10644 - protein, 10 aa, BK virus
LALSPVKLDK

SEQ ID NO: 10645 - protein, 10 aa, BK virus
ALSPVKLDKG

SEQ ID NO: 10646 - protein, 10 aa, BK virus
LSPVKLDKGH

SEQ ID NO: 10647 - protein, 10 aa, BK virus
SPVKLDKGHG

SEQ ID NO: 10648 - protein, 10 aa, BK virus
PVKLDKGHGS

SEQ ID NO: 10649 - protein, 10 aa, BK virus
VKLDKGHGSA

SEQ ID NO: 10650 - protein, 10 aa, BK virus
KLDKGHGSAP

SEQ ID NO: 10651 - protein, 10 aa, BK virus
LDKGHGSAPA

SEQ ID NO: 10652 - protein, 10 aa, BK virus
DKGHGSAPAV

SEQ ID NO: 10653 - protein, 10 aa, BK virus
KGHGSAPAVT

SEQ ID NO: 10654 - protein, 10 aa, BK virus
GHGSAPAVTT

SEQ ID NO: 10655 - protein, 10 aa, BK virus
HGSAPAVTTS

SEQ ID NO: 10656 - protein, 10 aa, BK virus
GSAPAVTTSF

SEQ ID NO: 10657 - protein, 10 aa, BK virus
SAPAVTTSFS

SEQ ID NO: 10658 - protein, 10 aa, BK virus
APAVTTSFSE

SEQ ID NO: 10659 - protein, 10 aa, BK virus
PAVTTSFSES

SEQ ID NO: 10660 - protein, 10 aa, BK virus
AVTTSFSESW

SEQ ID NO: 10661 - protein, 10 aa, BK virus
NLDWNKKKSS

SEQ ID NO: 10662 - protein, 10 aa, BK virus
LDWNKKKSSE

SEQ ID NO: 10663 - protein, 10 aa, BK virus
DWNKKKSSED

SEQ ID NO: 10664 - protein, 10 aa, BK virus
WNKKKSSEDF

SEQ ID NO: 10665 - protein, 10 aa, BK virus
NKKKSSEDFY

SEQ ID NO: 10666 - protein, 10 aa, BK virus
KKKSSEDFYF

SEQ ID NO: 10667 - protein, 10 aa, BK virus
KKSSEDFYFY

SEQ ID NO: 10668 - protein, 10 aa, BK virus
KSSEDFYFYF

SEQ ID NO: 10669 - protein, 10 aa, BK virus
SSEDFYFYFR

SEQ ID NO: 10670 - protein, 10 aa, BK virus
SEDFYFYFRA

SEQ ID NO: 10671 - protein, 10 aa, BK virus
EDFYFYFRAF

SEQ ID NO: 10672 - protein, 10 aa, BK virus
DFYFYFRAFA

SEQ ID NO: 10673 - protein, 10 aa, BK virus
FYFYFRAFAG

SEQ ID NO: 10674 - protein, 10 aa, BK virus
YFYFRAFAGI

SEQ ID NO: 10675 - protein, 10 aa, BK virus
FYFRAFAGIL

SEQ ID NO: 10676 - protein, 10 aa, BK virus
RQCRREKQKY

SEQ ID NO: 10677 - protein, 10 aa, BK virus
QCRREKQKYH

SEQ ID NO: 10678 - protein, 10 aa, BK virus
CRREKQKYHC

SEQ ID NO: 10679 - protein, 10 aa, BK virus
RREKQKYHCF

SEQ ID NO: 10680 - protein, 10 aa, BK virus
REKQKYHCFT

SEQ ID NO: 10681 - protein, 10 aa, BK virus
EKQKYHCFTC

SEQ ID NO: 10682 - protein, 10 aa, BK virus
KQKYHCFTCC

SEQ ID NO: 10683 - protein, 10 aa, BK virus
QKYHCFTCCK

SEQ ID NO: 10684 - protein, 10 aa, BK virus
KYHCFTCCKR

SEQ ID NO: 10685 - protein, 10 aa, BK virus
YHCFTCCKRL

SEQ ID NO: 10686 - protein, 10 aa, BK virus
HCFTCCKRLC

SEQ ID NO: 10687 - protein, 10 aa, BK virus
CFTCCKRLCK

SEQ ID NO: 10688 - protein, 10 aa, BK virus
FTCCKRLCKR

SEQ ID NO: 10689 - protein, 10 aa, BK virus
TCCKRLCKRL

SEQ ID NO: 10690 - protein, 10 aa, BK virus
CCKRLCKRLL

SEQ ID NO: 10691 - protein, 10 aa, BK virus
CKRLCKRLLG

SEQ ID NO: 10692 - protein, 10 aa, BK virus
KRLCKRLLGK

SEQ ID NO: 10693 - protein, 10 aa, BK virus
SLFFCISRFM

SEQ ID NO: 10694 - protein, 10 aa, BK virus
LFFCISRFMG

SEQ ID NO: 10695 - protein, 10 aa, BK virus
FFCISRFMGA

SEQ ID NO: 10696 - protein, 10 aa, BK virus
FCISRFMGAA

SEQ ID NO: 10697 - protein, 10 aa, BK virus
CISRFMGAAL

SEQ ID NO: 10698 - protein, 10 aa, BK virus
ISRFMGAALA

SEQ ID NO: 10699 - protein, 10 aa, BK virus
SRFMGAALAL

SEQ ID NO: 10700 - protein, 10 aa, BK virus
RFMGAALALL

SEQ ID NO: 10701 - protein, 10 aa, BK virus
FMGAALALLG

SEQ ID NO: 10702 - protein, 10 aa, BK virus
MGAALALLGD

SEQ ID NO: 10703 - protein, 10 aa, BK virus
GAALALLGDL

SEQ ID NO: 10704 - protein, 10 aa, BK virus
AALALLGDLV

SEQ ID NO: 10705 - protein, 10 aa, BK virus
ALALLGDLVA

SEQ ID NO: 10706 - protein, 10 aa, BK virus
LALLGDLVAS

SEQ ID NO: 10707 - protein, 10 aa, BK virus
ALLGDLVASV

SEQ ID NO: 10708 - protein, 10 aa, BK virus
LLGDLVASVS

SEQ ID NO: 10709 - protein, 10 aa, BK virus
LGDLVASVSE

SEQ ID NO: 10710 - protein, 10 aa, BK virus
GDLVASVSEA

SEQ ID NO: 10711 - protein, 10 aa, BK virus
DLVASVSEAA

SEQ ID NO: 10712 - protein, 10 aa, BK virus
LVASVSEAAA

SEQ ID NO: 10713 - protein, 10 aa, BK virus
VASVSEAAAA

SEQ ID NO: 10714 - protein, 10 aa, BK virus
ASVSEAAAAT

SEQ ID NO: 10715 - protein, 10 aa, BK virus
SVSEAAAATG

SEQ ID NO: 10716 - protein, 10 aa, BK virus
VSEAAAATGF

SEQ ID NO: 10717 - protein, 10 aa, BK virus
SEAAAATGFS

SEQ ID NO: 10718 - protein, 10 aa, BK virus
EAAAATGFSV

SEQ ID NO: 10719 - protein, 10 aa, BK virus
AAAATGFSVA

SEQ ID NO: 10720 - protein, 10 aa, BK virus
AAATGFSVAE

SEQ ID NO: 10721 - protein, 10 aa, BK virus
AATGFSVAEI

SEQ ID NO: 10722 - protein, 10 aa, BK virus
ATGFSVAEIA

SEQ ID NO: 10723 - protein, 10 aa, BK virus
TGFSVAEIAA

SEQ ID NO: 10724 - protein, 10 aa, BK virus
GFSVAEIAAG

SEQ ID NO: 10725 - protein, 10 aa, BK virus
FSVAEIAAGE

SEQ ID NO: 10726 - protein, 10 aa, BK virus
SVAEIAAGEA

SEQ ID NO: 10727 - protein, 10 aa, BK virus
VAEIAAGEAA

SEQ ID NO: 10728 - protein, 10 aa, BK virus
AEIAAGEAAA

SEQ ID NO: 10729 - protein, 10 aa, BK virus
EIAAGEAAAA

SEQ ID NO: 10730 - protein, 10 aa, BK virus
IAAGEAAAAI

SEQ ID NO: 10731 - protein, 10 aa, BK virus
AAGEAAAAIE

SEQ ID NO: 10732 - protein, 10 aa, BK virus
AGEAAAAIEV

SEQ ID NO: 10733 - protein, 10 aa, BK virus
GEAAAAIEVQ

SEQ ID NO: 10734 - protein, 10 aa, BK virus
EAAAAIEVQI

SEQ ID NO: 10735 - protein, 10 aa, BK virus
AAAAIEVQIA

SEQ ID NO: 10736 - protein, 10 aa, BK virus
AAAIEVQIAS

SEQ ID NO: 10737 - protein, 10 aa, BK virus
AAIEVQIASL

SEQ ID NO: 10738 - protein, 10 aa, BK virus
AIEVQIASLA

SEQ ID NO: 10739 - protein, 10 aa, BK virus
IEVQIASLAT

SEQ ID NO: 10740 - protein, 10 aa, BK virus
EVQIASLATV

SEQ ID NO: 10741 - protein, 10 aa, BK virus
VQIASLATVE

SEQ ID NO: 10742 - protein, 10 aa, BK virus
QIASLATVEG

SEQ ID NO: 10743 - protein, 10 aa, BK virus
IASLATVEGI

SEQ ID NO: 10744 - protein, 10 aa, BK virus
ASLATVEGIT

SEQ ID NO: 10745 - protein, 10 aa, BK virus
SLATVEGITS

SEQ ID NO: 10746 - protein, 10 aa, BK virus
LATVEGITST

SEQ ID NO: 10747 - protein, 10 aa, BK virus
ATVEGITSTS

SEQ ID NO: 10748 - protein, 10 aa, BK virus
TVEGITSTSE

SEQ ID NO: 10749 - protein, 10 aa, BK virus
VEGITSTSEA

SEQ ID NO: 10750 - protein, 10 aa, BK virus
EGITSTSEAI

SEQ ID NO: 10751 - protein, 10 aa, BK virus
GITSTSEAIA

SEQ ID NO: 10752 - protein, 10 aa, BK virus
ITSTSEAIAA

SEQ ID NO: 10753 - protein, 10 aa, BK virus
TSTSEAIAAI

SEQ ID NO: 10754 - protein, 10 aa, BK virus
STSEAIAAIG

SEQ ID NO: 10755 - protein, 10 aa, BK virus
TSEAIAAIGL

SEQ ID NO: 10756 - protein, 10 aa, BK virus
SEAIAAIGLT

SEQ ID NO: 10757 - protein, 10 aa, BK virus
EAIAAIGLTP

SEQ ID NO: 10758 - protein, 10 aa, BK virus
AIAAIGLTPQ

SEQ ID NO: 10759 - protein, 10 aa, BK virus
IAAIGLTPQT

SEQ ID NO: 10760 - protein, 10 aa, BK virus
AAIGLTPQTY

SEQ ID NO: 10761 - protein, 10 aa, BK virus
AIGLTPQTYA

SEQ ID NO: 10762 - protein, 10 aa, BK virus
IGLTPQTYAV

SEQ ID NO: 10763 - protein, 10 aa, BK virus
GLTPQTYAVI

SEQ ID NO: 10764 - protein, 10 aa, BK virus
LTPQTYAVIA

SEQ ID NO: 10765 - protein, 10 aa, BK virus
TPQTYAVIAG

SEQ ID NO: 10766 - protein, 10 aa, BK virus
PQTYAVIAGA

SEQ ID NO: 10767 - protein, 10 aa, BK virus
QTYAVIAGAP

SEQ ID NO: 10768 - protein, 10 aa, BK virus
TYAVIAGAPG

SEQ ID NO: 10769 - protein, 10 aa, BK virus
YAVIAGAPGA

SEQ ID NO: 10770 - protein, 10 aa, BK virus
AVIAGAPGAI

SEQ ID NO: 10771 - protein, 10 aa, BK virus
VIAGAPGAIA

SEQ ID NO: 10772 - protein, 10 aa, BK virus
IAGAPGAIAG

SEQ ID NO: 10773 - protein, 10 aa, BK virus
AGAPGAIAGF

SEQ ID NO: 10774 - protein, 10 aa, BK virus
GAPGAIAGFA

SEQ ID NO: 10775 - protein, 10 aa, BK virus
APGAIAGFAA

SEQ ID NO: 10776 - protein, 10 aa, BK virus
PGAIAGFAAL

SEQ ID NO: 10777 - protein, 10 aa, BK virus
GAIAGFAALI

SEQ ID NO: 10778 - protein, 10 aa, BK virus
AIAGFAALIQ

SEQ ID NO: 10779 - protein, 10 aa, BK virus
IAGFAALIQT

SEQ ID NO: 10780 - protein, 10 aa, BK virus
AGFAALIQTV

SEQ ID NO: 10781 - protein, 10 aa, BK virus
GFAALIQTVS

SEQ ID NO: 10782 - protein, 10 aa, BK virus
FAALIQTVSG

SEQ ID NO: 10783 - protein, 10 aa, BK virus
AALIQTVSGI

SEQ ID NO: 10784 - protein, 10 aa, BK virus
ALIQTVSGIS

SEQ ID NO: 10785 - protein, 10 aa, BK virus
LIQTVSGISS

SEQ ID NO: 10786 - protein, 10 aa, BK virus
IQTVSGISSL

SEQ ID NO: 10787 - protein, 10 aa, BK virus
QTVSGISSLA

SEQ ID NO: 10788 - protein, 10 aa, BK virus
TVSGISSLAQ

SEQ ID NO: 10789 - protein, 10 aa, BK virus
VSGISSLAQV

SEQ ID NO: 10790 - protein, 10 aa, BK virus
SGISSLAQVG

SEQ ID NO: 10791 - protein, 10 aa, BK virus
GISSLAQVGY

SEQ ID NO: 10792 - protein, 10 aa, BK virus
ISSLAQVGYK

SEQ ID NO: 10793 - protein, 10 aa, BK virus
SSLAQVGYKF

SEQ ID NO: 10794 - protein, 10 aa, BK virus
SLAQVGYKFF

SEQ ID NO: 10795 - protein, 10 aa, BK virus
LAQVGYKFFD

SEQ ID NO: 10796 - protein, 10 aa, BK virus
AQVGYKFFDD

SEQ ID NO: 10797 - protein, 10 aa, BK virus
QVGYKFFDDW

SEQ ID NO: 10798 - protein, 10 aa, BK virus
VGYKFFDDWD

SEQ ID NO: 10799 - protein, 10 aa, BK virus
GYKFFDDWDH

SEQ ID NO: 10800 - protein, 10 aa, BK virus
YKFFDDWDHK

SEQ ID NO: 10801 - protein, 10 aa, BK virus
KFFDDWDHKV

SEQ ID NO: 10802 - protein, 10 aa, BK virus
FFDDWDHKVS

SEQ ID NO: 10803 - protein, 10 aa, BK virus
FDDWDHKVST

SEQ ID NO: 10804 - protein, 10 aa, BK virus
DDWDHKVSTV

SEQ ID NO: 10805 - protein, 10 aa, BK virus
DWDHKVSTVG

SEQ ID NO: 10806 - protein, 10 aa, BK virus
WDHKVSTVGL

SEQ ID NO: 10807 - protein, 10 aa, BK virus
DHKVSTVGLY

SEQ ID NO: 10808 - protein, 10 aa, BK virus
HKVSTVGLYQ

SEQ ID NO: 10809 - protein, 10 aa, BK virus
KVSTVGLYQQ

SEQ ID NO: 10810 - protein, 10 aa, BK virus
VSTVGLYQQS

SEQ ID NO: 10811 - protein, 10 aa, BK virus
STVGLYQQSG

SEQ ID NO: 10812 - protein, 10 aa, BK virus
TVGLYQQSGM

SEQ ID NO: 10813 - protein, 10 aa, BK virus
VGLYQQSGMA

SEQ ID NO: 10814 - protein, 10 aa, BK virus
GLYQQSGMAL

SEQ ID NO: 10815 - protein, 10 aa, BK virus
LYQQSGMALE

SEQ ID NO: 10816 - protein, 10 aa, BK virus
YQQSGMALEL

SEQ ID NO: 10817 - protein, 10 aa, BK virus
QQSGMALELF

SEQ ID NO: 10818 - protein, 10 aa, BK virus
QSGMALELFN

SEQ ID NO: 10819 - protein, 10 aa, BK virus
SGMALELFNP

SEQ ID NO: 10820 - protein, 10 aa, BK virus
GMALELFNPD

SEQ ID NO: 10821 - protein, 10 aa, BK virus
MALELFNPDE

SEQ ID NO: 10822 - protein, 10 aa, BK virus
ALELFNPDEY

SEQ ID NO: 10823 - protein, 10 aa, BK virus
LELFNPDEYY

SEQ ID NO: 10824 - protein, 10 aa, BK virus
ELFNPDEYYD

SEQ ID NO: 10825 - protein, 10 aa, BK virus
LFNPDEYYDI

SEQ ID NO: 10826 - protein, 10 aa, BK virus
FNPDEYYDIL

SEQ ID NO: 10827 - protein, 10 aa, BK virus
NPDEYYDILF

SEQ ID NO: 10828 - protein, 10 aa, BK virus
PDEYYDILFP

SEQ ID NO: 10829 - protein, 10 aa, BK virus
DEYYDILFPG

SEQ ID NO: 10830 - protein, 10 aa, BK virus
EYYDILFPGV

SEQ ID NO: 10831 - protein, 10 aa, BK virus
YYDILFPGVN

SEQ ID NO: 10832 - protein, 10 aa, BK virus
YDILFPGVNT

SEQ ID NO: 10833 - protein, 10 aa, BK virus
DILFPGVNTF

SEQ ID NO: 10834 - protein, 10 aa, BK virus
ILFPGVNTFV

SEQ ID NO: 10835 - protein, 10 aa, BK virus
LFPGVNTFVN

SEQ ID NO: 10836 - protein, 10 aa, BK virus
FPGVNTFVNN

SEQ ID NO: 10837 - protein, 10 aa, BK virus
PGVNTFVNNI

SEQ ID NO: 10838 - protein, 10 aa, BK virus
GVNTFVNNIQ

SEQ ID NO: 10839 - protein, 10 aa, BK virus
VNTFVNNIQY

SEQ ID NO: 10840 - protein, 10 aa, BK virus
NTFVNNIQYL

SEQ ID NO: 10841 - protein, 10 aa, BK virus
TFVNNIQYLD

SEQ ID NO: 10842 - protein, 10 aa, BK virus
FVNNIQYLDP

SEQ ID NO: 10843 - protein, 10 aa, BK virus
VNNIQYLDPR

SEQ ID NO: 10844 - protein, 10 aa, BK virus
NNIQYLDPRH

SEQ ID NO: 10845 - protein, 10 aa, BK virus
NIQYLDPRHW

SEQ ID NO: 10846 - protein, 10 aa, BK virus
IQYLDPRHWG

SEQ ID NO: 10847 - protein, 10 aa, BK virus
QYLDPRHWGP

SEQ ID NO: 10848 - protein, 10 aa, BK virus
YLDPRHWGPS

SEQ ID NO: 10849 - protein, 10 aa, BK virus
LDPRHWGPSL

SEQ ID NO: 10850 - protein, 10 aa, BK virus
DPRHWGPSLF

SEQ ID NO: 10851 - protein, 10 aa, BK virus
PRHWGPSLFA

SEQ ID NO: 10852 - protein, 10 aa, BK virus
RHWGPSLFAT

SEQ ID NO: 10853 - protein, 10 aa, BK virus
HWGPSLFATI

SEQ ID NO: 10854 - protein, 10 aa, BK virus
WGPSLFATIS

SEQ ID NO: 10855 - protein, 10 aa, BK virus
GPSLFATISQ

SEQ ID NO: 10856 - protein, 10 aa, BK virus
PSLFATISQA

SEQ ID NO: 10857 - protein, 10 aa, BK virus
SLFATISQAL

SEQ ID NO: 10858 - protein, 10 aa, BK virus
LFATISQALW

SEQ ID NO: 10859 - protein, 10 aa, BK virus
FATISQALWH

SEQ ID NO: 10860 - protein, 10 aa, BK virus
ATISQALWHV

SEQ ID NO: 10861 - protein, 10 aa, BK virus
TISQALWHVI

SEQ ID NO: 10862 - protein, 10 aa, BK virus
ISQALWHVIR

SEQ ID NO: 10863 - protein, 10 aa, BK virus
SQALWHVIRD

SEQ ID NO: 10864 - protein, 10 aa, BK virus
QALWHVIRDD

SEQ ID NO: 10865 - protein, 10 aa, BK virus
ALWHVIRDDI

SEQ ID NO: 10866 - protein, 10 aa, BK virus
LWHVIRDDIP

SEQ ID NO: 10867 - protein, 10 aa, BK virus
WHVIRDDIPS

SEQ ID NO: 10868 - protein, 10 aa, BK virus
HVIRDDIPSI

SEQ ID NO: 10869 - protein, 10 aa, BK virus
VIRDDIPSIT

SEQ ID NO: 10870 - protein, 10 aa, BK virus
IRDDIPSITS

SEQ ID NO: 10871 - protein, 10 aa, BK virus
RDDIPSITSQ

SEQ ID NO: 10872 - protein, 10 aa, BK virus
DDIPSITSQE

SEQ ID NO: 10873 - protein, 10 aa, BK virus
DIPSITSQEL

SEQ ID NO: 10874 - protein, 10 aa, BK virus
IPSITSQELQ

SEQ ID NO: 10875 - protein, 10 aa, BK virus
PSITSQELQR

SEQ ID NO: 10876 - protein, 10 aa, BK virus
SITSQELQRR

SEQ ID NO: 10877 - protein, 10 aa, BK virus
ITSQELQRRT

SEQ ID NO: 10878 - protein, 10 aa, BK virus
TSQELQRRTE

SEQ ID NO: 10879 - protein, 10 aa, BK virus
SQELQRRTER

SEQ ID NO: 10880 - protein, 10 aa, BK virus
QELQRRTERF

SEQ ID NO: 10881 - protein, 10 aa, BK virus
ELQRRTERFF

SEQ ID NO: 10882 - protein, 10 aa, BK virus
LQRRTERFFR

SEQ ID NO: 10883 - protein, 10 aa, BK virus
QRRTERFFRD

SEQ ID NO: 10884 - protein, 10 aa, BK virus
RRTERFFRDS

SEQ ID NO: 10885 - protein, 10 aa, BK virus
RTERFFRDSL

SEQ ID NO: 10886 - protein, 10 aa, BK virus
TERFFRDSLA

SEQ ID NO: 10887 - protein, 10 aa, BK virus
ERFFRDSLAR

SEQ ID NO: 10888 - protein, 10 aa, BK virus
RFFRDSLARF

SEQ ID NO: 10889 - protein, 10 aa, BK virus
FFRDSLARFL

SEQ ID NO: 10890 - protein, 10 aa, BK virus
FRDSLARFLE

SEQ ID NO: 10891 - protein, 10 aa, BK virus
RDSLARFLEE

SEQ ID NO: 10892 - protein, 10 aa, BK virus
DSLARFLEET

SEQ ID NO: 10893 - protein, 10 aa, BK virus
SLARFLEETT

SEQ ID NO: 10894 - protein, 10 aa, BK virus
LARFLEETTW

SEQ ID NO: 10895 - protein, 10 aa, BK virus
ARFLEETTWT

SEQ ID NO: 10896 - protein, 10 aa, BK virus
RFLEETTWTI

SEQ ID NO: 10897 - protein, 10 aa, BK virus
FLEETTWTIV

SEQ ID NO: 10898 - protein, 10 aa, BK virus
LEETTWTIVN

SEQ ID NO: 10899 - protein, 10 aa, BK virus
EETTWTIVNA

SEQ ID NO: 10900 - protein, 10 aa, BK virus
ETTWTIVNAP

SEQ ID NO: 10901 - protein, 10 aa, BK virus
TTWTIVNAPI

SEQ ID NO: 10902 - protein, 10 aa, BK virus
TWTIVNAPIN

SEQ ID NO: 10903 - protein, 10 aa, BK virus
WTIVNAPINF

SEQ ID NO: 10904 - protein, 10 aa, BK virus
TIVNAPINFY

SEQ ID NO: 10905 - protein, 10 aa, BK virus
IVNAPINFYN

SEQ ID NO: 10906 - protein, 10 aa, BK virus
VNAPINFYNY

SEQ ID NO: 10907 - protein, 10 aa, BK virus
NAPINFYNYI

SEQ ID NO: 10908 - protein, 10 aa, BK virus
APINFYNYIQ

SEQ ID NO: 10909 - protein, 10 aa, BK virus
PINFYNYIQQ

SEQ ID NO: 10910 - protein, 10 aa, BK virus
INFYNYIQQY

SEQ ID NO: 10911 - protein, 10 aa, BK virus
NFYNYIQQYY

SEQ ID NO: 10912 - protein, 10 aa, BK virus
FYNYIQQYYS

SEQ ID NO: 10913 - protein, 10 aa, BK virus
YNYIQQYYSD

SEQ ID NO: 10914 - protein, 10 aa, BK virus
NYIQQYYSDL

SEQ ID NO: 10915 - protein, 10 aa, BK virus
YIQQYYSDLS

SEQ ID NO: 10916 - protein, 10 aa, BK virus
IQQYYSDLSP

SEQ ID NO: 10917 - protein, 10 aa, BK virus
QQYYSDLSPI

SEQ ID NO: 10918 - protein, 10 aa, BK virus
QYYSDLSPIR

SEQ ID NO: 10919 - protein, 10 aa, BK virus
YYSDLSPIRP

SEQ ID NO: 10920 - protein, 10 aa, BK virus
YSDLSPIRPS

SEQ ID NO: 10921 - protein, 10 aa, BK virus
SDLSPIRPSM

SEQ ID NO: 10922 - protein, 10 aa, BK virus
DLSPIRPSMV

SEQ ID NO: 10923 - protein, 10 aa, BK virus
LSPIRPSMVR

SEQ ID NO: 10924 - protein, 10 aa, BK virus
SPIRPSMVRQ

SEQ ID NO: 10925 - protein, 10 aa, BK virus
PIRPSMVRQV

SEQ ID NO: 10926 - protein, 10 aa, BK virus
IRPSMVRQVA

SEQ ID NO: 10927 - protein, 10 aa, BK virus
RPSMVRQVAE

SEQ ID NO: 10928 - protein, 10 aa, BK virus
PSMVRQVAER

SEQ ID NO: 10929 - protein, 10 aa, BK virus
SMVRQVAERE

SEQ ID NO: 10930 - protein, 10 aa, BK virus
MVRQVAEREG

SEQ ID NO: 10931 - protein, 10 aa, BK virus
VRQVAEREGT

SEQ ID NO: 10932 - protein, 10 aa, BK virus
RQVAEREGTR

SEQ ID NO: 10933 - protein, 10 aa, BK virus
QVAEREGTRV

SEQ ID NO: 10934 - protein, 10 aa, BK virus
VAEREGTRVH

SEQ ID NO: 10935 - protein, 10 aa, BK virus
AEREGTRVHF

SEQ ID NO: 10936 - protein, 10 aa, BK virus
EREGTRVHFG

SEQ ID NO: 10937 - protein, 10 aa, BK virus
REGTRVHFGH

SEQ ID NO: 10938 - protein, 10 aa, BK virus
EGTRVHFGHT

SEQ ID NO: 10939 - protein, 10 aa, BK virus
GTRVHFGHTY

SEQ ID NO: 10940 - protein, 10 aa, BK virus
TRVHFGHTYS

SEQ ID NO: 10941 - protein, 10 aa, BK virus
RVHFGHTYSI

SEQ ID NO: 10942 - protein, 10 aa, BK virus
VHFGHTYSID

SEQ ID NO: 10943 - protein, 10 aa, BK virus
HFGHTYSIDD

SEQ ID NO: 10944 - protein, 10 aa, BK virus
FGHTYSIDDA

SEQ ID NO: 10945 - protein, 10 aa, BK virus
GHTYSIDDAD

SEQ ID NO: 10946 - protein, 10 aa, BK virus
HTYSIDDADS

SEQ ID NO: 10947 - protein, 10 aa, BK virus
TYSIDDADSI

SEQ ID NO: 10948 - protein, 10 aa, BK virus
YSIDDADSIE

SEQ ID NO: 10949 - protein, 10 aa, BK virus
SIDDADSIEE

SEQ ID NO: 10950 - protein, 10 aa, BK virus
IDDADSIEEV

SEQ ID NO: 10951 - protein, 10 aa, BK virus
DDADSIEEVT

SEQ ID NO: 10952 - protein, 10 aa, BK virus
DADSIEEVTQ

SEQ ID NO: 10953 - protein, 10 aa, BK virus
ADSIEEVTQR

SEQ ID NO: 10954 - protein, 10 aa, BK virus
DSIEEVTQRM

SEQ ID NO: 10955 - protein, 10 aa, BK virus
SIEEVTQRMD

SEQ ID NO: 10956 - protein, 10 aa, BK virus
IEEVTQRMDL

SEQ ID NO: 10957 - protein, 10 aa, BK virus
EEVTQRMDLR

SEQ ID NO: 10958 - protein, 10 aa, BK virus
EVTQRMDLRN

SEQ ID NO: 10959 - protein, 10 aa, BK virus
VTQRMDLRNQ

SEQ ID NO: 10960 - protein, 10 aa, BK virus
TQRMDLRNQQ

SEQ ID NO: 10961 - protein, 10 aa, BK virus
QRMDLRNQQS

SEQ ID NO: 10962 - protein, 10 aa, BK virus
RMDLRNQQSV

SEQ ID NO: 10963 - protein, 10 aa, BK virus
MDLRNQQSVH

SEQ ID NO: 10964 - protein, 10 aa, BK virus
DLRNQQSVHS

SEQ ID NO: 10965 - protein, 10 aa, BK virus
LRNQQSVHSG

SEQ ID NO: 10966 - protein, 10 aa, BK virus
RNQQSVHSGE

SEQ ID NO: 10967 - protein, 10 aa, BK virus
NQQSVHSGEF

SEQ ID NO: 10968 - protein, 10 aa, BK virus
QQSVHSGEFI

SEQ ID NO: 10969 - protein, 10 aa, BK virus
QSVHSGEFIE

SEQ ID NO: 10970 - protein, 10 aa, BK virus
SVHSGEFIEK

SEQ ID NO: 10971 - protein, 10 aa, BK virus
VHSGEFIEKT

SEQ ID NO: 10972 - protein, 10 aa, BK virus
HSGEFIEKTI

SEQ ID NO: 10973 - protein, 10 aa, BK virus
SGEFIEKTIA

SEQ ID NO: 10974 - protein, 10 aa, BK virus
GEFIEKTIAP

SEQ ID NO: 10975 - protein, 10 aa, BK virus
EFIEKTIAPG

SEQ ID NO: 10976 - protein, 10 aa, BK virus
FIEKTIAPGG

SEQ ID NO: 10977 - protein, 10 aa, BK virus
IEKTIAPGGA

SEQ ID NO: 10978 - protein, 10 aa, BK virus
EKTIAPGGAN

SEQ ID NO: 10979 - protein, 10 aa, BK virus
KTIAPGGANQ

SEQ ID NO: 10980 - protein, 10 aa, BK virus
TIAPGGANQR

SEQ ID NO: 10981 - protein, 10 aa, BK virus
IAPGGANQRT

SEQ ID NO: 10982 - protein, 10 aa, BK virus
APGGANQRTA

SEQ ID NO: 10983 - protein, 10 aa, BK virus
PGGANQRTAP

SEQ ID NO: 10984 - protein, 10 aa, BK virus
GGANQRTAPQ

SEQ ID NO: 10985 - protein, 10 aa, BK virus
GANQRTAPQW

SEQ ID NO: 10986 - protein, 10 aa, BK virus
ANQRTAPQWM

SEQ ID NO: 10987 - protein, 10 aa, BK virus
NQRTAPQWML

SEQ ID NO: 10988 - protein, 10 aa, BK virus
QRTAPQWMLP

SEQ ID NO: 10989 - protein, 10 aa, BK virus
RTAPQWMLPL

SEQ ID NO: 10990 - protein, 10 aa, BK virus
TAPQWMLPLL

SEQ ID NO: 10991 - protein, 10 aa, BK virus
APQWMLPLLL

SEQ ID NO: 10992 - protein, 10 aa, BK virus
PQWMLPLLLG

SEQ ID NO: 10993 - protein, 10 aa, BK virus
QWMLPLLLGL

SEQ ID NO: 10994 - protein, 10 aa, BK virus
WMLPLLLGLY

SEQ ID NO: 10995 - protein, 10 aa, BK virus
MLPLLLGLYG

SEQ ID NO: 10996 - protein, 10 aa, BK virus
LPLLLGLYGT

SEQ ID NO: 10997 - protein, 10 aa, BK virus
PLLLGLYGTV

SEQ ID NO: 10998 - protein, 10 aa, BK virus
LLLGLYGTVT

SEQ ID NO: 10999 - protein, 10 aa, BK virus
LLGLYGTVTP

SEQ ID NO: 11000 - protein, 10 aa, BK virus
LGLYGTVTPA

SEQ ID NO: 11001 - protein, 10 aa, BK virus
GLYGTVTPAL

SEQ ID NO: 11002 - protein, 10 aa, BK virus
LYGTVTPALE

SEQ ID NO: 11003 - protein, 10 aa, BK virus
YGTVTPALEA

SEQ ID NO: 11004 - protein, 10 aa, BK virus
GTVTPALEAY

SEQ ID NO: 11005 - protein, 10 aa, BK virus
TVTPALEAYE

SEQ ID NO: 11006 - protein, 10 aa, BK virus
VTPALEAYED

SEQ ID NO: 11007 - protein, 10 aa, BK virus
TPALEAYEDG

SEQ ID NO: 11008 - protein, 10 aa, BK virus
PALEAYEDGP

SEQ ID NO: 11009 - protein, 10 aa, BK virus
ALEAYEDGPN

SEQ ID NO: 11010 - protein, 10 aa, BK virus
LEAYEDGPNQ

SEQ ID NO: 11011 - protein, 10 aa, BK virus
EAYEDGPNQK

SEQ ID NO: 11012 - protein, 10 aa, BK virus
AYEDGPNQKK

SEQ ID NO: 11013 - protein, 10 aa, BK virus
YEDGPNQKKR

SEQ ID NO: 11014 - protein, 10 aa, BK virus
EDGPNQKKRR

SEQ ID NO: 11015 - protein, 10 aa, BK virus
DGPNQKKRRV

SEQ ID NO: 11016 - protein, 10 aa, BK virus
GPNQKKRRVS

SEQ ID NO: 11017 - protein, 10 aa, BK virus
PNQKKRRVSR

SEQ ID NO: 11018 - protein, 10 aa, BK virus
NQKKRRVSRG

SEQ ID NO: 11019 - protein, 10 aa, BK virus
QKKRRVSRGS

SEQ ID NO: 11020 - protein, 10 aa, BK virus
KKRRVSRGSS

SEQ ID NO: 11021 - protein, 10 aa, BK virus
KRRVSRGSSQ

SEQ ID NO: 11022 - protein, 10 aa, BK virus
RRVSRGSSQK

SEQ ID NO: 11023 - protein, 10 aa, BK virus
RVSRGSSQKA

SEQ ID NO: 11024 - protein, 10 aa, BK virus
VSRGSSQKAK

SEQ ID NO: 11025 - protein, 10 aa, BK virus
SRGSSQKAKG

SEQ ID NO: 11026 - protein, 10 aa, BK virus
RGSSQKAKGT

SEQ ID NO: 11027 - protein, 10 aa, BK virus
GSSQKAKGTR

SEQ ID NO: 11028 - protein, 10 aa, BK virus
SSQKAKGTRA

SEQ ID NO: 11029 - protein, 10 aa, BK virus
SQKAKGTRAS

SEQ ID NO: 11030 - protein, 10 aa, BK virus
QKAKGTRASA

SEQ ID NO: 11031 - protein, 10 aa, BK virus
KAKGTRASAK

SEQ ID NO: 11032 - protein, 10 aa, BK virus
AKGTRASAKT

SEQ ID NO: 11033 - protein, 10 aa, BK virus
KGTRASAKTT

SEQ ID NO: 11034 - protein, 10 aa, BK virus
GTRASAKTTN

SEQ ID NO: 11035 - protein, 10 aa, BK virus
TRASAKTTNK

SEQ ID NO: 11036 - protein, 10 aa, BK virus
RASAKTTNKR

SEQ ID NO: 11037 - protein, 10 aa, BK virus
ASAKTTNKRR

SEQ ID NO: 11038 - protein, 10 aa, BK virus
SAKTTNKRRS

SEQ ID NO: 11039 - protein, 10 aa, BK virus
AKTTNKRRSR

SEQ ID NO: 11040 - protein, 10 aa, BK virus
KTTNKRRSRS

SEQ ID NO: 11041 - protein, 10 aa, BK virus
TTNKRRSRSS

SEQ ID NO: 11042 - protein, 10 aa, BK virus
TNKRRSRSSR

SEQ ID NO: 11043 - protein, 10 aa, BK virus
NKRRSRSSRS

SEQ ID NO: 11044 - protein, 10 aa, BK virus
NWGRCYYRGR

SEQ ID NO: 11045 - protein, 10 aa, BK virus
WGRCYYRGRM

SEQ ID NO: 11046 - protein, 10 aa, BK virus
GRCYYRGRML

SEQ ID NO: 11047 - protein, 10 aa, BK virus
RCYYRGRMLP

SEQ ID NO: 11048 - protein, 10 aa, BK virus
CYYRGRMLPK

SEQ ID NO: 11049 - protein, 10 aa, BK virus
YYRGRMLPKP

SEQ ID NO: 11050 - protein, 10 aa, BK virus
YRGRMLPKPR

SEQ ID NO: 11051 - protein, 10 aa, BK virus
RGRMLPKPRN

SEQ ID NO: 11052 - protein, 10 aa, BK virus
GRMLPKPRNG

SEQ ID NO: 11053 - protein, 10 aa, BK virus
RMLPKPRNGG

SEQ ID NO: 11054 - protein, 10 aa, BK virus
MLPKPRNGGS

SEQ ID NO: 11055 - protein, 10 aa, BK virus
LPKPRNGGSR

SEQ ID NO: 11056 - protein, 10 aa, BK virus
PREKNASLLQ

SEQ ID NO: 11057 - protein, 10 aa, BK virus
REKNASLLQH

SEQ ID NO: 11058 - protein, 10 aa, BK virus
EKNASLLQHS

SEQ ID NO: 11059 - protein, 10 aa, BK virus
KNASLLQHSK

SEQ ID NO: 11060 - protein, 10 aa, BK virus
NASLLQHSKN

SEQ ID NO: 11061 - protein, 10 aa, BK virus
ASLLQHSKNS

SEQ ID NO: 11062 - protein, 10 aa, BK virus
SLLQHSKNSP

SEQ ID NO: 11063 - protein, 10 aa, BK virus
LLQHSKNSPP

SEQ ID NO: 11064 - protein, 10 aa, BK virus
LQHSKNSPPQ

SEQ ID NO: 11065 - protein, 10 aa, BK virus
QHSKNSPPQF

SEQ ID NO: 11066 - protein, 10 aa, BK virus
HSKNSPPQFK

SEQ ID NO: 11067 - protein, 10 aa, BK virus
GPNLWKSTDV

SEQ ID NO: 11068 - protein, 10 aa, BK virus
PNLWKSTDVG

SEQ ID NO: 11069 - protein, 10 aa, BK virus
NLWKSTDVGG

SEQ ID NO: 11070 - protein, 10 aa, BK virus
LWKSTDVGGC

SEQ ID NO: 11071 - protein, 10 aa, BK virus
WKSTDVGGCN

SEQ ID NO: 11072 - protein, 10 aa, BK virus
KSTDVGGCNC

SEQ ID NO: 11073 - protein, 10 aa, BK virus
STDVGGCNCT

SEQ ID NO: 11074 - protein, 10 aa, BK virus
TDVGGCNCTN

SEQ ID NO: 11075 - protein, 10 aa, BK virus
DVGGCNCTNR

SEQ ID NO: 11076 - protein, 10 aa, BK virus
VGGCNCTNRG

SEQ ID NO: 11077 - protein, 10 aa, BK virus
GGCNCTNRGY

SEQ ID NO: 11078 - protein, 10 aa, BK virus
GCNCTNRGYW

SEQ ID NO: 11079 - protein, 10 aa, BK virus
CNCTNRGYWN

SEQ ID NO: 11080 - protein, 10 aa, BK virus
NCTNRGYWNN

SEQ ID NO: 11081 - protein, 10 aa, BK virus
AWWRKTYSRQ

SEQ ID NO: 11082 - protein, 10 aa, BK virus
FPLLCCRWRT

SEQ ID NO: 11083 - protein, 10 aa, BK virus
PLLCCRWRTL

SEQ ID NO: 11084 - protein, 10 aa, BK virus
LLCCRWRTLG

SEQ ID NO: 11085 - protein, 10 aa, BK virus
LCCRWRTLGN

SEQ ID NO: 11086 - protein, 10 aa, BK virus
CCRWRTLGNA

SEQ ID NO: 11087 - protein, 10 aa, BK virus
CRWRTLGNAG

SEQ ID NO: 11088 - protein, 10 aa, BK virus
RWRTLGNAGS

SEQ ID NO: 11089 - protein, 10 aa, BK virus
WRTLGNAGSA

SEQ ID NO: 11090 - protein, 10 aa, BK virus
RTLGNAGSAN

SEQ ID NO: 11091 - protein, 10 aa, BK virus
TLGNAGSANE

SEQ ID NO: 11092 - protein, 10 aa, BK virus
LGNAGSANEL

SEQ ID NO: 11093 - protein, 10 aa, BK virus
GNAGSANELQ

SEQ ID NO: 11094 - protein, 10 aa, BK virus
NAGSANELQV

SEQ ID NO: 11095 - protein, 10 aa, BK virus
AGSANELQVK

SEQ ID NO: 11096 - protein, 10 aa, BK virus
GSANELQVKV

SEQ ID NO: 11097 - protein, 10 aa, BK virus
SANELQVKVP

SEQ ID NO: 11098 - protein, 10 aa, BK virus
KPNSPVPGNE

SEQ ID NO: 11099 - protein, 10 aa, BK virus
PNSPVPGNEY

SEQ ID NO: 11100 - protein, 10 aa, BK virus
GLFGQKQCLS

SEQ ID NO: 11101 - protein, 10 aa, BK virus
LFGQKQCLSS

SEQ ID NO: 11102 - protein, 10 aa, BK virus
VFWDFHRRGK

SEQ ID NO: 11103 - protein, 10 aa, BK virus
FWDFHRRGKC

SEQ ID NO: 11104 - protein, 10 aa, BK virus
WDFHRRGKCS

SEQ ID NO: 11105 - protein, 10 aa, BK virus
DFHRRGKCSP

SEQ ID NO: 11106 - protein, 10 aa, BK virus
FHRRGKCSPS

SEQ ID NO: 11107 - protein, 10 aa, BK virus
HRRGKCSPST

SEQ ID NO: 11108 - protein, 10 aa, BK virus
RRGKCSPSTS

SEQ ID NO: 11109 - protein, 10 aa, BK virus
RGKCSPSTSC

SEQ ID NO: 11110 - protein, 10 aa, BK virus
GKCSPSTSCD

SEQ ID NO: 11111 - protein, 10 aa, BK virus
KCSPSTSCDQ

SEQ ID NO: 11112 - protein, 10 aa, BK virus
CSPSTSCDQH

SEQ ID NO: 11113 - protein, 10 aa, BK virus
SPSTSCDQHS

SEQ ID NO: 11114 - protein, 10 aa, BK virus
PSTSCDQHSY

SEQ ID NO: 11115 - protein, 10 aa, BK virus
STSCDQHSYH

SEQ ID NO: 11116 - protein, 10 aa, BK virus
TSCDQHSYHS

SEQ ID NO: 11117 - protein, 10 aa, BK virus
SCDQHSYHSV

SEQ ID NO: 11118 - protein, 10 aa, BK virus
CDQHSYHSVA

SEQ ID NO: 11119 - protein, 10 aa, BK virus
DQHSYHSVAR

SEQ ID NO: 11120 - protein, 10 aa, BK virus
QLWNTTVERP

SEQ ID NO: 11121 - protein, 10 aa, BK virus
LWNTTVERPC

SEQ ID NO: 11122 - protein, 10 aa, BK virus
WNTTVERPCK

SEQ ID NO: 11123 - protein, 10 aa, BK virus
NTTVERPCKI

SEQ ID NO: 11124 - protein, 10 aa, BK virus
TTVERPCKIF

SEQ ID NO: 11125 - protein, 10 aa, BK virus
DPPEKKICKE

SEQ ID NO: 11126 - protein, 10 aa, BK virus
PPEKKICKES

SEQ ID NO: 11127 - protein, 10 aa, BK virus
PEKKICKESL

SEQ ID NO: 11128 - protein, 10 aa, BK virus
EKKICKESLP

SEQ ID NO: 11129 - protein, 10 aa, BK virus
KKICKESLPN

SEQ ID NO: 11130 - protein, 10 aa, BK virus
KICKESLPNF

SEQ ID NO: 11131 - protein, 10 aa, BK virus
ICKESLPNFL

SEQ ID NO: 11132 - protein, 10 aa, BK virus
CKESLPNFLF

SEQ ID NO: 11133 - protein, 10 aa, BK virus
KESLPNFLFA

SEQ ID NO: 11134 - protein, 10 aa, BK virus
ESLPNFLFAK

SEQ ID NO: 11135 - protein, 10 aa, BK virus
PYKQENPESG

SEQ ID NO: 11136 - protein, 10 aa, BK virus
YKQENPESGW

SEQ ID NO: 11137 - protein, 10 aa, BK virus
KQENPESGWA

SEQ ID NO: 11138 - protein, 10 aa, BK virus
QENPESGWAA

SEQ ID NO: 11139 - protein, 10 aa, BK virus
ENPESGWAAY

SEQ ID NO: 11140 - protein, 10 aa, BK virus
NPESGWAAYV

SEQ ID NO: 11141 - protein, 10 aa, BK virus
PESGWAAYVW

SEQ ID NO: 11142 - protein, 10 aa, BK virus
ESGWAAYVWY

SEQ ID NO: 11143 - protein, 10 aa, BK virus
SGWAAYVWYG

SEQ ID NO: 11144 - protein, 10 aa, BK virus
GWAAYVWYGI

SEQ ID NO: 11145 - protein, 10 aa, BK virus
WAAYVWYGIP

SEQ ID NO: 11146 - protein, 10 aa, BK virus
AAYVWYGIPG

SEQ ID NO: 11147 - protein, 10 aa, BK virus
AYVWYGIPGR

SEQ ID NO: 11148 - protein, 10 aa, BK virus
YVWYGIPGRR

SEQ ID NO: 11149 - protein, 10 aa, BK virus
VWYGIPGRRG

SEQ ID NO: 11150 - protein, 10 aa, BK virus
WHRKTSRGPR

SEQ ID NO: 11151 - protein, 10 aa, BK virus
HRKTSRGPRY

SEQ ID NO: 11152 - protein, 10 aa, BK virus
RKTSRGPRYD

SEQ ID NO: 11153 - protein, 10 aa, BK virus
KTSRGPRYDK

SEQ ID NO: 11154 - protein, 10 aa, BK virus
TSRGPRYDKI

SEQ ID NO: 11155 - protein, 10 aa, BK virus
SRGPRYDKIY

SEQ ID NO: 11156 - protein, 10 aa, BK virus
QTGTIANQNA

SEQ ID NO: 11157 - protein, 10 aa, BK virus
TGTIANQNAL

SEQ ID NO: 11158 - protein, 10 aa, BK virus
GTIANQNALN

SEQ ID NO: 11159 - protein, 10 aa, BK virus
TIANQNALNR

SEQ ID NO: 11160 - protein, 10 aa, BK virus
IANQNALNRC

SEQ ID NO: 11161 - protein, 10 aa, BK virus
ANQNALNRCF

SEQ ID NO: 11162 - protein, 10 aa, BK virus
NQNALNRCFY

SEQ ID NO: 11163 - protein, 10 aa, BK virus
QNALNRCFYC

SEQ ID NO: 11164 - protein, 10 aa, BK virus
NALNRCFYCT

SEQ ID NO: 11165 - protein, 10 aa, BK virus
ALNRCFYCTY

SEQ ID NO: 11166 - protein, 10 aa, BK virus
LNRCFYCTYT

SEQ ID NO: 11167 - protein, 10 aa, BK virus
NRCFYCTYTF

SEQ ID NO: 11168 - protein, 10 aa, BK virus
RCFYCTYTFN

SEQ ID NO: 11169 - protein, 10 aa, BK virus
CFYCTYTFNK

SEQ ID NO: 11170 - protein, 10 aa, BK virus
FYCTYTFNKC

SEQ ID NO: 11171 - protein, 10 aa, BK virus
YCTYTFNKCC

SEQ ID NO: 11172 - protein, 10 aa, BK virus
CTYTFNKCCF

SEQ ID NO: 11173 - protein, 10 aa, BK virus
TYTFNKCCFC

SEQ ID NO: 11174 - protein, 10 aa, BK virus
YTFNKCCFCI

SEQ ID NO: 11175 - protein, 10 aa, BK virus
TFNKCCFCIS

SEQ ID NO: 11176 - protein, 10 aa, BK virus
FNKCCFCISH

SEQ ID NO: 11177 - protein, 10 aa, BK virus
NKCCFCISHF

SEQ ID NO: 11178 - protein, 10 aa, BK virus
NTESLYTNAT

SEQ ID NO: 11179 - protein, 10 aa, BK virus
TESLYTNATL

SEQ ID NO: 11180 - protein, 10 aa, BK virus
ESLYTNATLD

SEQ ID NO: 11181 - protein, 10 aa, BK virus
SLYTNATLDY

SEQ ID NO: 11182 - protein, 10 aa, BK virus
LYTNATLDYG

SEQ ID NO: 11183 - protein, 10 aa, BK virus
YTNATLDYGG

SEQ ID NO: 11184 - protein, 10 aa, BK virus
TNATLDYGGL

SEQ ID NO: 11185 - protein, 10 aa, BK virus
NATLDYGGLT

SEQ ID NO: 11186 - protein, 10 aa, BK virus
ATLDYGGLTF

SEQ ID NO: 11187 - protein, 10 aa, BK virus
TLDYGGLTFG

SEQ ID NO: 11188 - protein, 10 aa, BK virus
LDYGGLTFGN

SEQ ID NO: 11189 - protein, 10 aa, BK virus
DYGGLTFGNL

SEQ ID NO: 11190 - protein, 10 aa, BK virus
YGGLTFGNLQ

SEQ ID NO: 11191 - protein, 10 aa, BK virus
GGLTFGNLQQ

SEQ ID NO: 11192 - protein, 10 aa, BK virus
GLTFGNLQQG

SEQ ID NO: 11193 - protein, 10 aa, BK virus
LTFGNLQQGL

SEQ ID NO: 11194 - protein, 10 aa, BK virus
TFGNLQQGLK

SEQ ID NO: 11195 - protein, 10 aa, BK virus
FGNLQQGLKY

SEQ ID NO: 11196 - protein, 10 aa, BK virus
GNLQQGLKYL

SEQ ID NO: 11197 - protein, 10 aa, BK virus
NLQQGLKYLR

SEQ ID NO: 11198 - protein, 10 aa, BK virus
LQQGLKYLRL

SEQ ID NO: 11199 - protein, 10 aa, BK virus
QQGLKYLRLG

SEQ ID NO: 11200 - protein, 10 aa, BK virus
QGLKYLRLGK

SEQ ID NO: 11201 - protein, 10 aa, BK virus
GLKYLRLGKS

SEQ ID NO: 11202 - protein, 10 aa, BK virus
LKYLRLGKSI

SEQ ID NO: 11203 - protein, 10 aa, BK virus
KYLRLGKSIV

SEQ ID NO: 11204 - protein, 10 aa, BK virus
YLRLGKSIVI

SEQ ID NO: 11205 - protein, 10 aa, BK virus
LRLGKSIVIG

SEQ ID NO: 11206 - protein, 10 aa, BK virus
RLGKSIVIGI

SEQ ID NO: 11207 - protein, 10 aa, BK virus
LGKSIVIGIQ

SEQ ID NO: 11208 - protein, 10 aa, BK virus
GKSIVIGIQC

SEQ ID NO: 11209 - protein, 10 aa, BK virus
KSIVIGIQCL

SEQ ID NO: 11210 - protein, 10 aa, BK virus
SIVIGIQCLI

SEQ ID NO: 11211 - protein, 10 aa, BK virus
IVIGIQCLIH

SEQ ID NO: 11212 - protein, 10 aa, BK virus
VIGIQCLIHV

SEQ ID NO: 11213 - protein, 10 aa, BK virus
IGIQCLIHVQ

SEQ ID NO: 11214 - protein, 10 aa, BK virus
GIQCLIHVQS

SEQ ID NO: 11215 - protein, 10 aa, BK virus
IQCLIHVQSL

SEQ ID NO: 11216 - protein, 10 aa, BK virus
QCLIHVQSLQ

SEQ ID NO: 11217 - protein, 10 aa, BK virus
CLIHVQSLQF

SEQ ID NO: 11218 - protein, 10 aa, BK virus
LIHVQSLQFL

SEQ ID NO: 11219 - protein, 10 aa, BK virus
IHVQSLQFLN

SEQ ID NO: 11220 - protein, 10 aa, BK virus
HVQSLQFLNP

SEQ ID NO: 11221 - protein, 10 aa, BK virus
VQSLQFLNPL

SEQ ID NO: 11222 - protein, 10 aa, BK virus
QSLQFLNPLL

SEQ ID NO: 11223 - protein, 10 aa, BK virus
SLQFLNPLLL

SEQ ID NO: 11224 - protein, 10 aa, BK virus
YQEYISPCIY

SEQ ID NO: 11225 - protein, 10 aa, BK virus
QEYISPCIYY

SEQ ID NO: 11226 - protein, 10 aa, BK virus
EYISPCIYYI

SEQ ID NO: 11227 - protein, 10 aa, BK virus
YISPCIYYIS

SEQ ID NO: 11228 - protein, 10 aa, BK virus
ISPCIYYISS

SEQ ID NO: 11229 - protein, 10 aa, BK virus
SPCIYYISSL

SEQ ID NO: 11230 - protein, 10 aa, BK virus
PCIYYISSLK

SEQ ID NO: 11231 - protein, 10 aa, BK virus
CIYYISSLKK

SEQ ID NO: 11232 - protein, 10 aa, BK virus
IYYISSLKKY

SEQ ID NO: 11233 - protein, 10 aa, BK virus
YYISSLKKYT

SEQ ID NO: 11234 - protein, 10 aa, BK virus
YISSLKKYTY

SEQ ID NO: 11235 - protein, 10 aa, BK virus
ISSLKKYTYL

SEQ ID NO: 11236 - protein, 10 aa, BK virus
SSLKKYTYLS

SEQ ID NO: 11237 - protein, 10 aa, BK virus
SLKKYTYLSQ

SEQ ID NO: 11238 - protein, 10 aa, BK virus
LKKYTYLSQN

SEQ ID NO: 11239 - protein, 10 aa, BK virus
KKYTYLSQNP

SEQ ID NO: 11240 - protein, 10 aa, BK virus
KYTYLSQNPA

SEQ ID NO: 11241 - protein, 10 aa, BK virus
YTYLSQNPAF

SEQ ID NO: 11242 - protein, 10 aa, BK virus
TYLSQNPAFP

SEQ ID NO: 11243 - protein, 10 aa, BK virus
YLSQNPAFPS

SEQ ID NO: 11244 - protein, 10 aa, BK virus
LSQNPAFPSI

SEQ ID NO: 11245 - protein, 10 aa, BK virus
SQNPAFPSIQ

SEQ ID NO: 11246 - protein, 10 aa, BK virus
QNPAFPSIQQ

SEQ ID NO: 11247 - protein, 10 aa, BK virus
NPAFPSIQQF

SEQ ID NO: 11248 - protein, 10 aa, BK virus
IVYQLQNQLQ

SEQ ID NO: 11249 - protein, 10 aa, BK virus
VYQLQNQLQA

SEQ ID NO: 11250 - protein, 10 aa, BK virus
TKLAVATRSF

SEQ ID NO: 11251 - protein, 10 aa, BK virus
KLAVATRSFH

SEQ ID NO: 11252 - protein, 10 aa, BK virus
LAVATRSFHF

SEQ ID NO: 11253 - protein, 10 aa, BK virus
AVATRSFHFV

SEQ ID NO: 11254 - protein, 10 aa, BK virus
VATRSFHFVK

SEQ ID NO: 11255 - protein, 10 aa, BK virus
ATRSFHFVKF

SEQ ID NO: 11256 - protein, 10 aa, BK virus
TRSFHFVKFF

SEQ ID NO: 11257 - protein, 10 aa, BK virus
RSFHFVKFFF

SEQ ID NO: 11258 - protein, 10 aa, BK virus
SFHFVKFFFQ

SEQ ID NO: 11259 - protein, 10 aa, BK virus
FHFVKFFFQV

SEQ ID NO: 11260 - protein, 10 aa, BK virus
HFVKFFFQVR

SEQ ID NO: 11261 - protein, 10 aa, BK virus
FVKFFFQVRT

SEQ ID NO: 11262 - protein, 10 aa, BK virus
VKFFFQVRTL

SEQ ID NO: 11263 - protein, 10 aa, BK virus
KFFFQVRTLS

SEQ ID NO: 11264 - protein, 10 aa, BK virus
FFFQVRTLSF

SEQ ID NO: 11265 - protein, 10 aa, BK virus
FFQVRTLSFV

SEQ ID NO: 11266 - protein, 10 aa, BK virus
FQVRTLSFVR

SEQ ID NO: 11267 - protein, 10 aa, BK virus
QVRTLSFVRI

SEQ ID NO: 11268 - protein, 10 aa, BK virus
VRTLSFVRIF

SEQ ID NO: 11269 - protein, 10 aa, BK virus
RTLSFVRIFL

SEQ ID NO: 11270 - protein, 10 aa, BK virus
TLSFVRIFLN

SEQ ID NO: 11271 - protein, 10 aa, BK virus
LSFVRIFLNI

SEQ ID NO: 11272 - protein, 10 aa, BK virus
SFVRIFLNIF

SEQ ID NO: 11273 - protein, 10 aa, BK virus
FVRIFLNIFW

SEQ ID NO: 11274 - protein, 10 aa, BK virus
VRIFLNIFWA

SEQ ID NO: 11275 - protein, 10 aa, BK virus
PSLVEIFGFF

SEQ ID NO: 11276 - protein, 10 aa, BK virus
SLVEIFGFFC

SEQ ID NO: 11277 - protein, 10 aa, BK virus
LVEIFGFFCL

SEQ ID NO: 11278 - protein, 10 aa, BK virus
VEIFGFFCLN

SEQ ID NO: 11279 - protein, 10 aa, BK virus
EIFGFFCLNV

SEQ ID NO: 11280 - protein, 10 aa, BK virus
IFGFFCLNVS

SEQ ID NO: 11281 - protein, 10 aa, BK virus
FGFFCLNVSF

SEQ ID NO: 11282 - protein, 10 aa, BK virus
GFFCLNVSFL

SEQ ID NO: 11283 - protein, 10 aa, BK virus
FFCLNVSFLN

SEQ ID NO: 11284 - protein, 10 aa, BK virus
FCLNVSFLNL

SEQ ID NO: 11285 - protein, 10 aa, BK virus
CLNVSFLNLP

SEQ ID NO: 11286 - protein, 10 aa, BK virus
HFHLNNLSNC

SEQ ID NO: 11287 - protein, 10 aa, BK virus
FHLNNLSNCL

SEQ ID NO: 11288 - protein, 10 aa, BK virus
HLNNLSNCLN

SEQ ID NO: 11289 - protein, 10 aa, BK virus
LNNLSNCLNC

SEQ ID NO: 11290 - protein, 10 aa, BK virus
NNLSNCLNCL

SEQ ID NO: 11291 - protein, 10 aa, BK virus
NLSNCLNCLF

SEQ ID NO: 11292 - protein, 10 aa, BK virus
LSNCLNCLFH

SEQ ID NO: 11293 - protein, 10 aa, BK virus
SNCLNCLFHV

SEQ ID NO: 11294 - protein, 10 aa, BK virus
NCLNCLFHVL

SEQ ID NO: 11295 - protein, 10 aa, BK virus
CLNCLFHVLK

SEQ ID NO: 11296 - protein, 10 aa, BK virus
LNCLFHVLKA

SEQ ID NO: 11297 - protein, 10 aa, BK virus
NCLFHVLKAN

SEQ ID NO: 11298 - protein, 10 aa, BK virus
CLFHVLKANP

SEQ ID NO: 11299 - protein, 10 aa, BK virus
LFHVLKANPL

SEQ ID NO: 11300 - protein, 10 aa, BK virus
FHVLKANPLI

SEQ ID NO: 11301 - protein, 10 aa, BK virus
HVLKANPLIQ

SEQ ID NO: 11302 - protein, 10 aa, BK virus
VLKANPLIQL

SEQ ID NO: 11303 - protein, 10 aa, BK virus
LKANPLIQLL

SEQ ID NO: 11304 - protein, 10 aa, BK virus
KANPLIQLLS

SEQ ID NO: 11305 - protein, 10 aa, BK virus
ANPLIQLLSL

SEQ ID NO: 11306 - protein, 10 aa, BK virus
NPLIQLLSLL

SEQ ID NO: 11307 - protein, 10 aa, BK virus
PLIQLLSLLH

SEQ ID NO: 11308 - protein, 10 aa, BK virus
LIQLLSLLHL

SEQ ID NO: 11309 - protein, 10 aa, BK virus
IQLLSLLHLQ

SEQ ID NO: 11310 - protein, 10 aa, BK virus
QLLSLLHLQK

SEQ ID NO: 11311 - protein, 10 aa, BK virus
LLSLLHLQKQ

SEQ ID NO: 11312 - protein, 10 aa, BK virus
LSLLHLQKQP

SEQ ID NO: 11313 - protein, 10 aa, BK virus
SLLHLQKQPC

SEQ ID NO: 11314 - protein, 10 aa, BK virus
LLHLQKQPCT

SEQ ID NO: 11315 - protein, 10 aa, BK virus
LHLQKQPCTD

SEQ ID NO: 11316 - protein, 10 aa, BK virus
HLQKQPCTDL

SEQ ID NO: 11317 - protein, 10 aa, BK virus
LHLAQRLAFP

SEQ ID NO: 11318 - protein, 10 aa, BK virus
HLAQRLAFPW

SEQ ID NO: 11319 - protein, 10 aa, BK virus
LAQRLAFPWV

SEQ ID NO: 11320 - protein, 10 aa, BK virus
AQRLAFPWVG

SEQ ID NO: 11321 - protein, 10 aa, BK virus
QRLAFPWVGL

SEQ ID NO: 11322 - protein, 10 aa, BK virus
RLAFPWVGLH

SEQ ID NO: 11323 - protein, 10 aa, BK virus
LAFPWVGLHL

SEQ ID NO: 11324 - protein, 10 aa, BK virus
AFPWVGLHLR

SEQ ID NO: 11325 - protein, 10 aa, BK virus
FPWVGLHLRL

SEQ ID NO: 11326 - protein, 10 aa, BK virus
PWVGLHLRLY

SEQ ID NO: 11327 - protein, 10 aa, BK virus
WVGLHLRLYH

SEQ ID NO: 11328 - protein, 10 aa, BK virus
VGLHLRLYHH

SEQ ID NO: 11329 - protein, 10 aa, BK virus
GLHLRLYHHT

SEQ ID NO: 11330 - protein, 10 aa, BK virus
LHLRLYHHTN

SEQ ID NO: 11331 - protein, 10 aa, BK virus
HLRLYHHTNL

SEQ ID NO: 11332 - protein, 10 aa, BK virus
LRLYHHTNLI

SEQ ID NO: 11333 - protein, 10 aa, BK virus
RLYHHTNLIT

SEQ ID NO: 11334 - protein, 10 aa, BK virus
LYHHTNLITL

SEQ ID NO: 11335 - protein, 10 aa, BK virus
YHHTNLITLQ

SEQ ID NO: 11336 - protein, 10 aa, BK virus
HHTNLITLQL

SEQ ID NO: 11337 - protein, 10 aa, BK virus
HTNLITLQLV

SEQ ID NO: 11338 - protein, 10 aa, BK virus
TNLITLQLVL

SEQ ID NO: 11339 - protein, 10 aa, BK virus
NLITLQLVLF

SEQ ID NO: 11340 - protein, 10 aa, BK virus
LITLQLVLFF

SEQ ID NO: 11341 - protein, 10 aa, BK virus
ITLQLVLFFH

SEQ ID NO: 11342 - protein, 10 aa, BK virus
TLQLVLFFHY

SEQ ID NO: 11343 - protein, 10 aa, BK virus
LQLVLFFHYQ

SEQ ID NO: 11344 - protein, 10 aa, BK virus
QLVLFFHYQW

SEQ ID NO: 11345 - protein, 10 aa, BK virus
LVLFFHYQWD

SEQ ID NO: 11346 - protein, 10 aa, BK virus
VLFFHYQWDL

SEQ ID NO: 11347 - protein, 10 aa, BK virus
KQYSAKNQIL

SEQ ID NO: 11348 - protein, 10 aa, BK virus
QYSAKNQILQ

SEQ ID NO: 11349 - protein, 10 aa, BK virus
YSAKNQILQN

SEQ ID NO: 11350 - protein, 10 aa, BK virus
SAKNQILQNP

SEQ ID NO: 11351 - protein, 10 aa, BK virus
AKNQILQNPF

SEQ ID NO: 11352 - protein, 10 aa, BK virus
VANSAAKQHL

SEQ ID NO: 11353 - protein, 10 aa, BK virus
ANSAAKQHLP

SEQ ID NO: 11354 - protein, 10 aa, BK virus
NSAAKQHLPY

SEQ ID NO: 11355 - protein, 10 aa, BK virus
SAAKQHLPYI

SEQ ID NO: 11356 - protein, 10 aa, BK virus
AAKQHLPYIV

SEQ ID NO: 11357 - protein, 10 aa, BK virus
AKQHLPYIVL

SEQ ID NO: 11358 - protein, 10 aa, BK virus
KQHLPYIVLV

SEQ ID NO: 11359 - protein, 10 aa, BK virus
QHLPYIVLVQ

SEQ ID NO: 11360 - protein, 10 aa, BK virus
HLPYIVLVQH

SEQ ID NO: 11361 - protein, 10 aa, BK virus
LPYIVLVQHF

SEQ ID NO: 11362 - protein, 10 aa, BK virus
PYIVLVQHFH

SEQ ID NO: 11363 - protein, 10 aa, BK virus
YIVLVQHFHE

SEQ ID NO: 11364 - protein, 10 aa, BK virus
IVLVQHFHEL

SEQ ID NO: 11365 - protein, 10 aa, BK virus
VLVQHFHELQ

SEQ ID NO: 11366 - protein, 10 aa, BK virus
LVQHFHELQI

SEQ ID NO: 11367 - protein, 10 aa, BK virus
VQHFHELQIL

SEQ ID NO: 11368 - protein, 10 aa, BK virus
QHFHELQILN

SEQ ID NO: 11369 - protein, 10 aa, BK virus
HFHELQILNP

SEQ ID NO: 11370 - protein, 10 aa, BK virus
FHELQILNPF

SEQ ID NO: 11371 - protein, 10 aa, BK virus
HELQILNPFY

SEQ ID NO: 11372 - protein, 10 aa, BK virus
ELQILNPFYL

SEQ ID NO: 11373 - protein, 10 aa, BK virus
LQILNPFYLI

SEQ ID NO: 11374 - protein, 10 aa, BK virus
QILNPFYLIY

SEQ ID NO: 11375 - protein, 10 aa, BK virus
ILNPFYLIYD

SEQ ID NO: 11376 - protein, 10 aa, BK virus
IFLLAFLPWS

SEQ ID NO: 11377 - protein, 10 aa, BK virus
FLLAFLPWSY

SEQ ID NO: 11378 - protein, 10 aa, BK virus
LLAFLPWSYE

SEQ ID NO: 11379 - protein, 10 aa, BK virus
LAFLPWSYEG

SEQ ID NO: 11380 - protein, 10 aa, BK virus
AFLPWSYEGY

SEQ ID NO: 11381 - protein, 10 aa, BK virus
FLPWSYEGYL

SEQ ID NO: 11382 - protein, 10 aa, BK virus
LPWSYEGYLL

SEQ ID NO: 11383 - protein, 10 aa, BK virus
PWSYEGYLLF

SEQ ID NO: 11384 - protein, 10 aa, BK virus
WSYEGYLLFF

SEQ ID NO: 11385 - protein, 10 aa, BK virus
LKLYLLLADK

SEQ ID NO: 11386 - protein, 10 aa, BK virus
KLYLLLADKY

SEQ ID NO: 11387 - protein, 10 aa, BK virus
LYLLLADKYF

SEQ ID NO: 11388 - protein, 10 aa, BK virus
YLLLADKYFF

SEQ ID NO: 11389 - protein, 10 aa, BK virus
LLLADKYFFD

SEQ ID NO: 11390 - protein, 10 aa, BK virus
LLADKYFFDF

SEQ ID NO: 11391 - protein, 10 aa, BK virus
LADKYFFDFY

SEQ ID NO: 11392 - protein, 10 aa, BK virus
ADKYFFDFYF

SEQ ID NO: 11393 - protein, 10 aa, BK virus
DKYFFDFYFL

SEQ ID NO: 11394 - protein, 10 aa, BK virus
KYFFDFYFLQ

SEQ ID NO: 11395 - protein, 10 aa, BK virus
YFFDFYFLQK

SEQ ID NO: 11396 - protein, 10 aa, BK virus
SDKAGLFSDT

SEQ ID NO: 11397 - protein, 10 aa, BK virus
DKAGLFSDTF

SEQ ID NO: 11398 - protein, 10 aa, BK virus
KAGLFSDTFY

SEQ ID NO: 11399 - protein, 10 aa, BK virus
AGLFSDTFYT

SEQ ID NO: 11400 - protein, 10 aa, BK virus
GLFSDTFYTP

SEQ ID NO: 11401 - protein, 10 aa, BK virus
LFSDTFYTPL

SEQ ID NO: 11402 - protein, 10 aa, BK virus
FSDTFYTPLH

SEQ ID NO: 11403 - protein, 10 aa, BK virus
SDTFYTPLHC

SEQ ID NO: 11404 - protein, 10 aa, BK virus
DTFYTPLHCI

SEQ ID NO: 11405 - protein, 10 aa, BK virus
TFYTPLHCIE

SEQ ID NO: 11406 - protein, 10 aa, BK virus
FYTPLHCIEI

SEQ ID NO: 11407 - protein, 10 aa, BK virus
YTPLHCIEIL

SEQ ID NO: 11408 - protein, 10 aa, BK virus
TPLHCIEILN

SEQ ID NO: 11409 - protein, 10 aa, BK virus
PLHCIEILNT

SEQ ID NO: 11410 - protein, 10 aa, BK virus
LHCIEILNTY

SEQ ID NO: 11411 - protein, 10 aa, BK virus
HCIEILNTYL

SEQ ID NO: 11412 - protein, 10 aa, BK virus
CIEILNTYLI

SEQ ID NO: 11413 - protein, 10 aa, BK virus
IEILNTYLII

SEQ ID NO: 11414 - protein, 10 aa, BK virus
EILNTYLIIK

SEQ ID NO: 11415 - protein, 10 aa, BK virus
ILNTYLIIKT

SEQ ID NO: 11416 - protein, 10 aa, BK virus
LNTYLIIKTH

SEQ ID NO: 11417 - protein, 10 aa, BK virus
NTYLIIKTHP

SEQ ID NO: 11418 - protein, 10 aa, BK virus
TYLIIKTHPH

SEQ ID NO: 11419 - protein, 10 aa, BK virus
YLIIKTHPHT

SEQ ID NO: 11420 - protein, 10 aa, BK virus
LIIKTHPHTL

SEQ ID NO: 11421 - protein, 10 aa, BK virus
IIKTHPHTLS

SEQ ID NO: 11422 - protein, 10 aa, BK virus
IKTHPHTLSL

SEQ ID NO: 11423 - protein, 10 aa, BK virus
KTHPHTLSLL

SEQ ID NO: 11424 - protein, 10 aa, BK virus
THPHTLSLLH

SEQ ID NO: 11425 - protein, 10 aa, BK virus
HPHTLSLLHT

SEQ ID NO: 11426 - protein, 10 aa, BK virus
PHTLSLLHTQ

SEQ ID NO: 11427 - protein, 10 aa, BK virus
LISKTPALFL

SEQ ID NO: 11428 - protein, 10 aa, BK virus
ISKTPALFLQ

SEQ ID NO: 11429 - protein, 10 aa, BK virus
SKTPALFLQA

SEQ ID NO: 11430 - protein, 10 aa, BK virus
KTPALFLQAL

SEQ ID NO: 11431 - protein, 10 aa, BK virus
TPALFLQALL

SEQ ID NO: 11432 - protein, 10 aa, BK virus
PALFLQALLG

SEQ ID NO: 11433 - protein, 10 aa, BK virus
NHAPLSPLEC

SEQ ID NO: 11434 - protein, 10 aa, BK virus
HAPLSPLECF

SEQ ID NO: 11435 - protein, 10 aa, BK virus
APLSPLECFL

SEQ ID NO: 11436 - protein, 10 aa, BK virus
PLSPLECFLL

SEQ ID NO: 11437 - protein, 10 aa, BK virus
LRHYIVSIPY

SEQ ID NO: 11438 - protein, 10 aa, BK virus
LQKLYVYVEL

SEQ ID NO: 11439 - protein, 10 aa, BK virus
QKLYVYVELK

SEQ ID NO: 11440 - protein, 10 aa, BK virus
KLYVYVELKR

SEQ ID NO: 11441 - protein, 10 aa, BK virus
LYVYVELKRI

SEQ ID NO: 11442 - protein, 10 aa, BK virus
VFYTEFELFL

SEQ ID NO: 11443 - protein, 10 aa, BK virus
YTQQSRQGFY

SEQ ID NO: 11444 - protein, 10 aa, BK virus
TQQSRQGFYY

SEQ ID NO: 11445 - protein, 10 aa, BK virus
ETGVDQRESL

SEQ ID NO: 11446 - protein, 10 aa, BK virus
GLLPFFFFWV

SEQ ID NO: 11447 - protein, 10 aa, BK virus
LLPFFFFWVV

SEQ ID NO: 11448 - protein, 10 aa, BK virus
LPFFFFWVVL

SEQ ID NO: 11449 - protein, 10 aa, BK virus
PFFFFWVVLS

SEQ ID NO: 11450 - protein, 10 aa, BK virus
FFFFWVVLSV

SEQ ID NO: 11451 - protein, 10 aa, BK virus
FFFWVVLSVE

SEQ ID NO: 11452 - protein, 10 aa, BK virus
FFWVVLSVEN

SEQ ID NO: 11453 - protein, 10 aa, BK virus
FWVVLSVENL

SEQ ID NO: 11454 - protein, 10 aa, BK virus
WVVLSVENLL

SEQ ID NO: 11455 - protein, 10 aa, BK virus
VVLSVENLLL

SEQ ID NO: 11456 - protein, 10 aa, BK virus
VLSVENLLLL

SEQ ID NO: 11457 - protein, 10 aa, BK virus
LSVENLLLLL

SEQ ID NO: 11458 - protein, 10 aa, BK virus
SVENLLLLLH

SEQ ID NO: 11459 - protein, 10 aa, BK virus
VENLLLLLHH

SEQ ID NO: 11460 - protein, 10 aa, BK virus
ENLLLLLHHW

SEQ ID NO: 11461 - protein, 10 aa, BK virus
NLLLLLHHWQ

SEQ ID NO: 11462 - protein, 10 aa, BK virus
LLLLLHHWQT

SEQ ID NO: 11463 - protein, 10 aa, BK virus
LLLLHHWQTY

SEQ ID NO: 11464 - protein, 10 aa, BK virus
LLLHHWQTYL

SEQ ID NO: 11465 - protein, 10 aa, BK virus
LLHHWQTYLH

SEQ ID NO: 11466 - protein, 10 aa, BK virus
LHHWQTYLHG

SEQ ID NO: 11467 - protein, 10 aa, BK virus
HHWQTYLHGK

SEQ ID NO: 11468 - protein, 10 aa, BK virus
HWQTYLHGKI

SEQ ID NO: 11469 - protein, 10 aa, BK virus
WQTYLHGKIN

SEQ ID NO: 11470 - protein, 10 aa, BK virus
QTYLHGKINL

SEQ ID NO: 11471 - protein, 10 aa, BK virus
TYLHGKINLH

SEQ ID NO: 11472 - protein, 10 aa, BK virus
YLHGKINLHP

SEQ ID NO: 11473 - protein, 10 aa, BK virus
LHGKINLHPI

SEQ ID NO: 11474 - protein, 10 aa, BK virus
HGKINLHPIF

SEQ ID NO: 11475 - protein, 10 aa, BK virus
GKINLHPIFH

SEQ ID NO: 11476 - protein, 10 aa, BK virus
RNSTRTPTLL

SEQ ID NO: 11477 - protein, 10 aa, BK virus
NSTRTPTLLF

SEQ ID NO: 11478 - protein, 10 aa, BK virus
STRTPTLLFH

SEQ ID NO: 11479 - protein, 10 aa, BK virus
TRTPTLLFHR

SEQ ID NO: 11480 - protein, 10 aa, BK virus
RTPTLLFHRL

SEQ ID NO: 11481 - protein, 10 aa, BK virus
TPTLLFHRLA

SEQ ID NO: 11482 - protein, 10 aa, BK virus
PTLLFHRLAP

SEQ ID NO: 11483 - protein, 10 aa, BK virus
TLLFHRLAPI

SEQ ID NO: 11484 - protein, 10 aa, BK virus
LLFHRLAPIK

SEQ ID NO: 11485 - protein, 10 aa, BK virus
LFHRLAPIKK

SEQ ID NO: 11486 - protein, 10 aa, BK virus
FHRLAPIKKI

SEQ ID NO: 11487 - protein, 10 aa, BK virus
HRLAPIKKII

SEQ ID NO: 11488 - protein, 10 aa, BK virus
RLAPIKKIIT

SEQ ID NO: 11489 - protein, 10 aa, BK virus
GLLIFYYLSK

SEQ ID NO: 11490 - protein, 10 aa, BK virus
LLIFYYLSKY

SEQ ID NO: 11491 - protein, 10 aa, BK virus
LIFYYLSKYK

SEQ ID NO: 11492 - protein, 10 aa, BK virus
IFYYLSKYKL

SEQ ID NO: 11493 - protein, 10 aa, BK virus
FYYLSKYKLV

SEQ ID NO: 11494 - protein, 10 aa, BK virus
YYLSKYKLVT

SEQ ID NO: 11495 - protein, 10 aa, BK virus
YLSKYKLVTL

SEQ ID NO: 11496 - protein, 10 aa, BK virus
LSKYKLVTLK

SEQ ID NO: 11497 - protein, 10 aa, BK virus
SKYKLVTLKL

SEQ ID NO: 11498 - protein, 10 aa, BK virus
ISEGSFSNYL

SEQ ID NO: 11499 - protein, 10 aa, BK virus
SEGSFSNYLD

SEQ ID NO: 11500 - protein, 10 aa, BK virus
EGSFSNYLDP

SEQ ID NO: 11501 - protein, 10 aa, BK virus
GSFSNYLDPP

SEQ ID NO: 11502 - protein, 10 aa, BK virus
SFSNYLDPPL

SEQ ID NO: 11503 - protein, 10 aa, BK virus
FSNYLDPPLQ

SEQ ID NO: 11504 - protein, 10 aa, BK virus
SNYLDPPLQS

SEQ ID NO: 11505 - protein, 10 aa, BK virus
NYLDPPLQSF

SEQ ID NO: 11506 - protein, 10 aa, BK virus
YLDPPLQSFF

SEQ ID NO: 11507 - protein, 10 aa, BK virus
LDPPLQSFFS

SEQ ID NO: 11508 - protein, 10 aa, BK virus
AKPLCEAVNA

SEQ ID NO: 11509 - protein, 10 aa, BK virus
KPLCEAVNAV

SEQ ID NO: 11510 - protein, 10 aa, BK virus
PLCEAVNAVA

SEQ ID NO: 11511 - protein, 10 aa, BK virus
LCEAVNAVAI

SEQ ID NO: 11512 - protein, 10 aa, BK virus
CEAVNAVAIY

SEQ ID NO: 11513 - protein, 10 aa, BK virus
EAVNAVAIYP

SEQ ID NO: 11514 - protein, 10 aa, BK virus
AVNAVAIYPN

SEQ ID NO: 11515 - protein, 10 aa, BK virus
VNAVAIYPNQ

SEQ ID NO: 11516 - protein, 10 aa, BK virus
NAVAIYPNQG

SEQ ID NO: 11517 - protein, 10 aa, BK virus
AVAIYPNQGL

SEQ ID NO: 11518 - protein, 10 aa, BK virus
VAIYPNQGLF

SEQ ID NO: 11519 - protein, 10 aa, BK virus
AIYPNQGLFS

SEQ ID NO: 11520 - protein, 10 aa, BK virus
HARAVHRRLF

SEQ ID NO: 11521 - protein, 10 aa, BK virus
ARAVHRRLFG

SEQ ID NO: 11522 - protein, 10 aa, BK virus
RAVHRRLFGT

SEQ ID NO: 11523 - protein, 10 aa, BK virus
AVHRRLFGTN

SEQ ID NO: 11524 - protein, 10 aa, BK virus
VHRRLFGTNR

SEQ ID NO: 11525 - protein, 10 aa, BK virus
HRRLFGTNRP

SEQ ID NO: 11526 - protein, 10 aa, BK virus
RRLFGTNRPF

SEQ ID NO: 11527 - protein, 10 aa, BK virus
RLFGTNRPFL

SEQ ID NO: 11528 - protein, 10 aa, BK virus
LFGTNRPFLA

SEQ ID NO: 11529 - protein, 10 aa, BK virus
FGTNRPFLAV

SEQ ID NO: 11530 - protein, 10 aa, BK virus
GTNRPFLAVQ

SEQ ID NO: 11531 - protein, 10 aa, BK virus
TNRPFLAVQG

SEQ ID NO: 11532 - protein, 10 aa, BK virus
NRPFLAVQGI

SEQ ID NO: 11533 - protein, 10 aa, BK virus
RPFLAVQGIW

SEQ ID NO: 11534 - protein, 10 aa, BK virus
PFLAVQGIWA

SEQ ID NO: 11535 - protein, 10 aa, BK virus
FLAVQGIWAK

SEQ ID NO: 11536 - protein, 10 aa, BK virus
LAVQGIWAKR

SEQ ID NO: 11537 - protein, 10 aa, BK virus
AVQGIWAKRK

SEQ ID NO: 11538 - protein, 10 aa, BK virus
VQGIWAKRKI

SEQ ID NO: 11539 - protein, 10 aa, BK virus
QGIWAKRKIS

SEQ ID NO: 11540 - protein, 10 aa, BK virus
GIWAKRKIST

SEQ ID NO: 11541 - protein, 10 aa, BK virus
IWAKRKISTN

SEQ ID NO: 11542 - protein, 10 aa, BK virus
WAKRKISTNL

SEQ ID NO: 11543 - protein, 10 aa, BK virus
ATPGSKIRLM

SEQ ID NO: 11544 - protein, 10 aa, BK virus
TPGSKIRLMS

SEQ ID NO: 11545 - protein, 10 aa, BK virus
PGSKIRLMSY

SEQ ID NO: 11546 - protein, 10 aa, BK virus
GSKIRLMSYL

SEQ ID NO: 11547 - protein, 10 aa, BK virus
SKIRLMSYLY

SEQ ID NO: 11548 - protein, 10 aa, BK virus
KIRLMSYLYI

SEQ ID NO: 11549 - protein, 10 aa, BK virus
IRLMSYLYIL

SEQ ID NO: 11550 - protein, 10 aa, BK virus
RLMSYLYILL

SEQ ID NO: 11551 - protein, 10 aa, BK virus
LMSYLYILLH

SEQ ID NO: 11552 - protein, 10 aa, BK virus
MSYLYILLHF

SEQ ID NO: 11553 - protein, 10 aa, BK virus
SYLYILLHFF

SEQ ID NO: 11554 - protein, 10 aa, BK virus
YLYILLHFFI

SEQ ID NO: 11555 - protein, 10 aa, BK virus
LYILLHFFIQ

SEQ ID NO: 11556 - protein, 10 aa, BK virus
YILLHFFIQS

SEQ ID NO: 11557 - protein, 10 aa, BK virus
ILLHFFIQSI

SEQ ID NO: 11558 - protein, 10 aa, BK virus
LLHFFIQSIH

SEQ ID NO: 11559 - protein, 10 aa, BK virus
LHFFIQSIHS

SEQ ID NO: 11560 - protein, 10 aa, BK virus
HFFIQSIHSL

SEQ ID NO: 11561 - protein, 10 aa, BK virus
FFIQSIHSLH

SEQ ID NO: 11562 - protein, 10 aa, BK virus
FIQSIHSLHF

SEQ ID NO: 11563 - protein, 10 aa, BK virus
IQSIHSLHFI

SEQ ID NO: 11564 - protein, 10 aa, BK virus
QSIHSLHFIL

SEQ ID NO: 11565 - protein, 10 aa, BK virus
SIHSLHFILV

SEQ ID NO: 11566 - protein, 10 aa, BK virus
IHSLHFILVA

SEQ ID NO: 11567 - protein, 10 aa, BK virus
HSLHFILVAP

SEQ ID NO: 11568 - protein, 10 aa, BK virus
SLHFILVAPF

SEQ ID NO: 11569 - protein, 10 aa, BK virus
LHFILVAPFV

SEQ ID NO: 11570 - protein, 10 aa, BK virus
HFILVAPFVR

SEQ ID NO: 11571 - protein, 10 aa, BK virus
FILVAPFVRV

SEQ ID NO: 11572 - protein, 10 aa, BK virus
ILVAPFVRVK

SEQ ID NO: 11573 - protein, 10 aa, BK virus
LVAPFVRVKF

SEQ ID NO: 11574 - protein, 10 aa, BK virus
VAPFVRVKFL

SEQ ID NO: 11575 - protein, 10 aa, BK virus
APFVRVKFLT

SEQ ID NO: 11576 - protein, 10 aa, BK virus
PFVRVKFLTL

SEQ ID NO: 11577 - protein, 10 aa, BK virus
FVRVKFLTLP

SEQ ID NO: 11578 - protein, 10 aa, BK virus
GKISPGSSFK

SEQ ID NO: 11579 - protein, 10 aa, BK virus
KISPGSSFKA

SEQ ID NO: 11580 - protein, 10 aa, BK virus
KVHELHGFFP

SEQ ID NO: 11581 - protein, 10 aa, BK virus
VHELHGFFPV

SEQ ID NO: 11582 - protein, 10 aa, BK virus
HELHGFFPVK

SEQ ID NO: 11583 - protein, 10 aa, BK virus
ELHGFFPVKN

SEQ ID NO: 11584 - protein, 10 aa, BK virus
LHGFFPVKNF

SEQ ID NO: 11585 - protein, 10 aa, BK virus
HGFFPVKNFI

SEQ ID NO: 11586 - protein, 10 aa, BK virus
GFFPVKNFIH

SEQ ID NO: 11587 - protein, 11 aa, BK virus
LQKLQKNRDFP

SEQ ID NO: 11588 - protein, 11 aa, BK virus
QKLQKNRDFPK

SEQ ID NO: 11589 - protein, 11 aa, BK virus
ASEKASTPLLL

SEQ ID NO: 11590 - protein, 11 aa, BK virus
SEKASTPLLLE

SEQ ID NO: 11591 - protein, 11 aa, BK virus
EKASTPLLLER

SEQ ID NO: 11592 - protein, 11 aa, BK virus
KASTPLLLERK

SEQ ID NO: 11593 - protein, 11 aa, BK virus
ASTPLLLERKG

SEQ ID NO: 11594 - protein, 11 aa, BK virus
STPLLLERKGG

SEQ ID NO: 11595 - protein, 11 aa, BK virus
TPLLLERKGGG

SEQ ID NO: 11596 - protein, 11 aa, BK virus
PLLLERKGGGR

SEQ ID NO: 11597 - protein, 11 aa, BK virus
LLLERKGGGRG

SEQ ID NO: 11598 - protein, 11 aa, BK virus
LLERKGGGRGG

SEQ ID NO: 11599 - protein, 11 aa, BK virus
LERKGGGRGGL

SEQ ID NO: 11600 - protein, 11 aa, BK virus
ERKGGGRGGLG

SEQ ID NO: 11601 - protein, 11 aa, BK virus
RKGGGRGGLGL

SEQ ID NO: 11602 - protein, 11 aa, BK virus
KGGGRGGLGLL

SEQ ID NO: 11603 - protein, 11 aa, BK virus
GGGRGGLGLLY

SEQ ID NO: 11604 - protein, 11 aa, BK virus
GGRGGLGLLYI

SEQ ID NO: 11605 - protein, 11 aa, BK virus
GRGGLGLLYII

SEQ ID NO: 11606 - protein, 11 aa, BK virus
RGGLGLLYIIK

SEQ ID NO: 11607 - protein, 11 aa, BK virus
GGLGLLYIIKK

SEQ ID NO: 11608 - protein, 11 aa, BK virus
GLGLLYIIKKK

SEQ ID NO: 11609 - protein, 11 aa, BK virus
LGLLYIIKKKA

SEQ ID NO: 11610 - protein, 11 aa, BK virus
GLLYIIKKKAT

SEQ ID NO: 11611 - protein, 11 aa, BK virus
LLYIIKKKATG

SEQ ID NO: 11612 - protein, 11 aa, BK virus
LYIIKKKATGR

SEQ ID NO: 11613 - protein, 11 aa, BK virus
YIIKKKATGRS

SEQ ID NO: 11614 - protein, 11 aa, BK virus
IIKKKATGRSC

SEQ ID NO: 11615 - protein, 11 aa, BK virus
IKKKATGRSCL

SEQ ID NO: 11616 - protein, 11 aa, BK virus
KKKATGRSCLP

SEQ ID NO: 11617 - protein, 11 aa, BK virus
KKATGRSCLPM

SEQ ID NO: 11618 - protein, 11 aa, BK virus
KATGRSCLPME

SEQ ID NO: 11619 - protein, 11 aa, BK virus
ATGRSCLPMEC

SEQ ID NO: 11620 - protein, 11 aa, BK virus
TGRSCLPMECS

SEQ ID NO: 11621 - protein, 11 aa, BK virus
GRSCLPMECSQ

SEQ ID NO: 11622 - protein, 11 aa, BK virus
RSCLPMECSQT

SEQ ID NO: 11623 - protein, 11 aa, BK virus
SCLPMECSQTM

SEQ ID NO: 11624 - protein, 11 aa, BK virus
CLPMECSQTMT

SEQ ID NO: 11625 - protein, 11 aa, BK virus
LPMECSQTMTS

SEQ ID NO: 11626 - protein, 11 aa, BK virus
PMECSQTMTSG

SEQ ID NO: 11627 - protein, 11 aa, BK virus
MECSQTMTSGR

SEQ ID NO: 11628 - protein, 11 aa, BK virus
ECSQTMTSGRK

SEQ ID NO: 11629 - protein, 11 aa, BK virus
CSQTMTSGRKV

SEQ ID NO: 11630 - protein, 11 aa, BK virus
SQTMTSGRKVH

SEQ ID NO: 11631 - protein, 11 aa, BK virus
QTMTSGRKVHD

SEQ ID NO: 11632 - protein, 11 aa, BK virus
TMTSGRKVHDS

SEQ ID NO: 11633 - protein, 11 aa, BK virus
MTSGRKVHDSQ

SEQ ID NO: 11634 - protein, 11 aa, BK virus
TSGRKVHDSQG

SEQ ID NO: 11635 - protein, 11 aa, BK virus
SGRKVHDSQGN

SEQ ID NO: 11636 - protein, 11 aa, BK virus
GRKVHDSQGNA

SEQ ID NO: 11637 - protein, 11 aa, BK virus
RKVHDSQGNAA

SEQ ID NO: 11638 - protein, 11 aa, BK virus
KVHDSQGNAAK

SEQ ID NO: 11639 - protein, 11 aa, BK virus
VHDSQGNAAKP

SEQ ID NO: 11640 - protein, 11 aa, BK virus
PQEGKCMTHRE

SEQ ID NO: 11641 - protein, 11 aa, BK virus
QEGKCMTHREE

SEQ ID NO: 11642 - protein, 11 aa, BK virus
EGKCMTHREEL

SEQ ID NO: 11643 - protein, 11 aa, BK virus
GKCMTHREELL

SEQ ID NO: 11644 - protein, 11 aa, BK virus
KCMTHREELLT

SEQ ID NO: 11645 - protein, 11 aa, BK virus
CMTHREELLTH

SEQ ID NO: 11646 - protein, 11 aa, BK virus
MTHREELLTHG

SEQ ID NO: 11647 - protein, 11 aa, BK virus
THREELLTHGM

SEQ ID NO: 11648 - protein, 11 aa, BK virus
HREELLTHGMQ

SEQ ID NO: 11649 - protein, 11 aa, BK virus
REELLTHGMQP

SEQ ID NO: 11650 - protein, 11 aa, BK virus
EELLTHGMQPN

SEQ ID NO: 11651 - protein, 11 aa, BK virus
ELLTHGMQPNH

SEQ ID NO: 11652 - protein, 11 aa, BK virus
LLTHGMQPNHD

SEQ ID NO: 11653 - protein, 11 aa, BK virus
LTHGMQPNHDL

SEQ ID NO: 11654 - protein, 11 aa, BK virus
THGMQPNHDLR

SEQ ID NO: 11655 - protein, 11 aa, BK virus
HGMQPNHDLRK

SEQ ID NO: 11656 - protein, 11 aa, BK virus
GMQPNHDLRKE

SEQ ID NO: 11657 - protein, 11 aa, BK virus
MQPNHDLRKES

SEQ ID NO: 11658 - protein, 11 aa, BK virus
QPNHDLRKESA

SEQ ID NO: 11659 - protein, 11 aa, BK virus
QTCFASLGILA

SEQ ID NO: 11660 - protein, 11 aa, BK virus
TCFASLGILAL

SEQ ID NO: 11661 - protein, 11 aa, BK virus
CFASLGILALS

SEQ ID NO: 11662 - protein, 11 aa, BK virus
FASLGILALSP

SEQ ID NO: 11663 - protein, 11 aa, BK virus
ASLGILALSPV

SEQ ID NO: 11664 - protein, 11 aa, BK virus
SLGILALSPVK

SEQ ID NO: 11665 - protein, 11 aa, BK virus
LGILALSPVKL

SEQ ID NO: 11666 - protein, 11 aa, BK virus
GILALSPVKLD

SEQ ID NO: 11667 - protein, 11 aa, BK virus
ILALSPVKLDK

SEQ ID NO: 11668 - protein, 11 aa, BK virus
LALSPVKLDKG

SEQ ID NO: 11669 - protein, 11 aa, BK virus
ALSPVKLDKGH

SEQ ID NO: 11670 - protein, 11 aa, BK virus
LSPVKLDKGHG

SEQ ID NO: 11671 - protein, 11 aa, BK virus
SPVKLDKGHGS

SEQ ID NO: 11672 - protein, 11 aa, BK virus
PVKLDKGHGSA

SEQ ID NO: 11673 - protein, 11 aa, BK virus
VKLDKGHGSAP

SEQ ID NO: 11674 - protein, 11 aa, BK virus
KLDKGHGSAPA

SEQ ID NO: 11675 - protein, 11 aa, BK virus
LDKGHGSAPAV

SEQ ID NO: 11676 - protein, 11 aa, BK virus
DKGHGSAPAVT

SEQ ID NO: 11677 - protein, 11 aa, BK virus
KGHGSAPAVTT

SEQ ID NO: 11678 - protein, 11 aa, BK virus
GHGSAPAVTTS

SEQ ID NO: 11679 - protein, 11 aa, BK virus
HGSAPAVTTSF

SEQ ID NO: 11680 - protein, 11 aa, BK virus
GSAPAVTTSFS

SEQ ID NO: 11681 - protein, 11 aa, BK virus
SAPAVTTSFSE

SEQ ID NO: 11682 - protein, 11 aa, BK virus
APAVTTSFSES

SEQ ID NO: 11683 - protein, 11 aa, BK virus
PAVTTSFSESW

SEQ ID NO: 11684 - protein, 11 aa, BK virus
NLDWNKKKSSE

SEQ ID NO: 11685 - protein, 11 aa, BK virus
LDWNKKKSSED

SEQ ID NO: 11686 - protein, 11 aa, BK virus
DWNKKKSSEDF

SEQ ID NO: 11687 - protein, 11 aa, BK virus
WNKKKSSEDFY

SEQ ID NO: 11688 - protein, 11 aa, BK virus
NKKKSSEDFYF

SEQ ID NO: 11689 - protein, 11 aa, BK virus
KKKSSEDFYFY

SEQ ID NO: 11690 - protein, 11 aa, BK virus
KKSSEDFYFYF

SEQ ID NO: 11691 - protein, 11 aa, BK virus
KSSEDFYFYFR

SEQ ID NO: 11692 - protein, 11 aa, BK virus
SSEDFYFYFRA

SEQ ID NO: 11693 - protein, 11 aa, BK virus
SEDFYFYFRAF

SEQ ID NO: 11694 - protein, 11 aa, BK virus
EDFYFYFRAFA

SEQ ID NO: 11695 - protein, 11 aa, BK virus
DFYFYFRAFAG

SEQ ID NO: 11696 - protein, 11 aa, BK virus
FYFYFRAFAGI

SEQ ID NO: 11697 - protein, 11 aa, BK virus
YFYFRAFAGIL

SEQ ID NO: 11698 - protein, 11 aa, BK virus
RQCRREKQKYH

SEQ ID NO: 11699 - protein, 11 aa, BK virus
QCRREKQKYHC

SEQ ID NO: 11700 - protein, 11 aa, BK virus
CRREKQKYHCF

SEQ ID NO: 11701 - protein, 11 aa, BK virus
RREKQKYHCFT

SEQ ID NO: 11702 - protein, 11 aa, BK virus
REKQKYHCFTC

SEQ ID NO: 11703 - protein, 11 aa, BK virus
EKQKYHCFTCC

SEQ ID NO: 11704 - protein, 11 aa, BK virus
KQKYHCFTCCK

SEQ ID NO: 11705 - protein, 11 aa, BK virus
QKYHCFTCCKR

SEQ ID NO: 11706 - protein, 11 aa, BK virus
KYHCFTCCKRL

SEQ ID NO: 11707 - protein, 11 aa, BK virus
YHCFTCCKRLC

SEQ ID NO: 11708 - protein, 11 aa, BK virus
HCFTCCKRLCK

SEQ ID NO: 11709 - protein, 11 aa, BK virus
CFTCCKRLCKR

SEQ ID NO: 11710 - protein, 11 aa, BK virus
FTCCKRLCKRL

SEQ ID NO: 11711 - protein, 11 aa, BK virus
TCCKRLCKRLL

SEQ ID NO: 11712 - protein, 11 aa, BK virus
CCKRLCKRLLG

SEQ ID NO: 11713 - protein, 11 aa, BK virus
CKRLCKRLLGK

SEQ ID NO: 11714 - protein, 11 aa, BK virus
SLFFCISRFMG

SEQ ID NO: 11715 - protein, 11 aa, BK virus
LFFCISRFMGA

SEQ ID NO: 11716 - protein, 11 aa, BK virus
FFCISRFMGAA

SEQ ID NO: 11717 - protein, 11 aa, BK virus
FCISRFMGAAL

SEQ ID NO: 11718 - protein, 11 aa, BK virus
CISRFMGAALA

SEQ ID NO: 11719 - protein, 11 aa, BK virus
ISRFMGAALAL

SEQ ID NO: 11720 - protein, 11 aa, BK virus
SRFMGAALALL

SEQ ID NO: 11721 - protein, 11 aa, BK virus
RFMGAALALLG

SEQ ID NO: 11722 - protein, 11 aa, BK virus
FMGAALALLGD

SEQ ID NO: 11723 - protein, 11 aa, BK virus
MGAALALLGDL

SEQ ID NO: 11724 - protein, 11 aa, BK virus
GAALALLGDLV

SEQ ID NO: 11725 - protein, 11 aa, BK virus
AALALLGDLVA

SEQ ID NO: 11726 - protein, 11 aa, BK virus
ALALLGDLVAS

SEQ ID NO: 11727 - protein, 11 aa, BK virus
LALLGDLVASV

SEQ ID NO: 11728 - protein, 11 aa, BK virus
ALLGDLVASVS

SEQ ID NO: 11729 - protein, 11 aa, BK virus
LLGDLVASVSE

SEQ ID NO: 11730 - protein, 11 aa, BK virus
LGDLVASVSEA

SEQ ID NO: 11731 - protein, 11 aa, BK virus
GDLVASVSEAA

SEQ ID NO: 11732 - protein, 11 aa, BK virus
DLVASVSEAAA

SEQ ID NO: 11733 - protein, 11 aa, BK virus
LVASVSEAAAA

SEQ ID NO: 11734 - protein, 11 aa, BK virus
VASVSEAAAAT

SEQ ID NO: 11735 - protein, 11 aa, BK virus
ASVSEAAAATG

SEQ ID NO: 11736 - protein, 11 aa, BK virus
SVSEAAAATGF

SEQ ID NO: 11737 - protein, 11 aa, BK virus
VSEAAAATGFS

SEQ ID NO: 11738 - protein, 11 aa, BK virus
SEAAAATGFSV

SEQ ID NO: 11739 - protein, 11 aa, BK virus
EAAAATGFSVA

SEQ ID NO: 11740 - protein, 11 aa, BK virus
AAAATGFSVAE

SEQ ID NO: 11741 - protein, 11 aa, BK virus
AAATGFSVAEI

SEQ ID NO: 11742 - protein, 11 aa, BK virus
AATGFSVAEIA

SEQ ID NO: 11743 - protein, 11 aa, BK virus
ATGFSVAEIAA

SEQ ID NO: 11744 - protein, 11 aa, BK virus
TGFSVAEIAAG

SEQ ID NO: 11745 - protein, 11 aa, BK virus
GFSVAEIAAGE

SEQ ID NO: 11746 - protein, 11 aa, BK virus
FSVAEIAAGEA

SEQ ID NO: 11747 - protein, 11 aa, BK virus
SVAEIAAGEAA

SEQ ID NO: 11748 - protein, 11 aa, BK virus
VAEIAAGEAAA

SEQ ID NO: 11749 - protein, 11 aa, BK virus
AEIAAGEAAAA

SEQ ID NO: 11750 - protein, 11 aa, BK virus
EIAAGEAAAAI

SEQ ID NO: 11751 - protein, 11 aa, BK virus
IAAGEAAAAIE

SEQ ID NO: 11752 - protein, 11 aa, BK virus
AAGEAAAAIEV

SEQ ID NO: 11753 - protein, 11 aa, BK virus
AGEAAAAIEVQ

SEQ ID NO: 11754 - protein, 11 aa, BK virus
GEAAAAIEVQI

SEQ ID NO: 11755 - protein, 11 aa, BK virus
EAAAAIEVQIA

SEQ ID NO: 11756 - protein, 11 aa, BK virus
AAAAIEVQIAS

SEQ ID NO: 11757 - protein, 11 aa, BK virus
AAAIEVQIASL

SEQ ID NO: 11758 - protein, 11 aa, BK virus
AAIEVQIASLA

SEQ ID NO: 11759 - protein, 11 aa, BK virus
AIEVQIASLAT

SEQ ID NO: 11760 - protein, 11 aa, BK virus
IEVQIASLATV

SEQ ID NO: 11761 - protein, 11 aa, BK virus
EVQIASLATVE

SEQ ID NO: 11762 - protein, 11 aa, BK virus
VQIASLATVEG

SEQ ID NO: 11763 - protein, 11 aa, BK virus
QIASLATVEGI

SEQ ID NO: 11764 - protein, 11 aa, BK virus
IASLATVEGIT

SEQ ID NO: 11765 - protein, 11 aa, BK virus
ASLATVEGITS

SEQ ID NO: 11766 - protein, 11 aa, BK virus
SLATVEGITST

SEQ ID NO: 11767 - protein, 11 aa, BK virus
LATVEGITSTS

SEQ ID NO: 11768 - protein, 11 aa, BK virus
ATVEGITSTSE

SEQ ID NO: 11769 - protein, 11 aa, BK virus
TVEGITSTSEA

SEQ ID NO: 11770 - protein, 11 aa, BK virus
VEGITSTSEAI

SEQ ID NO: 11771 - protein, 11 aa, BK virus
EGITSTSEAIA

SEQ ID NO: 11772 - protein, 11 aa, BK virus
GITSTSEAIAA

SEQ ID NO: 11773 - protein, 11 aa, BK virus
ITSTSEAIAAI

SEQ ID NO: 11774 - protein, 11 aa, BK virus
TSTSEAIAAIG

SEQ ID NO: 11775 - protein, 11 aa, BK virus
STSEAIAAIGL

SEQ ID NO: 11776 - protein, 11 aa, BK virus
TSEAIAAIGLT

SEQ ID NO: 11777 - protein, 11 aa, BK virus
SEAIAAIGLTP

SEQ ID NO: 11778 - protein, 11 aa, BK virus
EAIAAIGLTPQ

SEQ ID NO: 11779 - protein, 11 aa, BK virus
AIAAIGLTPQT

SEQ ID NO: 11780 - protein, 11 aa, BK virus
IAAIGLTPQTY

SEQ ID NO: 11781 - protein, 11 aa, BK virus
AAIGLTPQTYA

SEQ ID NO: 11782 - protein, 11 aa, BK virus
AIGLTPQTYAV

SEQ ID NO: 11783 - protein, 11 aa, BK virus
IGLTPQTYAVI

SEQ ID NO: 11784 - protein, 11 aa, BK virus
GLTPQTYAVIA

SEQ ID NO: 11785 - protein, 11 aa, BK virus
LTPQTYAVIAG

SEQ ID NO: 11786 - protein, 11 aa, BK virus
TPQTYAVIAGA

SEQ ID NO: 11787 - protein, 11 aa, BK virus
PQTYAVIAGAP

SEQ ID NO: 11788 - protein, 11 aa, BK virus
QTYAVIAGAPG

SEQ ID NO: 11789 - protein, 11 aa, BK virus
TYAVIAGAPGA

SEQ ID NO: 11790 - protein, 11 aa, BK virus
YAVIAGAPGAI

SEQ ID NO: 11791 - protein, 11 aa, BK virus
AVIAGAPGAIA

SEQ ID NO: 11792 - protein, 11 aa, BK virus
VIAGAPGAIAG

SEQ ID NO: 11793 - protein, 11 aa, BK virus
IAGAPGAIAGF

SEQ ID NO: 11794 - protein, 11 aa, BK virus
AGAPGAIAGFA

SEQ ID NO: 11795 - protein, 11 aa, BK virus
GAPGAIAGFAA

SEQ ID NO: 11796 - protein, 11 aa, BK virus
APGAIAGFAAL

SEQ ID NO: 11797 - protein, 11 aa, BK virus
PGAIAGFAALI

SEQ ID NO: 11798 - protein, 11 aa, BK virus
GAIAGFAALIQ

SEQ ID NO: 11799 - protein, 11 aa, BK virus
AIAGFAALIQT

SEQ ID NO: 11800 - protein, 11 aa, BK virus
IAGFAALIQTV

SEQ ID NO: 11801 - protein, 11 aa, BK virus
AGFAALIQTVS

SEQ ID NO: 11802 - protein, 11 aa, BK virus
GFAALIQTVSG

SEQ ID NO: 11803 - protein, 11 aa, BK virus
FAALIQTVSGI

SEQ ID NO: 11804 - protein, 11 aa, BK virus
AALIQTVSGIS

SEQ ID NO: 11805 - protein, 11 aa, BK virus
ALIQTVSGISS

SEQ ID NO: 11806 - protein, 11 aa, BK virus
LIQTVSGISSL

SEQ ID NO: 11807 - protein, 11 aa, BK virus
IQTVSGISSLA

SEQ ID NO: 11808 - protein, 11 aa, BK virus
QTVSGISSLAQ

SEQ ID NO: 11809 - protein, 11 aa, BK virus
TVSGISSLAQV

SEQ ID NO: 11810 - protein, 11 aa, BK virus
VSGISSLAQVG

SEQ ID NO: 11811 - protein, 11 aa, BK virus
SGISSLAQVGY

SEQ ID NO: 11812 - protein, 11 aa, BK virus
GISSLAQVGYK

SEQ ID NO: 11813 - protein, 11 aa, BK virus
ISSLAQVGYKF

SEQ ID NO: 11814 - protein, 11 aa, BK virus
SSLAQVGYKFF

SEQ ID NO: 11815 - protein, 11 aa, BK virus
SLAQVGYKFFD

SEQ ID NO: 11816 - protein, 11 aa, BK virus
LAQVGYKFFDD

SEQ ID NO: 11817 - protein, 11 aa, BK virus
AQVGYKFFDDW

SEQ ID NO: 11818 - protein, 11 aa, BK virus
QVGYKFFDDWD

SEQ ID NO: 11819 - protein, 11 aa, BK virus
VGYKFFDDWDH

SEQ ID NO: 11820 - protein, 11 aa, BK virus
GYKFFDDWDHK

SEQ ID NO: 11821 - protein, 11 aa, BK virus
YKFFDDWDHKV

SEQ ID NO: 11822 - protein, 11 aa, BK virus
KFFDDWDHKVS

SEQ ID NO: 11823 - protein, 11 aa, BK virus
FFDDWDHKVST

SEQ ID NO: 11824 - protein, 11 aa, BK virus
FDDWDHKVSTV

SEQ ID NO: 11825 - protein, 11 aa, BK virus
DDWDHKVSTVG

SEQ ID NO: 11826 - protein, 11 aa, BK virus
DWDHKVSTVGL

SEQ ID NO: 11827 - protein, 11 aa, BK virus
WDHKVSTVGLY

SEQ ID NO: 11828 - protein, 11 aa, BK virus
DHKVSTVGLYQ

SEQ ID NO: 11829 - protein, 11 aa, BK virus
HKVSTVGLYQQ

SEQ ID NO: 11830 - protein, 11 aa, BK virus
KVSTVGLYQQS

SEQ ID NO: 11831 - protein, 11 aa, BK virus
VSTVGLYQQSG

SEQ ID NO: 11832 - protein, 11 aa, BK virus
STVGLYQQSGM

SEQ ID NO: 11833 - protein, 11 aa, BK virus
TVGLYQQSGMA

SEQ ID NO: 11834 - protein, 11 aa, BK virus
VGLYQQSGMAL

SEQ ID NO: 11835 - protein, 11 aa, BK virus
GLYQQSGMALE

SEQ ID NO: 11836 - protein, 11 aa, BK virus
LYQQSGMALEL

SEQ ID NO: 11837 - protein, 11 aa, BK virus
YQQSGMALELF

SEQ ID NO: 11838 - protein, 11 aa, BK virus
QQSGMALELFN

SEQ ID NO: 11839 - protein, 11 aa, BK virus
QSGMALELFNP

SEQ ID NO: 11840 - protein, 11 aa, BK virus
SGMALELFNPD

SEQ ID NO: 11841 - protein, 11 aa, BK virus
GMALELFNPDE

SEQ ID NO: 11842 - protein, 11 aa, BK virus
MALELFNPDEY

SEQ ID NO: 11843 - protein, 11 aa, BK virus
ALELFNPDEYY

SEQ ID NO: 11844 - protein, 11 aa, BK virus
LELFNPDEYYD

SEQ ID NO: 11845 - protein, 11 aa, BK virus
ELFNPDEYYDI

SEQ ID NO: 11846 - protein, 11 aa, BK virus
LFNPDEYYDIL

SEQ ID NO: 11847 - protein, 11 aa, BK virus
FNPDEYYDILF

SEQ ID NO: 11848 - protein, 11 aa, BK virus
NPDEYYDILFP

SEQ ID NO: 11849 - protein, 11 aa, BK virus
PDEYYDILFPG

SEQ ID NO: 11850 - protein, 11 aa, BK virus
DEYYDILFPGV

SEQ ID NO: 11851 - protein, 11 aa, BK virus
EYYDILFPGVN

SEQ ID NO: 11852 - protein, 11 aa, BK virus
YYDILFPGVNT

SEQ ID NO: 11853 - protein, 11 aa, BK virus
YDILFPGVNTF

SEQ ID NO: 11854 - protein, 11 aa, BK virus
DILFPGVNTFV

SEQ ID NO: 11855 - protein, 11 aa, BK virus
ILFPGVNTFVN

SEQ ID NO: 11856 - protein, 11 aa, BK virus
LFPGVNTFVNN

SEQ ID NO: 11857 - protein, 11 aa, BK virus
FPGVNTFVNNI

SEQ ID NO: 11858 - protein, 11 aa, BK virus
PGVNTFVNNIQ

SEQ ID NO: 11859 - protein, 11 aa, BK virus
GVNTFVNNIQY

SEQ ID NO: 11860 - protein, 11 aa, BK virus
VNTFVNNIQYL

SEQ ID NO: 11861 - protein, 11 aa, BK virus
NTFVNNIQYLD

SEQ ID NO: 11862 - protein, 11 aa, BK virus
TFVNNIQYLDP

SEQ ID NO: 11863 - protein, 11 aa, BK virus
FVNNIQYLDPR

SEQ ID NO: 11864 - protein, 11 aa, BK virus
VNNIQYLDPRH

SEQ ID NO: 11865 - protein, 11 aa, BK virus
NNIQYLDPRHW

SEQ ID NO: 11866 - protein, 11 aa, BK virus
NIQYLDPRHWG

SEQ ID NO: 11867 - protein, 11 aa, BK virus
IQYLDPRHWGP

SEQ ID NO: 11868 - protein, 11 aa, BK virus
QYLDPRHWGPS

SEQ ID NO: 11869 - protein, 11 aa, BK virus
YLDPRHWGPSL

SEQ ID NO: 11870 - protein, 11 aa, BK virus
LDPRHWGPSLF

SEQ ID NO: 11871 - protein, 11 aa, BK virus
DPRHWGPSLFA

SEQ ID NO: 11872 - protein, 11 aa, BK virus
PRHWGPSLFAT

SEQ ID NO: 11873 - protein, 11 aa, BK virus
RHWGPSLFATI

SEQ ID NO: 11874 - protein, 11 aa, BK virus
HWGPSLFATIS

SEQ ID NO: 11875 - protein, 11 aa, BK virus
WGPSLFATISQ

SEQ ID NO: 11876 - protein, 11 aa, BK virus
GPSLFATISQA

SEQ ID NO: 11877 - protein, 11 aa, BK virus
PSLFATISQAL

SEQ ID NO: 11878 - protein, 11 aa, BK virus
SLFATISQALW

SEQ ID NO: 11879 - protein, 11 aa, BK virus
LFATISQALWH

SEQ ID NO: 11880 - protein, 11 aa, BK virus
FATISQALWHV

SEQ ID NO: 11881 - protein, 11 aa, BK virus
ATISQALWHVI

SEQ ID NO: 11882 - protein, 11 aa, BK virus
TISQALWHVIR

SEQ ID NO: 11883 - protein, 11 aa, BK virus
ISQALWHVIRD

SEQ ID NO: 11884 - protein, 11 aa, BK virus
SQALWHVIRDD

SEQ ID NO: 11885 - protein, 11 aa, BK virus
QALWHVIRDDI

SEQ ID NO: 11886 - protein, 11 aa, BK virus
ALWHVIRDDIP

SEQ ID NO: 11887 - protein, 11 aa, BK virus
LWHVIRDDIPS

SEQ ID NO: 11888 - protein, 11 aa, BK virus
WHVIRDDIPSI

SEQ ID NO: 11889 - protein, 11 aa, BK virus
HVIRDDIPSIT

SEQ ID NO: 11890 - protein, 11 aa, BK virus
VIRDDIPSITS

SEQ ID NO: 11891 - protein, 11 aa, BK virus
IRDDIPSITSQ

SEQ ID NO: 11892 - protein, 11 aa, BK virus
RDDIPSITSQE

SEQ ID NO: 11893 - protein, 11 aa, BK virus
DDIPSITSQEL

SEQ ID NO: 11894 - protein, 11 aa, BK virus
DIPSITSQELQ

SEQ ID NO: 11895 - protein, 11 aa, BK virus
IPSITSQELQR

SEQ ID NO: 11896 - protein, 11 aa, BK virus
PSITSQELQRR

SEQ ID NO: 11897 - protein, 11 aa, BK virus
SITSQELQRRT

SEQ ID NO: 11898 - protein, 11 aa, BK virus
ITSQELQRRTE

SEQ ID NO: 11899 - protein, 11 aa, BK virus
TSQELQRRTER

SEQ ID NO: 11900 - protein, 11 aa, BK virus
SQELQRRTERF

SEQ ID NO: 11901 - protein, 11 aa, BK virus
QELQRRTERFF

SEQ ID NO: 11902 - protein, 11 aa, BK virus
ELQRRTERFFR

SEQ ID NO: 11903 - protein, 11 aa, BK virus
LQRRTERFFRD

SEQ ID NO: 11904 - protein, 11 aa, BK virus
QRRTERFFRDS

SEQ ID NO: 11905 - protein, 11 aa, BK virus
RRTERFFRDSL

SEQ ID NO: 11906 - protein, 11 aa, BK virus
RTERFFRDSLA

SEQ ID NO: 11907 - protein, 11 aa, BK virus
TERFFRDSLAR

SEQ ID NO: 11908 - protein, 11 aa, BK virus
ERFFRDSLARF

SEQ ID NO: 11909 - protein, 11 aa, BK virus
RFFRDSLARFL

SEQ ID NO: 11910 - protein, 11 aa, BK virus
FFRDSLARFLE

SEQ ID NO: 11911 - protein, 11 aa, BK virus
FRDSLARFLEE

SEQ ID NO: 11912 - protein, 11 aa, BK virus
RDSLARFLEET

SEQ ID NO: 11913 - protein, 11 aa, BK virus
DSLARFLEETT

SEQ ID NO: 11914 - protein, 11 aa, BK virus
SLARFLEETTW

SEQ ID NO: 11915 - protein, 11 aa, BK virus
LARFLEETTWT

SEQ ID NO: 11916 - protein, 11 aa, BK virus
ARFLEETTWTI

SEQ ID NO: 11917 - protein, 11 aa, BK virus
RFLEETTWTIV

SEQ ID NO: 11918 - protein, 11 aa, BK virus
FLEETTWTIVN

SEQ ID NO: 11919 - protein, 11 aa, BK virus
LEETTWTIVNA

SEQ ID NO: 11920 - protein, 11 aa, BK virus
EETTWTIVNAP

SEQ ID NO: 11921 - protein, 11 aa, BK virus
ETTWTIVNAPI

SEQ ID NO: 11922 - protein, 11 aa, BK virus
TTWTIVNAPIN

SEQ ID NO: 11923 - protein, 11 aa, BK virus
TWTIVNAPINF

SEQ ID NO: 11924 - protein, 11 aa, BK virus
WTIVNAPINFY

SEQ ID NO: 11925 - protein, 11 aa, BK virus
TIVNAPINFYN

SEQ ID NO: 11926 - protein, 11 aa, BK virus
IVNAPINFYNY

SEQ ID NO: 11927 - protein, 11 aa, BK virus
VNAPINFYNYI

SEQ ID NO: 11928 - protein, 11 aa, BK virus
NAPINFYNYIQ

SEQ ID NO: 11929 - protein, 11 aa, BK virus
APINFYNYIQQ

SEQ ID NO: 11930 - protein, 11 aa, BK virus
PINFYNYIQQY

SEQ ID NO: 11931 - protein, 11 aa, BK virus
INFYNYIQQYY

SEQ ID NO: 11932 - protein, 11 aa, BK virus
NFYNYIQQYYS

SEQ ID NO: 11933 - protein, 11 aa, BK virus
FYNYIQQYYSD

SEQ ID NO: 11934 - protein, 11 aa, BK virus
YNYIQQYYSDL

SEQ ID NO: 11935 - protein, 11 aa, BK virus
NYIQQYYSDLS

SEQ ID NO: 11936 - protein, 11 aa, BK virus
YIQQYYSDLSP

SEQ ID NO: 11937 - protein, 11 aa, BK virus
IQQYYSDLSPI

SEQ ID NO: 11938 - protein, 11 aa, BK virus
QQYYSDLSPIR

SEQ ID NO: 11939 - protein, 11 aa, BK virus
QYYSDLSPIRP

SEQ ID NO: 11940 - protein, 11 aa, BK virus
YYSDLSPIRPS

SEQ ID NO: 11941 - protein, 11 aa, BK virus
YSDLSPIRPSM

SEQ ID NO: 11942 - protein, 11 aa, BK virus
SDLSPIRPSMV

SEQ ID NO: 11943 - protein, 11 aa, BK virus
DLSPIRPSMVR

SEQ ID NO: 11944 - protein, 11 aa, BK virus
LSPIRPSMVRQ

SEQ ID NO: 11945 - protein, 11 aa, BK virus
SPIRPSMVRQV

SEQ ID NO: 11946 - protein, 11 aa, BK virus
PIRPSMVRQVA

SEQ ID NO: 11947 - protein, 11 aa, BK virus
IRPSMVRQVAE

SEQ ID NO: 11948 - protein, 11 aa, BK virus
RPSMVRQVAER

SEQ ID NO: 11949 - protein, 11 aa, BK virus
PSMVRQVAERE

SEQ ID NO: 11950 - protein, 11 aa, BK virus
SMVRQVAEREG

SEQ ID NO: 11951 - protein, 11 aa, BK virus
MVRQVAEREGT

SEQ ID NO: 11952 - protein, 11 aa, BK virus
VRQVAEREGTR

SEQ ID NO: 11953 - protein, 11 aa, BK virus
RQVAEREGTRV

SEQ ID NO: 11954 - protein, 11 aa, BK virus
QVAEREGTRVH

SEQ ID NO: 11955 - protein, 11 aa, BK virus
VAEREGTRVHF

SEQ ID NO: 11956 - protein, 11 aa, BK virus
AEREGTRVHFG

SEQ ID NO: 11957 - protein, 11 aa, BK virus
EREGTRVHFGH

SEQ ID NO: 11958 - protein, 11 aa, BK virus
REGTRVHFGHT

SEQ ID NO: 11959 - protein, 11 aa, BK virus
EGTRVHFGHTY

SEQ ID NO: 11960 - protein, 11 aa, BK virus
GTRVHFGHTYS

SEQ ID NO: 11961 - protein, 11 aa, BK virus
TRVHFGHTYSI

SEQ ID NO: 11962 - protein, 11 aa, BK virus
RVHFGHTYSID

SEQ ID NO: 11963 - protein, 11 aa, BK virus
VHFGHTYSIDD

SEQ ID NO: 11964 - protein, 11 aa, BK virus
HFGHTYSIDDA

SEQ ID NO: 11965 - protein, 11 aa, BK virus
FGHTYSIDDAD

SEQ ID NO: 11966 - protein, 11 aa, BK virus
GHTYSIDDADS

SEQ ID NO: 11967 - protein, 11 aa, BK virus
HTYSIDDADSI

SEQ ID NO: 11968 - protein, 11 aa, BK virus
TYSIDDADSIE

SEQ ID NO: 11969 - protein, 11 aa, BK virus
YSIDDADSIEE

SEQ ID NO: 11970 - protein, 11 aa, BK virus
SIDDADSIEEV

SEQ ID NO: 11971 - protein, 11 aa, BK virus
IDDADSIEEVT

SEQ ID NO: 11972 - protein, 11 aa, BK virus
DDADSIEEVTQ

SEQ ID NO: 11973 - protein, 11 aa, BK virus
DADSIEEVTQR

SEQ ID NO: 11974 - protein, 11 aa, BK virus
ADSIEEVTQRM

SEQ ID NO: 11975 - protein, 11 aa, BK virus
DSIEEVTQRMD

SEQ ID NO: 11976 - protein, 11 aa, BK virus
SIEEVTQRMDL

SEQ ID NO: 11977 - protein, 11 aa, BK virus
IEEVTQRMDLR

SEQ ID NO: 11978 - protein, 11 aa, BK virus
EEVTQRMDLRN

SEQ ID NO: 11979 - protein, 11 aa, BK virus
EVTQRMDLRNQ

SEQ ID NO: 11980 - protein, 11 aa, BK virus
VTQRMDLRNQQ

SEQ ID NO: 11981 - protein, 11 aa, BK virus
TQRMDLRNQQS

SEQ ID NO: 11982 - protein, 11 aa, BK virus
QRMDLRNQQSV

SEQ ID NO: 11983 - protein, 11 aa, BK virus
RMDLRNQQSVH

SEQ ID NO: 11984 - protein, 11 aa, BK virus
MDLRNQQSVHS

SEQ ID NO: 11985 - protein, 11 aa, BK virus
DLRNQQSVHSG

SEQ ID NO: 11986 - protein, 11 aa, BK virus
LRNQQSVHSGE

SEQ ID NO: 11987 - protein, 11 aa, BK virus
RNQQSVHSGEF

SEQ ID NO: 11988 - protein, 11 aa, BK virus
NQQSVHSGEFI

SEQ ID NO: 11989 - protein, 11 aa, BK virus
QQSVHSGEFIE

SEQ ID NO: 11990 - protein, 11 aa, BK virus
QSVHSGEFIEK

SEQ ID NO: 11991 - protein, 11 aa, BK virus
SVHSGEFIEKT

SEQ ID NO: 11992 - protein, 11 aa, BK virus
VHSGEFIEKTI

SEQ ID NO: 11993 - protein, 11 aa, BK virus
HSGEFIEKTIA

SEQ ID NO: 11994 - protein, 11 aa, BK virus
SGEFIEKTIAP

SEQ ID NO: 11995 - protein, 11 aa, BK virus
GEFIEKTIAPG

SEQ ID NO: 11996 - protein, 11 aa, BK virus
EFIEKTIAPGG

SEQ ID NO: 11997 - protein, 11 aa, BK virus
FIEKTIAPGGA

SEQ ID NO: 11998 - protein, 11 aa, BK virus
IEKTIAPGGAN

SEQ ID NO: 11999 - protein, 11 aa, BK virus
EKTIAPGGANQ

SEQ ID NO: 12000 - protein, 11 aa, BK virus
KTIAPGGANQR

SEQ ID NO: 12001 - protein, 11 aa, BK virus
TIAPGGANQRT

SEQ ID NO: 12002 - protein, 11 aa, BK virus
IAPGGANQRTA

SEQ ID NO: 12003 - protein, 11 aa, BK virus
APGGANQRTAP

SEQ ID NO: 12004 - protein, 11 aa, BK virus
PGGANQRTAPQ

SEQ ID NO: 12005 - protein, 11 aa, BK virus
GGANQRTAPQW

SEQ ID NO: 12006 - protein, 11 aa, BK virus
GANQRTAPQWM

SEQ ID NO: 12007 - protein, 11 aa, BK virus
ANQRTAPQWML

SEQ ID NO: 12008 - protein, 11 aa, BK virus
NQRTAPQWMLP

SEQ ID NO: 12009 - protein, 11 aa, BK virus
QRTAPQWMLPL

SEQ ID NO: 12010 - protein, 11 aa, BK virus
RTAPQWMLPLL

SEQ ID NO: 12011 - protein, 11 aa, BK virus
TAPQWMLPLLL

SEQ ID NO: 12012 - protein, 11 aa, BK virus
APQWMLPLLLG

SEQ ID NO: 12013 - protein, 11 aa, BK virus
PQWMLPLLLGL

SEQ ID NO: 12014 - protein, 11 aa, BK virus
QWMLPLLLGLY

SEQ ID NO: 12015 - protein, 11 aa, BK virus
WMLPLLLGLYG

SEQ ID NO: 12016 - protein, 11 aa, BK virus
MLPLLLGLYGT

SEQ ID NO: 12017 - protein, 11 aa, BK virus
LPLLLGLYGTV

SEQ ID NO: 12018 - protein, 11 aa, BK virus
PLLLGLYGTVT

SEQ ID NO: 12019 - protein, 11 aa, BK virus
LLLGLYGTVTP

SEQ ID NO: 12020 - protein, 11 aa, BK virus
LLGLYGTVTPA

SEQ ID NO: 12021 - protein, 11 aa, BK virus
LGLYGTVTPAL

SEQ ID NO: 12022 - protein, 11 aa, BK virus
GLYGTVTPALE

SEQ ID NO: 12023 - protein, 11 aa, BK virus
LYGTVTPALEA

SEQ ID NO: 12024 - protein, 11 aa, BK virus
YGTVTPALEAY

SEQ ID NO: 12025 - protein, 11 aa, BK virus
GTVTPALEAYE

SEQ ID NO: 12026 - protein, 11 aa, BK virus
TVTPALEAYED

SEQ ID NO: 12027 - protein, 11 aa, BK virus
VTPALEAYEDG

SEQ ID NO: 12028 - protein, 11 aa, BK virus
TPALEAYEDGP

SEQ ID NO: 12029 - protein, 11 aa, BK virus
PALEAYEDGPN

SEQ ID NO: 12030 - protein, 11 aa, BK virus
ALEAYEDGPNQ

SEQ ID NO: 12031 - protein, 11 aa, BK virus
LEAYEDGPNQK

SEQ ID NO: 12032 - protein, 11 aa, BK virus
EAYEDGPNQKK

SEQ ID NO: 12033 - protein, 11 aa, BK virus
AYEDGPNQKKR

SEQ ID NO: 12034 - protein, 11 aa, BK virus
YEDGPNQKKRR

SEQ ID NO: 12035 - protein, 11 aa, BK virus
EDGPNQKKRRV

SEQ ID NO: 12036 - protein, 11 aa, BK virus
DGPNQKKRRVS

SEQ ID NO: 12037 - protein, 11 aa, BK virus
GPNQKKRRVSR

SEQ ID NO: 12038 - protein, 11 aa, BK virus
PNQKKRRVSRG

SEQ ID NO: 12039 - protein, 11 aa, BK virus
NQKKRRVSRGS

SEQ ID NO: 12040 - protein, 11 aa, BK virus
QKKRRVSRGSS

SEQ ID NO: 12041 - protein, 11 aa, BK virus
KKRRVSRGSSQ

SEQ ID NO: 12042 - protein, 11 aa, BK virus
KRRVSRGSSQK

SEQ ID NO: 12043 - protein, 11 aa, BK virus
RRVSRGSSQKA

SEQ ID NO: 12044 - protein, 11 aa, BK virus
RVSRGSSQKAK

SEQ ID NO: 12045 - protein, 11 aa, BK virus
VSRGSSQKAKG

SEQ ID NO: 12046 - protein, 11 aa, BK virus
SRGSSQKAKGT

SEQ ID NO: 12047 - protein, 11 aa, BK virus
RGSSQKAKGTR

SEQ ID NO: 12048 - protein, 11 aa, BK virus
GSSQKAKGTRA

SEQ ID NO: 12049 - protein, 11 aa, BK virus
SSQKAKGTRAS

SEQ ID NO: 12050 - protein, 11 aa, BK virus
SQKAKGTRASA

SEQ ID NO: 12051 - protein, 11 aa, BK virus
QKAKGTRASAK

SEQ ID NO: 12052 - protein, 11 aa, BK virus
KAKGTRASAKT

SEQ ID NO: 12053 - protein, 11 aa, BK virus
AKGTRASAKTT

SEQ ID NO: 12054 - protein, 11 aa, BK virus
KGTRASAKTTN

SEQ ID NO: 12055 - protein, 11 aa, BK virus
GTRASAKTTNK

SEQ ID NO: 12056 - protein, 11 aa, BK virus
TRASAKTTNKR

SEQ ID NO: 12057 - protein, 11 aa, BK virus
RASAKTTNKRR

SEQ ID NO: 12058 - protein, 11 aa, BK virus
ASAKTTNKRRS

SEQ ID NO: 12059 - protein, 11 aa, BK virus
SAKTTNKRRSR

SEQ ID NO: 12060 - protein, 11 aa, BK virus
AKTTNKRRSRS

SEQ ID NO: 12061 - protein, 11 aa, BK virus
KTTNKRRSRSS

SEQ ID NO: 12062 - protein, 11 aa, BK virus
TTNKRRSRSSR

SEQ ID NO: 12063 - protein, 11 aa, BK virus
TNKRRSRSSRS

SEQ ID NO: 12064 - protein, 11 aa, BK virus
NWGRCYYRGRM

SEQ ID NO: 12065 - protein, 11 aa, BK virus
WGRCYYRGRML

SEQ ID NO: 12066 - protein, 11 aa, BK virus
GRCYYRGRMLP

SEQ ID NO: 12067 - protein, 11 aa, BK virus
RCYYRGRMLPK

SEQ ID NO: 12068 - protein, 11 aa, BK virus
CYYRGRMLPKP

SEQ ID NO: 12069 - protein, 11 aa, BK virus
YYRGRMLPKPR

SEQ ID NO: 12070 - protein, 11 aa, BK virus
YRGRMLPKPRN

SEQ ID NO: 12071 - protein, 11 aa, BK virus
RGRMLPKPRNG

SEQ ID NO: 12072 - protein, 11 aa, BK virus
GRMLPKPRNGG

SEQ ID NO: 12073 - protein, 11 aa, BK virus
RMLPKPRNGGS

SEQ ID NO: 12074 - protein, 11 aa, BK virus
MLPKPRNGGSR

SEQ ID NO: 12075 - protein, 11 aa, BK virus
PREKNASLLQH

SEQ ID NO: 12076 - protein, 11 aa, BK virus
REKNASLLQHS

SEQ ID NO: 12077 - protein, 11 aa, BK virus
EKNASLLQHSK

SEQ ID NO: 12078 - protein, 11 aa, BK virus
KNASLLQHSKN

SEQ ID NO: 12079 - protein, 11 aa, BK virus
NASLLQHSKNS

SEQ ID NO: 12080 - protein, 11 aa, BK virus
ASLLQHSKNSP

SEQ ID NO: 12081 - protein, 11 aa, BK virus
SLLQHSKNSPP

SEQ ID NO: 12082 - protein, 11 aa, BK virus
LLQHSKNSPPQ

SEQ ID NO: 12083 - protein, 11 aa, BK virus
LQHSKNSPPQF

SEQ ID NO: 12084 - protein, 11 aa, BK virus
QHSKNSPPQFK

SEQ ID NO: 12085 - protein, 11 aa, BK virus
GPNLWKSTDVG

SEQ ID NO: 12086 - protein, 11 aa, BK virus
PNLWKSTDVGG

SEQ ID NO: 12087 - protein, 11 aa, BK virus
NLWKSTDVGGC

SEQ ID NO: 12088 - protein, 11 aa, BK virus
LWKSTDVGGCN

SEQ ID NO: 12089 - protein, 11 aa, BK virus
WKSTDVGGCNC

SEQ ID NO: 12090 - protein, 11 aa, BK virus
KSTDVGGCNCT

SEQ ID NO: 12091 - protein, 11 aa, BK virus
STDVGGCNCTN

SEQ ID NO: 12092 - protein, 11 aa, BK virus
TDVGGCNCTNR

SEQ ID NO: 12093 - protein, 11 aa, BK virus
DVGGCNCTNRG

SEQ ID NO: 12094 - protein, 11 aa, BK virus
VGGCNCTNRGY

SEQ ID NO: 12095 - protein, 11 aa, BK virus
GGCNCTNRGYW

SEQ ID NO: 12096 - protein, 11 aa, BK virus
GCNCTNRGYWN

SEQ ID NO: 12097 - protein, 11 aa, BK virus
CNCTNRGYWNN

SEQ ID NO: 12098 - protein, 11 aa, BK virus
FPLLCCRWRTL

SEQ ID NO: 12099 - protein, 11 aa, BK virus
PLLCCRWRTLG

SEQ ID NO: 12100 - protein, 11 aa, BK virus
LLCCRWRTLGN

SEQ ID NO: 12101 - protein, 11 aa, BK virus
LCCRWRTLGNA

SEQ ID NO: 12102 - protein, 11 aa, BK virus
CCRWRTLGNAG

SEQ ID NO: 12103 - protein, 11 aa, BK virus
CRWRTLGNAGS

SEQ ID NO: 12104 - protein, 11 aa, BK virus
RWRTLGNAGSA

SEQ ID NO: 12105 - protein, 11 aa, BK virus
WRTLGNAGSAN

SEQ ID NO: 12106 - protein, 11 aa, BK virus
RTLGNAGSANE

SEQ ID NO: 12107 - protein, 11 aa, BK virus
TLGNAGSANEL

SEQ ID NO: 12108 - protein, 11 aa, BK virus
LGNAGSANELQ

SEQ ID NO: 12109 - protein, 11 aa, BK virus
GNAGSANELQV

SEQ ID NO: 12110 - protein, 11 aa, BK virus
NAGSANELQVK

SEQ ID NO: 12111 - protein, 11 aa, BK virus
AGSANELQVKV

SEQ ID NO: 12112 - protein, 11 aa, BK virus
GSANELQVKVP

SEQ ID NO: 12113 - protein, 11 aa, BK virus
KPNSPVPGNEY

SEQ ID NO: 12114 - protein, 11 aa, BK virus
GLFGQKQCLSS

SEQ ID NO: 12115 - protein, 11 aa, BK virus
VFWDFHRRGKC

SEQ ID NO: 12116 - protein, 11 aa, BK virus
FWDFHRRGKCS

SEQ ID NO: 12117 - protein, 11 aa, BK virus
WDFHRRGKCSP

SEQ ID NO: 12118 - protein, 11 aa, BK virus
DFHRRGKCSPS

SEQ ID NO: 12119 - protein, 11 aa, BK virus
FHRRGKCSPST

SEQ ID NO: 12120 - protein, 11 aa, BK virus
HRRGKCSPSTS

SEQ ID NO: 12121 - protein, 11 aa, BK virus
RRGKCSPSTSC

SEQ ID NO: 12122 - protein, 11 aa, BK virus
RGKCSPSTSCD

SEQ ID NO: 12123 - protein, 11 aa, BK virus
GKCSPSTSCDQ

SEQ ID NO: 12124 - protein, 11 aa, BK virus
KCSPSTSCDQH

SEQ ID NO: 12125 - protein, 11 aa, BK virus
CSPSTSCDQHS

SEQ ID NO: 12126 - protein, 11 aa, BK virus
SPSTSCDQHSY

SEQ ID NO: 12127 - protein, 11 aa, BK virus
PSTSCDQHSYH

SEQ ID NO: 12128 - protein, 11 aa, BK virus
STSCDQHSYHS

SEQ ID NO: 12129 - protein, 11 aa, BK virus
TSCDQHSYHSV

SEQ ID NO: 12130 - protein, 11 aa, BK virus
SCDQHSYHSVA

SEQ ID NO: 12131 - protein, 11 aa, BK virus
CDQHSYHSVAR

SEQ ID NO: 12132 - protein, 11 aa, BK virus
QLWNTTVERPC

SEQ ID NO: 12133 - protein, 11 aa, BK virus
LWNTTVERPCK

SEQ ID NO: 12134 - protein, 11 aa, BK virus
WNTTVERPCKI

SEQ ID NO: 12135 - protein, 11 aa, BK virus
NTTVERPCKIF

SEQ ID NO: 12136 - protein, 11 aa, BK virus
DPPEKKICKES

SEQ ID NO: 12137 - protein, 11 aa, BK virus
PPEKKICKESL

SEQ ID NO: 12138 - protein, 11 aa, BK virus
PEKKICKESLP

SEQ ID NO: 12139 - protein, 11 aa, BK virus
EKKICKESLPN

SEQ ID NO: 12140 - protein, 11 aa, BK virus
KKICKESLPNF

SEQ ID NO: 12141 - protein, 11 aa, BK virus
KICKESLPNFL

SEQ ID NO: 12142 - protein, 11 aa, BK virus
ICKESLPNFLF

SEQ ID NO: 12143 - protein, 11 aa, BK virus
CKESLPNFLFA

SEQ ID NO: 12144 - protein, 11 aa, BK virus
KESLPNFLFAK

SEQ ID NO: 12145 - protein, 11 aa, BK virus
PYKQENPESGW

SEQ ID NO: 12146 - protein, 11 aa, BK virus
YKQENPESGWA

SEQ ID NO: 12147 - protein, 11 aa, BK virus
KQENPESGWAA

SEQ ID NO: 12148 - protein, 11 aa, BK virus
QENPESGWAAY

SEQ ID NO: 12149 - protein, 11 aa, BK virus
ENPESGWAAYV

SEQ ID NO: 12150 - protein, 11 aa, BK virus
NPESGWAAYVW

SEQ ID NO: 12151 - protein, 11 aa, BK virus
PESGWAAYVWY

SEQ ID NO: 12152 - protein, 11 aa, BK virus
ESGWAAYVWYG

SEQ ID NO: 12153 - protein, 11 aa, BK virus
SGWAAYVWYGI

SEQ ID NO: 12154 - protein, 11 aa, BK virus
GWAAYVWYGIP

SEQ ID NO: 12155 - protein, 11 aa, BK virus
WAAYVWYGIPG

SEQ ID NO: 12156 - protein, 11 aa, BK virus
AAYVWYGIPGR

SEQ ID NO: 12157 - protein, 11 aa, BK virus
AYVWYGIPGRR

SEQ ID NO: 12158 - protein, 11 aa, BK virus
YVWYGIPGRRG

SEQ ID NO: 12159 - protein, 11 aa, BK virus
WHRKTSRGPRY

SEQ ID NO: 12160 - protein, 11 aa, BK virus
HRKTSRGPRYD

SEQ ID NO: 12161 - protein, 11 aa, BK virus
RKTSRGPRYDK

SEQ ID NO: 12162 - protein, 11 aa, BK virus
KTSRGPRYDKI

SEQ ID NO: 12163 - protein, 11 aa, BK virus
TSRGPRYDKIY

SEQ ID NO: 12164 - protein, 11 aa, BK virus
QTGTIANQNAL

SEQ ID NO: 12165 - protein, 11 aa, BK virus
TGTIANQNALN

SEQ ID NO: 12166 - protein, 11 aa, BK virus
GTIANQNALNR

SEQ ID NO: 12167 - protein, 11 aa, BK virus
TIANQNALNRC

SEQ ID NO: 12168 - protein, 11 aa, BK virus
IANQNALNRCF

SEQ ID NO: 12169 - protein, 11 aa, BK virus
ANQNALNRCFY

SEQ ID NO: 12170 - protein, 11 aa, BK virus
NQNALNRCFYC

SEQ ID NO: 12171 - protein, 11 aa, BK virus
QNALNRCFYCT

SEQ ID NO: 12172 - protein, 11 aa, BK virus
NALNRCFYCTY

SEQ ID NO: 12173 - protein, 11 aa, BK virus
ALNRCFYCTYT

SEQ ID NO: 12174 - protein, 11 aa, BK virus
LNRCFYCTYTF

SEQ ID NO: 12175 - protein, 11 aa, BK virus
NRCFYCTYTFN

SEQ ID NO: 12176 - protein, 11 aa, BK virus
RCFYCTYTFNK

SEQ ID NO: 12177 - protein, 11 aa, BK virus
CFYCTYTFNKC

SEQ ID NO: 12178 - protein, 11 aa, BK virus
FYCTYTFNKCC

SEQ ID NO: 12179 - protein, 11 aa, BK virus
YCTYTFNKCCF

SEQ ID NO: 12180 - protein, 11 aa, BK virus
CTYTFNKCCFC

SEQ ID NO: 12181 - protein, 11 aa, BK virus
TYTFNKCCFCI

SEQ ID NO: 12182 - protein, 11 aa, BK virus
YTFNKCCFCIS

SEQ ID NO: 12183 - protein, 11 aa, BK virus
TFNKCCFCISH

SEQ ID NO: 12184 - protein, 11 aa, BK virus
FNKCCFCISHF

SEQ ID NO: 12185 - protein, 11 aa, BK virus
NTESLYTNATL

SEQ ID NO: 12186 - protein, 11 aa, BK virus
TESLYTNATLD

SEQ ID NO: 12187 - protein, 11 aa, BK virus
ESLYTNATLDY

SEQ ID NO: 12188 - protein, 11 aa, BK virus
SLYTNATLDYG

SEQ ID NO: 12189 - protein, 11 aa, BK virus
LYTNATLDYGG

SEQ ID NO: 12190 - protein, 11 aa, BK virus
YTNATLDYGGL

SEQ ID NO: 12191 - protein, 11 aa, BK virus
TNATLDYGGLT

SEQ ID NO: 12192 - protein, 11 aa, BK virus
NATLDYGGLTF

SEQ ID NO: 12193 - protein, 11 aa, BK virus
ATLDYGGLTFG

SEQ ID NO: 12194 - protein, 11 aa, BK virus
TLDYGGLTFGN

SEQ ID NO: 12195 - protein, 11 aa, BK virus
LDYGGLTFGNL

SEQ ID NO: 12196 - protein, 11 aa, BK virus
DYGGLTFGNLQ

SEQ ID NO: 12197 - protein, 11 aa, BK virus
YGGLTFGNLQQ

SEQ ID NO: 12198 - protein, 11 aa, BK virus
GGLTFGNLQQG

SEQ ID NO: 12199 - protein, 11 aa, BK virus
GLTFGNLQQGL

SEQ ID NO: 12200 - protein, 11 aa, BK virus
LTFGNLQQGLK

SEQ ID NO: 12201 - protein, 11 aa, BK virus
TFGNLQQGLKY

SEQ ID NO: 12202 - protein, 11 aa, BK virus
FGNLQQGLKYL

SEQ ID NO: 12203 - protein, 11 aa, BK virus
GNLQQGLKYLR

SEQ ID NO: 12204 - protein, 11 aa, BK virus
NLQQGLKYLRL

SEQ ID NO: 12205 - protein, 11 aa, BK virus
LQQGLKYLRLG

SEQ ID NO: 12206 - protein, 11 aa, BK virus
QQGLKYLRLGK

SEQ ID NO: 12207 - protein, 11 aa, BK virus
QGLKYLRLGKS

SEQ ID NO: 12208 - protein, 11 aa, BK virus
GLKYLRLGKSI

SEQ ID NO: 12209 - protein, 11 aa, BK virus
LKYLRLGKSIV

SEQ ID NO: 12210 - protein, 11 aa, BK virus
KYLRLGKSIVI

SEQ ID NO: 12211 - protein, 11 aa, BK virus
YLRLGKSIVIG

SEQ ID NO: 12212 - protein, 11 aa, BK virus
LRLGKSIVIGI

SEQ ID NO: 12213 - protein, 11 aa, BK virus
RLGKSIVIGIQ

SEQ ID NO: 12214 - protein, 11 aa, BK virus
LGKSIVIGIQC

SEQ ID NO: 12215 - protein, 11 aa, BK virus
GKSIVIGIQCL

SEQ ID NO: 12216 - protein, 11 aa, BK virus
KSIVIGIQCLI

SEQ ID NO: 12217 - protein, 11 aa, BK virus
SIVIGIQCLIH

SEQ ID NO: 12218 - protein, 11 aa, BK virus
IVIGIQCLIHV

SEQ ID NO: 12219 - protein, 11 aa, BK virus
VIGIQCLIHVQ

SEQ ID NO: 12220 - protein, 11 aa, BK virus
IGIQCLIHVQS

SEQ ID NO: 12221 - protein, 11 aa, BK virus
GIQCLIHVQSL

SEQ ID NO: 12222 - protein, 11 aa, BK virus
IQCLIHVQSLQ

SEQ ID NO: 12223 - protein, 11 aa, BK virus
QCLIHVQSLQF

SEQ ID NO: 12224 - protein, 11 aa, BK virus
CLIHVQSLQFL

SEQ ID NO: 12225 - protein, 11 aa, BK virus
LIHVQSLQFLN

SEQ ID NO: 12226 - protein, 11 aa, BK virus
IHVQSLQFLNP

SEQ ID NO: 12227 - protein, 11 aa, BK virus
HVQSLQFLNPL

SEQ ID NO: 12228 - protein, 11 aa, BK virus
VQSLQFLNPLL

SEQ ID NO: 12229 - protein, 11 aa, BK virus
QSLQFLNPLLL

SEQ ID NO: 12230 - protein, 11 aa, BK virus
YQEYISPCIYY

SEQ ID NO: 12231 - protein, 11 aa, BK virus
QEYISPCIYYI

SEQ ID NO: 12232 - protein, 11 aa, BK virus
EYISPCIYYIS

SEQ ID NO: 12233 - protein, 11 aa, BK virus
YISPCIYYISS

SEQ ID NO: 12234 - protein, 11 aa, BK virus
ISPCIYYISSL

SEQ ID NO: 12235 - protein, 11 aa, BK virus
SPCIYYISSLK

SEQ ID NO: 12236 - protein, 11 aa, BK virus
PCIYYISSLKK

SEQ ID NO: 12237 - protein, 11 aa, BK virus
CIYYISSLKKY

SEQ ID NO: 12238 - protein, 11 aa, BK virus
IYYISSLKKYT

SEQ ID NO: 12239 - protein, 11 aa, BK virus
YYISSLKKYTY

SEQ ID NO: 12240 - protein, 11 aa, BK virus
YISSLKKYTYL

SEQ ID NO: 12241 - protein, 11 aa, BK virus
ISSLKKYTYLS

SEQ ID NO: 12242 - protein, 11 aa, BK virus
SSLKKYTYLSQ

SEQ ID NO: 12243 - protein, 11 aa, BK virus
SLKKYTYLSQN

SEQ ID NO: 12244 - protein, 11 aa, BK virus
LKKYTYLSQNP

SEQ ID NO: 12245 - protein, 11 aa, BK virus
KKYTYLSQNPA

SEQ ID NO: 12246 - protein, 11 aa, BK virus
KYTYLSQNPAF

SEQ ID NO: 12247 - protein, 11 aa, BK virus
YTYLSQNPAFP

SEQ ID NO: 12248 - protein, 11 aa, BK virus
TYLSQNPAFPS

SEQ ID NO: 12249 - protein, 11 aa, BK virus
YLSQNPAFPSI

SEQ ID NO: 12250 - protein, 11 aa, BK virus
LSQNPAFPSIQ

SEQ ID NO: 12251 - protein, 11 aa, BK virus
SQNPAFPSIQQ

SEQ ID NO: 12252 - protein, 11 aa, BK virus
QNPAFPSIQQF

SEQ ID NO: 12253 - protein, 11 aa, BK virus
IVYQLQNQLQA

SEQ ID NO: 12254 - protein, 11 aa, BK virus
TKLAVATRSFH

SEQ ID NO: 12255 - protein, 11 aa, BK virus
KLAVATRSFHF

SEQ ID NO: 12256 - protein, 11 aa, BK virus
LAVATRSFHFV

SEQ ID NO: 12257 - protein, 11 aa, BK virus
AVATRSFHFVK

SEQ ID NO: 12258 - protein, 11 aa, BK virus
VATRSFHFVKF

SEQ ID NO: 12259 - protein, 11 aa, BK virus
ATRSFHFVKFF

SEQ ID NO: 12260 - protein, 11 aa, BK virus
TRSFHFVKFFF

SEQ ID NO: 12261 - protein, 11 aa, BK virus
RSFHFVKFFFQ

SEQ ID NO: 12262 - protein, 11 aa, BK virus
SFHFVKFFFQV

SEQ ID NO: 12263 - protein, 11 aa, BK virus
FHFVKFFFQVR

SEQ ID NO: 12264 - protein, 11 aa, BK virus
HFVKFFFQVRT

SEQ ID NO: 12265 - protein, 11 aa, BK virus
FVKFFFQVRTL

SEQ ID NO: 12266 - protein, 11 aa, BK virus
VKFFFQVRTLS

SEQ ID NO: 12267 - protein, 11 aa, BK virus
KFFFQVRTLSF

SEQ ID NO: 12268 - protein, 11 aa, BK virus
FFFQVRTLSFV

SEQ ID NO: 12269 - protein, 11 aa, BK virus
FFQVRTLSFVR

SEQ ID NO: 12270 - protein, 11 aa, BK virus
FQVRTLSFVRI

SEQ ID NO: 12271 - protein, 11 aa, BK virus
QVRTLSFVRIF

SEQ ID NO: 12272 - protein, 11 aa, BK virus
VRTLSFVRIFL

SEQ ID NO: 12273 - protein, 11 aa, BK virus
RTLSFVRIFLN

SEQ ID NO: 12274 - protein, 11 aa, BK virus
TLSFVRIFLNI

SEQ ID NO: 12275 - protein, 11 aa, BK virus
LSFVRIFLNIF

SEQ ID NO: 12276 - protein, 11 aa, BK virus
SFVRIFLNIFW

SEQ ID NO: 12277 - protein, 11 aa, BK virus
FVRIFLNIFWA

SEQ ID NO: 12278 - protein, 11 aa, BK virus
PSLVEIFGFFC

SEQ ID NO: 12279 - protein, 11 aa, BK virus
SLVEIFGFFCL

SEQ ID NO: 12280 - protein, 11 aa, BK virus
LVEIFGFFCLN

SEQ ID NO: 12281 - protein, 11 aa, BK virus
VEIFGFFCLNV

SEQ ID NO: 12282 - protein, 11 aa, BK virus
EIFGFFCLNVS

SEQ ID NO: 12283 - protein, 11 aa, BK virus
IFGFFCLNVSF

SEQ ID NO: 12284 - protein, 11 aa, BK virus
FGFFCLNVSFL

SEQ ID NO: 12285 - protein, 11 aa, BK virus
GFFCLNVSFLN

SEQ ID NO: 12286 - protein, 11 aa, BK virus
FFCLNVSFLNL

SEQ ID NO: 12287 - protein, 11 aa, BK virus
FCLNVSFLNLP

SEQ ID NO: 12288 - protein, 11 aa, BK virus
HFHLNNLSNCL

SEQ ID NO: 12289 - protein, 11 aa, BK virus
FHLNNLSNCLN

SEQ ID NO: 12290 - protein, 11 aa, BK virus
HLNNLSNCLNC

SEQ ID NO: 12291 - protein, 11 aa, BK virus
LNNLSNCLNCL

SEQ ID NO: 12292 - protein, 11 aa, BK virus
NNLSNCLNCLF

SEQ ID NO: 12293 - protein, 11 aa, BK virus
NLSNCLNCLFH

SEQ ID NO: 12294 - protein, 11 aa, BK virus
LSNCLNCLFHV

SEQ ID NO: 12295 - protein, 11 aa, BK virus
SNCLNCLFHVL

SEQ ID NO: 12296 - protein, 11 aa, BK virus
NCLNCLFHVLK

SEQ ID NO: 12297 - protein, 11 aa, BK virus
CLNCLFHVLKA

SEQ ID NO: 12298 - protein, 11 aa, BK virus
LNCLFHVLKAN

SEQ ID NO: 12299 - protein, 11 aa, BK virus
NCLFHVLKANP

SEQ ID NO: 12300 - protein, 11 aa, BK virus
CLFHVLKANPL

SEQ ID NO: 12301 - protein, 11 aa, BK virus
LFHVLKANPLI

SEQ ID NO: 12302 - protein, 11 aa, BK virus
FHVLKANPLIQ

SEQ ID NO: 12303 - protein, 11 aa, BK virus
HVLKANPLIQL

SEQ ID NO: 12304 - protein, 11 aa, BK virus
VLKANPLIQLL

SEQ ID NO: 12305 - protein, 11 aa, BK virus
LKANPLIQLLS

SEQ ID NO: 12306 - protein, 11 aa, BK virus
KANPLIQLLSL

SEQ ID NO: 12307 - protein, 11 aa, BK virus
ANPLIQLLSLL

SEQ ID NO: 12308 - protein, 11 aa, BK virus
NPLIQLLSLLH

SEQ ID NO: 12309 - protein, 11 aa, BK virus
PLIQLLSLLHL

SEQ ID NO: 12310 - protein, 11 aa, BK virus
LIQLLSLLHLQ

SEQ ID NO: 12311 - protein, 11 aa, BK virus
IQLLSLLHLQK

SEQ ID NO: 12312 - protein, 11 aa, BK virus
QLLSLLHLQKQ

SEQ ID NO: 12313 - protein, 11 aa, BK virus
LLSLLHLQKQP

SEQ ID NO: 12314 - protein, 11 aa, BK virus
LSLLHLQKQPC

SEQ ID NO: 12315 - protein, 11 aa, BK virus
SLLHLQKQPCT

SEQ ID NO: 12316 - protein, 11 aa, BK virus
LLHLQKQPCTD

SEQ ID NO: 12317 - protein, 11 aa, BK virus
LHLQKQPCTDL

SEQ ID NO: 12318 - protein, 11 aa, BK virus
LHLAQRLAFPW

SEQ ID NO: 12319 - protein, 11 aa, BK virus
HLAQRLAFPWV

SEQ ID NO: 12320 - protein, 11 aa, BK virus
LAQRLAFPWVG

SEQ ID NO: 12321 - protein, 11 aa, BK virus
AQRLAFPWVGL

SEQ ID NO: 12322 - protein, 11 aa, BK virus
QRLAFPWVGLH

SEQ ID NO: 12323 - protein, 11 aa, BK virus
RLAFPWVGLHL

SEQ ID NO: 12324 - protein, 11 aa, BK virus
LAFPWVGLHLR

SEQ ID NO: 12325 - protein, 11 aa, BK virus
AFPWVGLHLRL

SEQ ID NO: 12326 - protein, 11 aa, BK virus
FPWVGLHLRLY

SEQ ID NO: 12327 - protein, 11 aa, BK virus
PWVGLHLRLYH

SEQ ID NO: 12328 - protein, 11 aa, BK virus
WVGLHLRLYHH

SEQ ID NO: 12329 - protein, 11 aa, BK virus
VGLHLRLYHHT

SEQ ID NO: 12330 - protein, 11 aa, BK virus
GLHLRLYHHTN

SEQ ID NO: 12331 - protein, 11 aa, BK virus
LHLRLYHHTNL

SEQ ID NO: 12332 - protein, 11 aa, BK virus
HLRLYHHTNLI

SEQ ID NO: 12333 - protein, 11 aa, BK virus
LRLYHHTNLIT

SEQ ID NO: 12334 - protein, 11 aa, BK virus
RLYHHTNLITL

SEQ ID NO: 12335 - protein, 11 aa, BK virus
LYHHTNLITLQ

SEQ ID NO: 12336 - protein, 11 aa, BK virus
YHHTNLITLQL

SEQ ID NO: 12337 - protein, 11 aa, BK virus
HHTNLITLQLV

SEQ ID NO: 12338 - protein, 11 aa, BK virus
HTNLITLQLVL

SEQ ID NO: 12339 - protein, 11 aa, BK virus
TNLITLQLVLF

SEQ ID NO: 12340 - protein, 11 aa, BK virus
NLITLQLVLFF

SEQ ID NO: 12341 - protein, 11 aa, BK virus
LITLQLVLFFH

SEQ ID NO: 12342 - protein, 11 aa, BK virus
ITLQLVLFFHY

SEQ ID NO: 12343 - protein, 11 aa, BK virus
TLQLVLFFHYQ

SEQ ID NO: 12344 - protein, 11 aa, BK virus
LQLVLFFHYQW

SEQ ID NO: 12345 - protein, 11 aa, BK virus
QLVLFFHYQWD

SEQ ID NO: 12346 - protein, 11 aa, BK virus
LVLFFHYQWDL

SEQ ID NO: 12347 - protein, 11 aa, BK virus
KQYSAKNQILQ

SEQ ID NO: 12348 - protein, 11 aa, BK virus
QYSAKNQILQN

SEQ ID NO: 12349 - protein, 11 aa, BK virus
YSAKNQILQNP

SEQ ID NO: 12350 - protein, 11 aa, BK virus
SAKNQILQNPF

SEQ ID NO: 12351 - protein, 11 aa, BK virus
VANSAAKQHLP

SEQ ID NO: 12352 - protein, 11 aa, BK virus
ANSAAKQHLPY

SEQ ID NO: 12353 - protein, 11 aa, BK virus
NSAAKQHLPYI

SEQ ID NO: 12354 - protein, 11 aa, BK virus
SAAKQHLPYIV

SEQ ID NO: 12355 - protein, 11 aa, BK virus
AAKQHLPYIVL

SEQ ID NO: 12356 - protein, 11 aa, BK virus
AKQHLPYIVLV

SEQ ID NO: 12357 - protein, 11 aa, BK virus
KQHLPYIVLVQ

SEQ ID NO: 12358 - protein, 11 aa, BK virus
QHLPYIVLVQH

SEQ ID NO: 12359 - protein, 11 aa, BK virus
HLPYIVLVQHF

SEQ ID NO: 12360 - protein, 11 aa, BK virus
LPYIVLVQHFH

SEQ ID NO: 12361 - protein, 11 aa, BK virus
PYIVLVQHFHE

SEQ ID NO: 12362 - protein, 11 aa, BK virus
YIVLVQHFHEL

SEQ ID NO: 12363 - protein, 11 aa, BK virus
IVLVQHFHELQ

SEQ ID NO: 12364 - protein, 11 aa, BK virus
VLVQHFHELQI

SEQ ID NO: 12365 - protein, 11 aa, BK virus
LVQHFHELQIL

SEQ ID NO: 12366 - protein, 11 aa, BK virus
VQHFHELQILN

SEQ ID NO: 12367 - protein, 11 aa, BK virus
QHFHELQILNP

SEQ ID NO: 12368 - protein, 11 aa, BK virus
HFHELQILNPF

SEQ ID NO: 12369 - protein, 11 aa, BK virus
FHELQILNPFY

SEQ ID NO: 12370 - protein, 11 aa, BK virus
HELQILNPFYL

SEQ ID NO: 12371 - protein, 11 aa, BK virus
ELQILNPFYLI

SEQ ID NO: 12372 - protein, 11 aa, BK virus
LQILNPFYLIY

SEQ ID NO: 12373 - protein, 11 aa, BK virus
QILNPFYLIYD

SEQ ID NO: 12374 - protein, 11 aa, BK virus
IFLLAFLPWSY

SEQ ID NO: 12375 - protein, 11 aa, BK virus
FLLAFLPWSYE

SEQ ID NO: 12376 - protein, 11 aa, BK virus
LLAFLPWSYEG

SEQ ID NO: 12377 - protein, 11 aa, BK virus
LAFLPWSYEGY

SEQ ID NO: 12378 - protein, 11 aa, BK virus
AFLPWSYEGYL

SEQ ID NO: 12379 - protein, 11 aa, BK virus
FLPWSYEGYLL

SEQ ID NO: 12380 - protein, 11 aa, BK virus
LPWSYEGYLLF

SEQ ID NO: 12381 - protein, 11 aa, BK virus
PWSYEGYLLFF

SEQ ID NO: 12382 - protein, 11 aa, BK virus
LKLYLLLADKY

SEQ ID NO: 12383 - protein, 11 aa, BK virus
KLYLLLADKYF

SEQ ID NO: 12384 - protein, 11 aa, BK virus
LYLLLADKYFF

SEQ ID NO: 12385 - protein, 11 aa, BK virus
YLLLADKYFFD

SEQ ID NO: 12386 - protein, 11 aa, BK virus
LLLADKYFFDF

SEQ ID NO: 12387 - protein, 11 aa, BK virus
LLADKYFFDFY

SEQ ID NO: 12388 - protein, 11 aa, BK virus
LADKYFFDFYF

SEQ ID NO: 12389 - protein, 11 aa, BK virus
ADKYFFDFYFL

SEQ ID NO: 12390 - protein, 11 aa, BK virus
DKYFFDFYFLQ

SEQ ID NO: 12391 - protein, 11 aa, BK virus
KYFFDFYFLQK

SEQ ID NO: 12392 - protein, 11 aa, BK virus
SDKAGLFSDTF

SEQ ID NO: 12393 - protein, 11 aa, BK virus
DKAGLFSDTFY

SEQ ID NO: 12394 - protein, 11 aa, BK virus
KAGLFSDTFYT

SEQ ID NO: 12395 - protein, 11 aa, BK virus
AGLFSDTFYTP

SEQ ID NO: 12396 - protein, 11 aa, BK virus
GLFSDTFYTPL

SEQ ID NO: 12397 - protein, 11 aa, BK virus
LFSDTFYTPLH

SEQ ID NO: 12398 - protein, 11 aa, BK virus
FSDTFYTPLHC

SEQ ID NO: 12399 - protein, 11 aa, BK virus
SDTFYTPLHCI

SEQ ID NO: 12400 - protein, 11 aa, BK virus
DTFYTPLHCIE

SEQ ID NO: 12401 - protein, 11 aa, BK virus
TFYTPLHCIEI

SEQ ID NO: 12402 - protein, 11 aa, BK virus
FYTPLHCIEIL

SEQ ID NO: 12403 - protein, 11 aa, BK virus
YTPLHCIEILN

SEQ ID NO: 12404 - protein, 11 aa, BK virus
TPLHCIEILNT

SEQ ID NO: 12405 - protein, 11 aa, BK virus
PLHCIEILNTY

SEQ ID NO: 12406 - protein, 11 aa, BK virus
LHCIEILNTYL

SEQ ID NO: 12407 - protein, 11 aa, BK virus
HCIEILNTYLI

SEQ ID NO: 12408 - protein, 11 aa, BK virus
CIEILNTYLII

SEQ ID NO: 12409 - protein, 11 aa, BK virus
IEILNTYLIIK

SEQ ID NO: 12410 - protein, 11 aa, BK virus
EILNTYLIIKT

SEQ ID NO: 12411 - protein, 11 aa, BK virus
ILNTYLIIKTH

SEQ ID NO: 12412 - protein, 11 aa, BK virus
LNTYLIIKTHP

SEQ ID NO: 12413 - protein, 11 aa, BK virus
NTYLIIKTHPH

SEQ ID NO: 12414 - protein, 11 aa, BK virus
TYLIIKTHPHT

SEQ ID NO: 12415 - protein, 11 aa, BK virus
YLIIKTHPHTL

SEQ ID NO: 12416 - protein, 11 aa, BK virus
LIIKTHPHTLS

SEQ ID NO: 12417 - protein, 11 aa, BK virus
IIKTHPHTLSL

SEQ ID NO: 12418 - protein, 11 aa, BK virus
IKTHPHTLSLL

SEQ ID NO: 12419 - protein, 11 aa, BK virus
KTHPHTLSLLH

SEQ ID NO: 12420 - protein, 11 aa, BK virus
THPHTLSLLHT

SEQ ID NO: 12421 - protein, 11 aa, BK virus
HPHTLSLLHTQ

SEQ ID NO: 12422 - protein, 11 aa, BK virus
LISKTPALFLQ

SEQ ID NO: 12423 - protein, 11 aa, BK virus
ISKTPALFLQA

SEQ ID NO: 12424 - protein, 11 aa, BK virus
SKTPALFLQAL

SEQ ID NO: 12425 - protein, 11 aa, BK virus
KTPALFLQALL

SEQ ID NO: 12426 - protein, 11 aa, BK virus
TPALFLQALLG

SEQ ID NO: 12427 - protein, 11 aa, BK virus
NHAPLSPLECF

SEQ ID NO: 12428 - protein, 11 aa, BK virus
HAPLSPLECFL

SEQ ID NO: 12429 - protein, 11 aa, BK virus
APLSPLECFLL

SEQ ID NO: 12430 - protein, 11 aa, BK virus
LQKLYVYVELK

SEQ ID NO: 12431 - protein, 11 aa, BK virus
QKLYVYVELKR

SEQ ID NO: 12432 - protein, 11 aa, BK virus
KLYVYVELKRI

SEQ ID NO: 12433 - protein, 11 aa, BK virus
YTQQSRQGFYY

SEQ ID NO: 12434 - protein, 11 aa, BK virus
GLLPFFFFWVV

SEQ ID NO: 12435 - protein, 11 aa, BK virus
LLPFFFFWVVL

SEQ ID NO: 12436 - protein, 11 aa, BK virus
LPFFFFWVVLS

SEQ ID NO: 12437 - protein, 11 aa, BK virus
PFFFFWVVLSV

SEQ ID NO: 12438 - protein, 11 aa, BK virus
FFFFWVVLSVE

SEQ ID NO: 12439 - protein, 11 aa, BK virus
FFFWVVLSVEN

SEQ ID NO: 12440 - protein, 11 aa, BK virus
FFWVVLSVENL

SEQ ID NO: 12441 - protein, 11 aa, BK virus
FWVVLSVENLL

SEQ ID NO: 12442 - protein, 11 aa, BK virus
WVVLSVENLLL

SEQ ID NO: 12443 - protein, 11 aa, BK virus
VVLSVENLLLL

SEQ ID NO: 12444 - protein, 11 aa, BK virus
VLSVENLLLLL

SEQ ID NO: 12445 - protein, 11 aa, BK virus
LSVENLLLLLH

SEQ ID NO: 12446 - protein, 11 aa, BK virus
SVENLLLLLHH

SEQ ID NO: 12447 - protein, 11 aa, BK virus
VENLLLLLHHW

SEQ ID NO: 12448 - protein, 11 aa, BK virus
ENLLLLLHHWQ

SEQ ID NO: 12449 - protein, 11 aa, BK virus
NLLLLLHHWQT

SEQ ID NO: 12450 - protein, 11 aa, BK virus
LLLLLHHWQTY

SEQ ID NO: 12451 - protein, 11 aa, BK virus
LLLLHHWQTYL

SEQ ID NO: 12452 - protein, 11 aa, BK virus
LLLHHWQTYLH

SEQ ID NO: 12453 - protein, 11 aa, BK virus
LLHHWQTYLHG

SEQ ID NO: 12454 - protein, 11 aa, BK virus
LHHWQTYLHGK

SEQ ID NO: 12455 - protein, 11 aa, BK virus
HHWQTYLHGKI

SEQ ID NO: 12456 - protein, 11 aa, BK virus
HWQTYLHGKIN

SEQ ID NO: 12457 - protein, 11 aa, BK virus
WQTYLHGKINL

SEQ ID NO: 12458 - protein, 11 aa, BK virus
QTYLHGKINLH

SEQ ID NO: 12459 - protein, 11 aa, BK virus
TYLHGKINLHP

SEQ ID NO: 12460 - protein, 11 aa, BK virus
YLHGKINLHPI

SEQ ID NO: 12461 - protein, 11 aa, BK virus
LHGKINLHPIF

SEQ ID NO: 12462 - protein, 11 aa, BK virus
HGKINLHPIFH

SEQ ID NO: 12463 - protein, 11 aa, BK virus
RNSTRTPTLLF

SEQ ID NO: 12464 - protein, 11 aa, BK virus
NSTRTPTLLFH

SEQ ID NO: 12465 - protein, 11 aa, BK virus
STRTPTLLFHR

SEQ ID NO: 12466 - protein, 11 aa, BK virus
TRTPTLLFHRL

SEQ ID NO: 12467 - protein, 11 aa, BK virus
RTPTLLFHRLA

SEQ ID NO: 12468 - protein, 11 aa, BK virus
TPTLLFHRLAP

SEQ ID NO: 12469 - protein, 11 aa, BK virus
PTLLFHRLAPI

SEQ ID NO: 12470 - protein, 11 aa, BK virus
TLLFHRLAPIK

SEQ ID NO: 12471 - protein, 11 aa, BK virus
LLFHRLAPIKK

SEQ ID NO: 12472 - protein, 11 aa, BK virus
LFHRLAPIKKI

SEQ ID NO: 12473 - protein, 11 aa, BK virus
FHRLAPIKKII

SEQ ID NO: 12474 - protein, 11 aa, BK virus
HRLAPIKKIIT

SEQ ID NO: 12475 - protein, 11 aa, BK virus
GLLIFYYLSKY

SEQ ID NO: 12476 - protein, 11 aa, BK virus
LLIFYYLSKYK

SEQ ID NO: 12477 - protein, 11 aa, BK virus
LIFYYLSKYKL

SEQ ID NO: 12478 - protein, 11 aa, BK virus
IFYYLSKYKLV

SEQ ID NO: 12479 - protein, 11 aa, BK virus
FYYLSKYKLVT

SEQ ID NO: 12480 - protein, 11 aa, BK virus
YYLSKYKLVTL

SEQ ID NO: 12481 - protein, 11 aa, BK virus
YLSKYKLVTLK

SEQ ID NO: 12482 - protein, 11 aa, BK virus
LSKYKLVTLKL

SEQ ID NO: 12483 - protein, 11 aa, BK virus
ISEGSFSNYLD

SEQ ID NO: 12484 - protein, 11 aa, BK virus
SEGSFSNYLDP

SEQ ID NO: 12485 - protein, 11 aa, BK virus
EGSFSNYLDPP

SEQ ID NO: 12486 - protein, 11 aa, BK virus
GSFSNYLDPPL

SEQ ID NO: 12487 - protein, 11 aa, BK virus
SFSNYLDPPLQ

SEQ ID NO: 12488 - protein, 11 aa, BK virus
FSNYLDPPLQS

SEQ ID NO: 12489 - protein, 11 aa, BK virus
SNYLDPPLQSF

SEQ ID NO: 12490 - protein, 11 aa, BK virus
NYLDPPLQSFF

SEQ ID NO: 12491 - protein, 11 aa, BK virus
YLDPPLQSFFS

SEQ ID NO: 12492 - protein, 11 aa, BK virus
AKPLCEAVNAV

SEQ ID NO: 12493 - protein, 11 aa, BK virus
KPLCEAVNAVA

SEQ ID NO: 12494 - protein, 11 aa, BK virus
PLCEAVNAVAI

SEQ ID NO: 12495 - protein, 11 aa, BK virus
LCEAVNAVAIY

SEQ ID NO: 12496 - protein, 11 aa, BK virus
CEAVNAVAIYP

SEQ ID NO: 12497 - protein, 11 aa, BK virus
EAVNAVAIYPN

SEQ ID NO: 12498 - protein, 11 aa, BK virus
AVNAVAIYPNQ

SEQ ID NO: 12499 - protein, 11 aa, BK virus
VNAVAIYPNQG

SEQ ID NO: 12500 - protein, 11 aa, BK virus
NAVAIYPNQGL

SEQ ID NO: 12501 - protein, 11 aa, BK virus
AVAIYPNQGLF

SEQ ID NO: 12502 - protein, 11 aa, BK virus
VAIYPNQGLFS

SEQ ID NO: 12503 - protein, 11 aa, BK virus
HARAVHRRLFG

SEQ ID NO: 12504 - protein, 11 aa, BK virus
ARAVHRRLFGT

SEQ ID NO: 12505 - protein, 11 aa, BK virus
RAVHRRLFGTN

SEQ ID NO: 12506 - protein, 11 aa, BK virus
AVHRRLFGTNR

SEQ ID NO: 12507 - protein, 11 aa, BK virus
VHRRLFGTNRP

SEQ ID NO: 12508 - protein, 11 aa, BK virus
HRRLFGTNRPF

SEQ ID NO: 12509 - protein, 11 aa, BK virus
RRLFGTNRPFL

SEQ ID NO: 12510 - protein, 11 aa, BK virus
RLFGTNRPFLA

SEQ ID NO: 12511 - protein, 11 aa, BK virus
LFGTNRPFLAV

SEQ ID NO: 12512 - protein, 11 aa, BK virus
FGTNRPFLAVQ

SEQ ID NO: 12513 - protein, 11 aa, BK virus
GTNRPFLAVQG

SEQ ID NO: 12514 - protein, 11 aa, BK virus
TNRPFLAVQGI

SEQ ID NO: 12515 - protein, 11 aa, BK virus
NRPFLAVQGIW

SEQ ID NO: 12516 - protein, 11 aa, BK virus
RPFLAVQGIWA

SEQ ID NO: 12517 - protein, 11 aa, BK virus
PFLAVQGIWAK

SEQ ID NO: 12518 - protein, 11 aa, BK virus
FLAVQGIWAKR

SEQ ID NO: 12519 - protein, 11 aa, BK virus
LAVQGIWAKRK

SEQ ID NO: 12520 - protein, 11 aa, BK virus
AVQGIWAKRKI

SEQ ID NO: 12521 - protein, 11 aa, BK virus
VQGIWAKRKIS

SEQ ID NO: 12522 - protein, 11 aa, BK virus
QGIWAKRKIST

SEQ ID NO: 12523 - protein, 11 aa, BK virus
GIWAKRKISTN

SEQ ID NO: 12524 - protein, 11 aa, BK virus
IWAKRKISTNL

SEQ ID NO: 12525 - protein, 11 aa, BK virus
ATPGSKIRLMS

SEQ ID NO: 12526 - protein, 11 aa, BK virus
TPGSKIRLMSY

SEQ ID NO: 12527 - protein, 11 aa, BK virus
PGSKIRLMSYL

SEQ ID NO: 12528 - protein, 11 aa, BK virus
GSKIRLMSYLY

SEQ ID NO: 12529 - protein, 11 aa, BK virus
SKIRLMSYLYI

SEQ ID NO: 12530 - protein, 11 aa, BK virus
KIRLMSYLYIL

SEQ ID NO: 12531 - protein, 11 aa, BK virus
IRLMSYLYILL

SEQ ID NO: 12532 - protein, 11 aa, BK virus
RLMSYLYILLH

SEQ ID NO: 12533 - protein, 11 aa, BK virus
LMSYLYILLHF

SEQ ID NO: 12534 - protein, 11 aa, BK virus
MSYLYILLHFF

SEQ ID NO: 12535 - protein, 11 aa, BK virus
SYLYILLHFFI

SEQ ID NO: 12536 - protein, 11 aa, BK virus
YLYILLHFFIQ

SEQ ID NO: 12537 - protein, 11 aa, BK virus
LYILLHFFIQS

SEQ ID NO: 12538 - protein, 11 aa, BK virus
YILLHFFIQSI

SEQ ID NO: 12539 - protein, 11 aa, BK virus
ILLHFFIQSIH

SEQ ID NO: 12540 - protein, 11 aa, BK virus
LLHFFIQSIHS

SEQ ID NO: 12541 - protein, 11 aa, BK virus
LHFFIQSIHSL

SEQ ID NO: 12542 - protein, 11 aa, BK virus
HFFIQSIHSLH

SEQ ID NO: 12543 - protein, 11 aa, BK virus
FFIQSIHSLHF

SEQ ID NO: 12544 - protein, 11 aa, BK virus
FIQSIHSLHFI

SEQ ID NO: 12545 - protein, 11 aa, BK virus
IQSIHSLHFIL

SEQ ID NO: 12546 - protein, 11 aa, BK virus
QSIHSLHFILV

SEQ ID NO: 12547 - protein, 11 aa, BK virus
SIHSLHFILVA

SEQ ID NO: 12548 - protein, 11 aa, BK virus
IHSLHFILVAP

SEQ ID NO: 12549 - protein, 11 aa, BK virus
HSLHFILVAPF

SEQ ID NO: 12550 - protein, 11 aa, BK virus
SLHFILVAPFV

SEQ ID NO: 12551 - protein, 11 aa, BK virus
LHFILVAPFVR

SEQ ID NO: 12552 - protein, 11 aa, BK virus
HFILVAPFVRV

SEQ ID NO: 12553 - protein, 11 aa, BK virus
FILVAPFVRVK

SEQ ID NO: 12554 - protein, 11 aa, BK virus
ILVAPFVRVKF

SEQ ID NO: 12555 - protein, 11 aa, BK virus
LVAPFVRVKFL

SEQ ID NO: 12556 - protein, 11 aa, BK virus
VAPFVRVKFLT

SEQ ID NO: 12557 - protein, 11 aa, BK virus
APFVRVKFLTL

SEQ ID NO: 12558 - protein, 11 aa, BK virus
PFVRVKFLTLP

SEQ ID NO: 12559 - protein, 11 aa, BK virus
GKISPGSSFKA

SEQ ID NO: 12560 - protein, 11 aa, BK virus
KVHELHGFFPV

SEQ ID NO: 12561 - protein, 11 aa, BK virus
VHELHGFFPVK

SEQ ID NO: 12562 - protein, 11 aa, BK virus
HELHGFFPVKN

SEQ ID NO: 12563 - protein, 11 aa, BK virus
ELHGFFPVKNF

SEQ ID NO: 12564 - protein, 11 aa, BK virus
LHGFFPVKNFI

SEQ ID NO: 12565 - protein, 11 aa, BK virus
HGFFPVKNFIH

SEQ ID NO: 12566 - protein, 8 aa, BK virus
MDKVLNRE

SEQ ID NO: 12567 - protein, 8 aa, BK virus
DKVLNREE

SEQ ID NO: 12568 - protein, 8 aa, BK virus
KVLNREES

SEQ ID NO: 12569 - protein, 8 aa, BK virus
VLNREESM

SEQ ID NO: 12570 - protein, 8 aa, BK virus
LNREESME

SEQ ID NO: 12571 - protein, 8 aa, BK virus
NREESMEL

SEQ ID NO: 12572 - protein, 8 aa, BK virus
REESMELM

SEQ ID NO: 12573 - protein, 8 aa, BK virus
EESMELMD

SEQ ID NO: 12574 - protein, 8 aa, BK virus
ESMELMDL

SEQ ID NO: 12575 - protein, 8 aa, BK virus
SMELMDLL

SEQ ID NO: 12576 - protein, 8 aa, BK virus
MELMDLLG

SEQ ID NO: 12577 - protein, 8 aa, BK virus
ELMDLLGL

SEQ ID NO: 12578 - protein, 8 aa, BK virus
LMDLLGLE

SEQ ID NO: 12579 - protein, 8 aa, BK virus
MDLLGLER

SEQ ID NO: 12580 - protein, 8 aa, BK virus
DLLGLERA

SEQ ID NO: 12581 - protein, 8 aa, BK virus
LLGLERAA

SEQ ID NO: 12582 - protein, 8 aa, BK virus
LGLERAAW

SEQ ID NO: 12583 - protein, 8 aa, BK virus
GLERAAWG

SEQ ID NO: 12584 - protein, 8 aa, BK virus
LERAAWGN

SEQ ID NO: 12585 - protein, 8 aa, BK virus
ERAAWGNL

SEQ ID NO: 12586 - protein, 8 aa, BK virus
RAAWGNLP

SEQ ID NO: 12587 - protein, 8 aa, BK virus
AAWGNLPL

SEQ ID NO: 12588 - protein, 8 aa, BK virus
AWGNLPLM

SEQ ID NO: 12589 - protein, 8 aa, BK virus
WGNLPLMR

SEQ ID NO: 12590 - protein, 8 aa, BK virus
GNLPLMRK

SEQ ID NO: 12591 - protein, 8 aa, BK virus
NLPLMRKA

SEQ ID NO: 12592 - protein, 8 aa, BK virus
LPLMRKAY

SEQ ID NO: 12593 - protein, 8 aa, BK virus
PLMRKAYL

SEQ ID NO: 12594 - protein, 8 aa, BK virus
LMRKAYLR

SEQ ID NO: 12595 - protein, 8 aa, BK virus
MRKAYLRK

SEQ ID NO: 12596 - protein, 8 aa, BK virus
RKAYLRKC

SEQ ID NO: 12597 - protein, 8 aa, BK virus
KAYLRKCK

SEQ ID NO: 12598 - protein, 8 aa, BK virus
AYLRKCKE

SEQ ID NO: 12599 - protein, 8 aa, BK virus
YLRKCKEF

SEQ ID NO: 12600 - protein, 8 aa, BK virus
LRKCKEFH

SEQ ID NO: 12601 - protein, 8 aa, BK virus
RKCKEFHP

SEQ ID NO: 12602 - protein, 8 aa, BK virus
KCKEFHPD

SEQ ID NO: 12603 - protein, 8 aa, BK virus
CKEFHPDK

SEQ ID NO: 12604 - protein, 8 aa, BK virus
KEFHPDKG

SEQ ID NO: 12605 - protein, 8 aa, BK virus
EFHPDKGG

SEQ ID NO: 12606 - protein, 8 aa, BK virus
FHPDKGGD

SEQ ID NO: 12607 - protein, 8 aa, BK virus
HPDKGGDE

SEQ ID NO: 12608 - protein, 8 aa, BK virus
PDKGGDED

SEQ ID NO: 12609 - protein, 8 aa, BK virus
DKGGDEDK

SEQ ID NO: 12610 - protein, 8 aa, BK virus
KGGDEDKM

SEQ ID NO: 12611 - protein, 8 aa, BK virus
GGDEDKMK

SEQ ID NO: 12612 - protein, 8 aa, BK virus
GDEDKMKR

SEQ ID NO: 12613 - protein, 8 aa, BK virus
DEDKMKRM

SEQ ID NO: 12614 - protein, 8 aa, BK virus
EDKMKRMN

SEQ ID NO: 12615 - protein, 8 aa, BK virus
DKMKRMNT

SEQ ID NO: 12616 - protein, 8 aa, BK virus
KMKRMNTL

SEQ ID NO: 12617 - protein, 8 aa, BK virus
MKRMNTLY

SEQ ID NO: 12618 - protein, 8 aa, BK virus
KRMNTLYK

SEQ ID NO: 12619 - protein, 8 aa, BK virus
RMNTLYKK

SEQ ID NO: 12620 - protein, 8 aa, BK virus
MNTLYKKM

SEQ ID NO: 12621 - protein, 8 aa, BK virus
NTLYKKME

SEQ ID NO: 12622 - protein, 8 aa, BK virus
TLYKKMEQ

SEQ ID NO: 12623 - protein, 8 aa, BK virus
LYKKMEQD

SEQ ID NO: 12624 - protein, 8 aa, BK virus
YKKMEQDV

SEQ ID NO: 12625 - protein, 8 aa, BK virus
KKMEQDVK

SEQ ID NO: 12626 - protein, 8 aa, BK virus
KMEQDVKV

SEQ ID NO: 12627 - protein, 8 aa, BK virus
MEQDVKVA

SEQ ID NO: 12628 - protein, 8 aa, BK virus
EQDVKVAH

SEQ ID NO: 12629 - protein, 8 aa, BK virus
QDVKVAHQ

SEQ ID NO: 12630 - protein, 8 aa, BK virus
DVKVAHQP

SEQ ID NO: 12631 - protein, 8 aa, BK virus
VKVAHQPD

SEQ ID NO: 12632 - protein, 8 aa, BK virus
KVAHQPDF

SEQ ID NO: 12633 - protein, 8 aa, BK virus
VAHQPDFG

SEQ ID NO: 12634 - protein, 8 aa, BK virus
AHQPDFGT

SEQ ID NO: 12635 - protein, 8 aa, BK virus
HQPDFGTW

SEQ ID NO: 12636 - protein, 8 aa, BK virus
QPDFGTWS

SEQ ID NO: 12637 - protein, 8 aa, BK virus
PDFGTWSS

SEQ ID NO: 12638 - protein, 8 aa, BK virus
DFGTWSSS

SEQ ID NO: 12639 - protein, 8 aa, BK virus
FGTWSSSE

SEQ ID NO: 12640 - protein, 8 aa, BK virus
GTWSSSEV

SEQ ID NO: 12641 - protein, 8 aa, BK virus
TWSSSEVC

SEQ ID NO: 12642 - protein, 8 aa, BK virus
WSSSEVCA

SEQ ID NO: 12643 - protein, 8 aa, BK virus
SSSEVCAD

SEQ ID NO: 12644 - protein, 8 aa, BK virus
SSEVCADF

SEQ ID NO: 12645 - protein, 8 aa, BK virus
SEVCADFP

SEQ ID NO: 12646 - protein, 8 aa, BK virus
EVCADFPL

SEQ ID NO: 12647 - protein, 8 aa, BK virus
VCADFPLC

SEQ ID NO: 12648 - protein, 8 aa, BK virus
CADFPLCP

SEQ ID NO: 12649 - protein, 8 aa, BK virus
ADFPLCPD

SEQ ID NO: 12650 - protein, 8 aa, BK virus
DFPLCPDT

SEQ ID NO: 12651 - protein, 8 aa, BK virus
FPLCPDTL

SEQ ID NO: 12652 - protein, 8 aa, BK virus
PLCPDTLY

SEQ ID NO: 12653 - protein, 8 aa, BK virus
LCPDTLYC

SEQ ID NO: 12654 - protein, 8 aa, BK virus
CPDTLYCK

SEQ ID NO: 12655 - protein, 8 aa, BK virus
PDTLYCKE

SEQ ID NO: 12656 - protein, 8 aa, BK virus
DTLYCKEW

SEQ ID NO: 12657 - protein, 8 aa, BK virus
TLYCKEWP

SEQ ID NO: 12658 - protein, 8 aa, BK virus
LYCKEWPI

SEQ ID NO: 12659 - protein, 8 aa, BK virus
YCKEWPIC

SEQ ID NO: 12660 - protein, 8 aa, BK virus
CKEWPICS

SEQ ID NO: 12661 - protein, 8 aa, BK virus
KEWPICSK

SEQ ID NO: 12662 - protein, 8 aa, BK virus
EWPICSKK

SEQ ID NO: 12663 - protein, 8 aa, BK virus
WPICSKKP

SEQ ID NO: 12664 - protein, 8 aa, BK virus
PICSKKPS

SEQ ID NO: 12665 - protein, 8 aa, BK virus
ICSKKPSV

SEQ ID NO: 12666 - protein, 8 aa, BK virus
CSKKPSVH

SEQ ID NO: 12667 - protein, 8 aa, BK virus
SKKPSVHC

SEQ ID NO: 12668 - protein, 8 aa, BK virus
KKPSVHCP

SEQ ID NO: 12669 - protein, 8 aa, BK virus
KPSVHCPC

SEQ ID NO: 12670 - protein, 8 aa, BK virus
PSVHCPCM

SEQ ID NO: 12671 - protein, 8 aa, BK virus
SVHCPCML

SEQ ID NO: 12672 - protein, 8 aa, BK virus
VHCPCMLC

SEQ ID NO: 12673 - protein, 8 aa, BK virus
HCPCMLCQ

SEQ ID NO: 12674 - protein, 8 aa, BK virus
CPCMLCQL

SEQ ID NO: 12675 - protein, 8 aa, BK virus
PCMLCQLR

SEQ ID NO: 12676 - protein, 8 aa, BK virus
CMLCQLRL

SEQ ID NO: 12677 - protein, 8 aa, BK virus
MLCQLRLR

SEQ ID NO: 12678 - protein, 8 aa, BK virus
LCQLRLRH

SEQ ID NO: 12679 - protein, 8 aa, BK virus
CQLRLRHL

SEQ ID NO: 12680 - protein, 8 aa, BK virus
QLRLRHLN

SEQ ID NO: 12681 - protein, 8 aa, BK virus
LRLRHLNR

SEQ ID NO: 12682 - protein, 8 aa, BK virus
RLRHLNRK

SEQ ID NO: 12683 - protein, 8 aa, BK virus
LRHLNRKF

SEQ ID NO: 12684 - protein, 8 aa, BK virus
RHLNRKFL

SEQ ID NO: 12685 - protein, 8 aa, BK virus
HLNRKFLR

SEQ ID NO: 12686 - protein, 8 aa, BK virus
LNRKFLRK

SEQ ID NO: 12687 - protein, 8 aa, BK virus
NRKFLRKE

SEQ ID NO: 12688 - protein, 8 aa, BK virus
RKFLRKEP

SEQ ID NO: 12689 - protein, 8 aa, BK virus
KFLRKEPL

SEQ ID NO: 12690 - protein, 8 aa, BK virus
FLRKEPLV

SEQ ID NO: 12691 - protein, 8 aa, BK virus
LRKEPLVW

SEQ ID NO: 12692 - protein, 8 aa, BK virus
RKEPLVWI

SEQ ID NO: 12693 - protein, 8 aa, BK virus
KEPLVWID

SEQ ID NO: 12694 - protein, 8 aa, BK virus
EPLVWIDC

SEQ ID NO: 12695 - protein, 8 aa, BK virus
PLVWIDCY

SEQ ID NO: 12696 - protein, 8 aa, BK virus
LVWIDCYC

SEQ ID NO: 12697 - protein, 8 aa, BK virus
VWIDCYCI

SEQ ID NO: 12698 - protein, 8 aa, BK virus
WIDCYCID

SEQ ID NO: 12699 - protein, 8 aa, BK virus
IDCYCIDC

SEQ ID NO: 12700 - protein, 8 aa, BK virus
DCYCIDCF

SEQ ID NO: 12701 - protein, 8 aa, BK virus
CYCIDCFT

SEQ ID NO: 12702 - protein, 8 aa, BK virus
YCIDCFTQ

SEQ ID NO: 12703 - protein, 8 aa, BK virus
CIDCFTQW

SEQ ID NO: 12704 - protein, 8 aa, BK virus
IDCFTQWF

SEQ ID NO: 12705 - protein, 8 aa, BK virus
DCFTQWFG

SEQ ID NO: 12706 - protein, 8 aa, BK virus
CFTQWFGL

SEQ ID NO: 12707 - protein, 8 aa, BK virus
FTQWFGLD

SEQ ID NO: 12708 - protein, 8 aa, BK virus
TQWFGLDL

SEQ ID NO: 12709 - protein, 8 aa, BK virus
QWFGLDLT

SEQ ID NO: 12710 - protein, 8 aa, BK virus
WFGLDLTE

SEQ ID NO: 12711 - protein, 8 aa, BK virus
FGLDLTEE

SEQ ID NO: 12712 - protein, 8 aa, BK virus
GLDLTEET

SEQ ID NO: 12713 - protein, 8 aa, BK virus
LDLTEETL

SEQ ID NO: 12714 - protein, 8 aa, BK virus
DLTEETLQ

SEQ ID NO: 12715 - protein, 8 aa, BK virus
LTEETLQW

SEQ ID NO: 12716 - protein, 8 aa, BK virus
TEETLQWW

SEQ ID NO: 12717 - protein, 8 aa, BK virus
EETLQWWV

SEQ ID NO: 12718 - protein, 8 aa, BK virus
ETLQWWVQ

SEQ ID NO: 12719 - protein, 8 aa, BK virus
TLQWWVQI

SEQ ID NO: 12720 - protein, 8 aa, BK virus
LQWWVQII

SEQ ID NO: 12721 - protein, 8 aa, BK virus
QWWVQIIG

SEQ ID NO: 12722 - protein, 8 aa, BK virus
WWVQIIGE

SEQ ID NO: 12723 - protein, 8 aa, BK virus
WVQIIGET

SEQ ID NO: 12724 - protein, 8 aa, BK virus
VQIIGETP

SEQ ID NO: 12725 - protein, 8 aa, BK virus
QIIGETPF

SEQ ID NO: 12726 - protein, 8 aa, BK virus
IIGETPFR

SEQ ID NO: 12727 - protein, 8 aa, BK virus
IGETPFRD

SEQ ID NO: 12728 - protein, 8 aa, BK virus
GETPFRDL

SEQ ID NO: 12729 - protein, 8 aa, BK virus
ETPFRDLK

SEQ ID NO: 12730 - protein, 8 aa, BK virus
TPFRDLKL

SEQ ID NO: 12731 - protein, 8 aa, BK virus
KALSNYFF

SEQ ID NO: 12732 - protein, 8 aa, BK virus
ALSNYFFY

SEQ ID NO: 12733 - protein, 8 aa, BK virus
LSNYFFYR

SEQ ID NO: 12734 - protein, 8 aa, BK virus
SNYFFYRC

SEQ ID NO: 12735 - protein, 8 aa, BK virus
NYFFYRCQ

SEQ ID NO: 12736 - protein, 8 aa, BK virus
YFFYRCQP

SEQ ID NO: 12737 - protein, 8 aa, BK virus
FFYRCQPM

SEQ ID NO: 12738 - protein, 8 aa, BK virus
FYRCQPME

SEQ ID NO: 12739 - protein, 8 aa, BK virus
YRCQPMEQ

SEQ ID NO: 12740 - protein, 8 aa, BK virus
RCQPMEQK

SEQ ID NO: 12741 - protein, 8 aa, BK virus
CQPMEQKS

SEQ ID NO: 12742 - protein, 8 aa, BK virus
QPMEQKSG

SEQ ID NO: 12743 - protein, 8 aa, BK virus
PMEQKSGS

SEQ ID NO: 12744 - protein, 8 aa, BK virus
MEQKSGSP

SEQ ID NO: 12745 - protein, 8 aa, BK virus
EQKSGSPG

SEQ ID NO: 12746 - protein, 8 aa, BK virus
QKSGSPGG

SEQ ID NO: 12747 - protein, 8 aa, BK virus
KSGSPGGV

SEQ ID NO: 12748 - protein, 8 aa, BK virus
SGSPGGVP

SEQ ID NO: 12749 - protein, 8 aa, BK virus
GSPGGVPL

SEQ ID NO: 12750 - protein, 8 aa, BK virus
SPGGVPLM

SEQ ID NO: 12751 - protein, 8 aa, BK virus
PGGVPLMK

SEQ ID NO: 12752 - protein, 8 aa, BK virus
GGVPLMKN

SEQ ID NO: 12753 - protein, 8 aa, BK virus
GVPLMKNG

SEQ ID NO: 12754 - protein, 8 aa, BK virus
VPLMKNGM

SEQ ID NO: 12755 - protein, 8 aa, BK virus
PLMKNGMK

SEQ ID NO: 12756 - protein, 8 aa, BK virus
LMKNGMKI

SEQ ID NO: 12757 - protein, 8 aa, BK virus
MKNGMKIY

SEQ ID NO: 12758 - protein, 8 aa, BK virus
KNGMKIYF

SEQ ID NO: 12759 - protein, 8 aa, BK virus
NGMKIYFA

SEQ ID NO: 12760 - protein, 8 aa, BK virus
GMKIYFAM

SEQ ID NO: 12761 - protein, 8 aa, BK virus
MKIYFAMK

SEQ ID NO: 12762 - protein, 8 aa, BK virus
KIYFAMKI

SEQ ID NO: 12763 - protein, 8 aa, BK virus
IYFAMKIC

SEQ ID NO: 12764 - protein, 8 aa, BK virus
YFAMKICL

SEQ ID NO: 12765 - protein, 8 aa, BK virus
FAMKICLP

SEQ ID NO: 12766 - protein, 8 aa, BK virus
AMKICLPV

SEQ ID NO: 12767 - protein, 8 aa, BK virus
MKICLPVM

SEQ ID NO: 12768 - protein, 8 aa, BK virus
KICLPVMK

SEQ ID NO: 12769 - protein, 8 aa, BK virus
ICLPVMKK

SEQ ID NO: 12770 - protein, 8 aa, BK virus
CLPVMKKQ

SEQ ID NO: 12771 - protein, 8 aa, BK virus
LPVMKKQQ

SEQ ID NO: 12772 - protein, 8 aa, BK virus
PVMKKQQQ

SEQ ID NO: 12773 - protein, 8 aa, BK virus
VMKKQQQI

SEQ ID NO: 12774 - protein, 8 aa, BK virus
MKKQQQIL

SEQ ID NO: 12775 - protein, 8 aa, BK virus
KKQQQILN

SEQ ID NO: 12776 - protein, 8 aa, BK virus
KQQQILNT

SEQ ID NO: 12777 - protein, 8 aa, BK virus
QQQILNTQ

SEQ ID NO: 12778 - protein, 8 aa, BK virus
QQILNTQH

SEQ ID NO: 12779 - protein, 8 aa, BK virus
QILNTQHH

SEQ ID NO: 12780 - protein, 8 aa, BK virus
ILNTQHHP

SEQ ID NO: 12781 - protein, 8 aa, BK virus
LNTQHHPK

SEQ ID NO: 12782 - protein, 8 aa, BK virus
NTQHHPKK

SEQ ID NO: 12783 - protein, 8 aa, BK virus
TQHHPKKK

SEQ ID NO: 12784 - protein, 8 aa, BK virus
QHHPKKKE

SEQ ID NO: 12785 - protein, 8 aa, BK virus
HHPKKKER

SEQ ID NO: 12786 - protein, 8 aa, BK virus
KTLKTFPL

SEQ ID NO: 12787 - protein, 8 aa, BK virus
TLKTFPLI

SEQ ID NO: 12788 - protein, 8 aa, BK virus
LKTFPLIY

SEQ ID NO: 12789 - protein, 8 aa, BK virus
KTFPLIYT

SEQ ID NO: 12790 - protein, 8 aa, BK virus
TFPLIYTS

SEQ ID NO: 12791 - protein, 8 aa, BK virus
FPLIYTSF

SEQ ID NO: 12792 - protein, 8 aa, BK virus
PLIYTSFL

SEQ ID NO: 12793 - protein, 8 aa, BK virus
LIYTSFLV

SEQ ID NO: 12794 - protein, 8 aa, BK virus
IYTSFLVK

SEQ ID NO: 12795 - protein, 8 aa, BK virus
YTSFLVKL

SEQ ID NO: 12796 - protein, 8 aa, BK virus
TSFLVKLY

SEQ ID NO: 12797 - protein, 8 aa, BK virus
SFLVKLYL

SEQ ID NO: 12798 - protein, 8 aa, BK virus
FLVKLYLV

SEQ ID NO: 12799 - protein, 8 aa, BK virus
LVKLYLVI

SEQ ID NO: 12800 - protein, 8 aa, BK virus
VKLYLVIE

SEQ ID NO: 12801 - protein, 8 aa, BK virus
KLYLVIEP

SEQ ID NO: 12802 - protein, 8 aa, BK virus
LYLVIEPL

SEQ ID NO: 12803 - protein, 8 aa, BK virus
YLVIEPLP

SEQ ID NO: 12804 - protein, 8 aa, BK virus
LVIEPLPA

SEQ ID NO: 12805 - protein, 8 aa, BK virus
VIEPLPAL

SEQ ID NO: 12806 - protein, 8 aa, BK virus
IEPLPALL

SEQ ID NO: 12807 - protein, 8 aa, BK virus
EPLPALLC

SEQ ID NO: 12808 - protein, 8 aa, BK virus
PLPALLCI

SEQ ID NO: 12809 - protein, 8 aa, BK virus
LPALLCIL

SEQ ID NO: 12810 - protein, 8 aa, BK virus
PALLCILL

SEQ ID NO: 12811 - protein, 8 aa, BK virus
ALLCILLK

SEQ ID NO: 12812 - protein, 8 aa, BK virus
LLCILLKK

SEQ ID NO: 12813 - protein, 8 aa, BK virus
LCILLKKK

SEQ ID NO: 12814 - protein, 8 aa, BK virus
CILLKKKL

SEQ ID NO: 12815 - protein, 8 aa, BK virus
ILLKKKLK

SEQ ID NO: 12816 - protein, 8 aa, BK virus
LLKKKLKF

SEQ ID NO: 12817 - protein, 8 aa, BK virus
LKKKLKFC

SEQ ID NO: 12818 - protein, 8 aa, BK virus
KKKLKFCI

SEQ ID NO: 12819 - protein, 8 aa, BK virus
KKLKFCIK

SEQ ID NO: 12820 - protein, 8 aa, BK virus
KLKFCIKN

SEQ ID NO: 12821 - protein, 8 aa, BK virus
LKFCIKNL

SEQ ID NO: 12822 - protein, 8 aa, BK virus
KFCIKNLW

SEQ ID NO: 12823 - protein, 8 aa, BK virus
FCIKNLWK

SEQ ID NO: 12824 - protein, 8 aa, BK virus
CIKNLWKN

SEQ ID NO: 12825 - protein, 8 aa, BK virus
IKNLWKNI

SEQ ID NO: 12826 - protein, 8 aa, BK virus
KNLWKNIL

SEQ ID NO: 12827 - protein, 8 aa, BK virus
LLLVDTCV

SEQ ID NO: 12828 - protein, 8 aa, BK virus
LLVDTCVL

SEQ ID NO: 12829 - protein, 8 aa, BK virus
LVDTCVLG

SEQ ID NO: 12830 - protein, 8 aa, BK virus
VDTCVLGI

SEQ ID NO: 12831 - protein, 8 aa, BK virus
DTCVLGII

SEQ ID NO: 12832 - protein, 8 aa, BK virus
TCVLGIIL

SEQ ID NO: 12833 - protein, 8 aa, BK virus
CVLGIILY

SEQ ID NO: 12834 - protein, 8 aa, BK virus
VLGIILYS

SEQ ID NO: 12835 - protein, 8 aa, BK virus
LGIILYSF

SEQ ID NO: 12836 - protein, 8 aa, BK virus
LHIDIEFL

SEQ ID NO: 12837 - protein, 8 aa, BK virus
HIDIEFLQ

SEQ ID NO: 12838 - protein, 8 aa, BK virus
IDIEFLQL

SEQ ID NO: 12839 - protein, 8 aa, BK virus
DIEFLQLI

SEQ ID NO: 12840 - protein, 8 aa, BK virus
IEFLQLII

SEQ ID NO: 12841 - protein, 8 aa, BK virus
EFLQLIIS

SEQ ID NO: 12842 - protein, 8 aa, BK virus
FLQLIISV

SEQ ID NO: 12843 - protein, 8 aa, BK virus
LQLIISVK

SEQ ID NO: 12844 - protein, 8 aa, BK virus
QLIISVKS

SEQ ID NO: 12845 - protein, 8 aa, BK virus
LIISVKSC

SEQ ID NO: 12846 - protein, 8 aa, BK virus
IISVKSCV

SEQ ID NO: 12847 - protein, 8 aa, BK virus
ISVKSCVP

SEQ ID NO: 12848 - protein, 8 aa, BK virus
SVKSCVPL

SEQ ID NO: 12849 - protein, 8 aa, BK virus
VKSCVPLV

SEQ ID NO: 12850 - protein, 8 aa, BK virus
KSCVPLVF

SEQ ID NO: 12851 - protein, 8 aa, BK virus
FVRVLIRN

SEQ ID NO: 12852 - protein, 8 aa, BK virus
VRVLIRNT

SEQ ID NO: 12853 - protein, 8 aa, BK virus
RVLIRNTY

SEQ ID NO: 12854 - protein, 8 aa, BK virus
VLIRNTYY

SEQ ID NO: 12855 - protein, 8 aa, BK virus
LIRNTYYI

SEQ ID NO: 12856 - protein, 8 aa, BK virus
IRNTYYIV

SEQ ID NO: 12857 - protein, 8 aa, BK virus
RNTYYIVP

SEQ ID NO: 12858 - protein, 8 aa, BK virus
RSMILAQK

SEQ ID NO: 12859 - protein, 8 aa, BK virus
SMILAQKS

SEQ ID NO: 12860 - protein, 8 aa, BK virus
MILAQKSL

SEQ ID NO: 12861 - protein, 8 aa, BK virus
ILAQKSLK

SEQ ID NO: 12862 - protein, 8 aa, BK virus
LAQKSLKK

SEQ ID NO: 12863 - protein, 8 aa, BK virus
AQKSLKKQ

SEQ ID NO: 12864 - protein, 8 aa, BK virus
QKSLKKQS

SEQ ID NO: 12865 - protein, 8 aa, BK virus
KSLKKQSR

SEQ ID NO: 12866 - protein, 8 aa, BK virus
SLKKQSRC

SEQ ID NO: 12867 - protein, 8 aa, BK virus
LKKQSRCL

SEQ ID NO: 12868 - protein, 8 aa, BK virus
KKQSRCLG

SEQ ID NO: 12869 - protein, 8 aa, BK virus
KQSRCLGN

SEQ ID NO: 12870 - protein, 8 aa, BK virus
RQSVRMCF

SEQ ID NO: 12871 - protein, 8 aa, BK virus
QSVRMCFY

SEQ ID NO: 12872 - protein, 8 aa, BK virus
SVRMCFYY

SEQ ID NO: 12873 - protein, 8 aa, BK virus
RSVKSVRK

SEQ ID NO: 12874 - protein, 8 aa, BK virus
SVKSVRKK

SEQ ID NO: 12875 - protein, 8 aa, BK virus
VKSVRKKT

SEQ ID NO: 12876 - protein, 8 aa, BK virus
KSVRKKTS

SEQ ID NO: 12877 - protein, 8 aa, BK virus
SVRKKTSL

SEQ ID NO: 12878 - protein, 8 aa, BK virus
VRKKTSLI

SEQ ID NO: 12879 - protein, 8 aa, BK virus
RKKTSLIT

SEQ ID NO: 12880 - protein, 8 aa, BK virus
KKTSLITL

SEQ ID NO: 12881 - protein, 8 aa, BK virus
KTSLITLS

SEQ ID NO: 12882 - protein, 8 aa, BK virus
TSLITLSI

SEQ ID NO: 12883 - protein, 8 aa, BK virus
SLITLSIM

SEQ ID NO: 12884 - protein, 8 aa, BK virus
LITLSIMK

SEQ ID NO: 12885 - protein, 8 aa, BK virus
ITLSIMKS

SEQ ID NO: 12886 - protein, 8 aa, BK virus
TLSIMKST

SEQ ID NO: 12887 - protein, 8 aa, BK virus
LSIMKSTL

SEQ ID NO: 12888 - protein, 8 aa, BK virus
SIMKSTLQ

SEQ ID NO: 12889 - protein, 8 aa, BK virus
IMKSTLQM

SEQ ID NO: 12890 - protein, 8 aa, BK virus
MKSTLQML

SEQ ID NO: 12891 - protein, 8 aa, BK virus
KSTLQMLL

SEQ ID NO: 12892 - protein, 8 aa, BK virus
STLQMLLF

SEQ ID NO: 12893 - protein, 8 aa, BK virus
TLQMLLFL

SEQ ID NO: 12894 - protein, 8 aa, BK virus
LQMLLFLQ

SEQ ID NO: 12895 - protein, 8 aa, BK virus
QMLLFLQK

SEQ ID NO: 12896 - protein, 8 aa, BK virus
MLLFLQKV

SEQ ID NO: 12897 - protein, 8 aa, BK virus
LLFLQKVK

SEQ ID NO: 12898 - protein, 8 aa, BK virus
LFLQKVKI

SEQ ID NO: 12899 - protein, 8 aa, BK virus
FLQKVKIK

SEQ ID NO: 12900 - protein, 8 aa, BK virus
LQKVKIKK

SEQ ID NO: 12901 - protein, 8 aa, BK virus
QKVKIKKV

SEQ ID NO: 12902 - protein, 8 aa, BK virus
KVKIKKVF

SEQ ID NO: 12903 - protein, 8 aa, BK virus
VKIKKVFV

SEQ ID NO: 12904 - protein, 8 aa, BK virus
KIKKVFVS

SEQ ID NO: 12905 - protein, 8 aa, BK virus
IKKVFVSK

SEQ ID NO: 12906 - protein, 8 aa, BK virus
KKVFVSKQ

SEQ ID NO: 12907 - protein, 8 aa, BK virus
YLELMEML

SEQ ID NO: 12908 - protein, 8 aa, BK virus
LELMEMLY

SEQ ID NO: 12909 - protein, 8 aa, BK virus
NNIWQVLL

SEQ ID NO: 12910 - protein, 8 aa, BK virus
NIWQVLLG

SEQ ID NO: 12911 - protein, 8 aa, BK virus
IWQVLLGC

SEQ ID NO: 12912 - protein, 8 aa, BK virus
WQVLLGCT

SEQ ID NO: 12913 - protein, 8 aa, BK virus
QVLLGCTV

SEQ ID NO: 12914 - protein, 8 aa, BK virus
VLLGCTVC

SEQ ID NO: 12915 - protein, 8 aa, BK virus
LLGCTVCY

SEQ ID NO: 12916 - protein, 8 aa, BK virus
LGCTVCYL

SEQ ID NO: 12917 - protein, 8 aa, BK virus
GCTVCYLK

SEQ ID NO: 12918 - protein, 8 aa, BK virus
CTVCYLKW

SEQ ID NO: 12919 - protein, 8 aa, BK virus
TVCYLKWI

SEQ ID NO: 12920 - protein, 8 aa, BK virus
VCYLKWIL

SEQ ID NO: 12921 - protein, 8 aa, BK virus
YLIFCTVL

SEQ ID NO: 12922 - protein, 8 aa, BK virus
LIFCTVLF

SEQ ID NO: 12923 - protein, 8 aa, BK virus
IFCTVLFS

SEQ ID NO: 12924 - protein, 8 aa, BK virus
FCTVLFSM

SEQ ID NO: 12925 - protein, 8 aa, BK virus
CTVLFSMY

SEQ ID NO: 12926 - protein, 8 aa, BK virus
TVLFSMYL

SEQ ID NO: 12927 - protein, 8 aa, BK virus
VLFSMYLK

SEQ ID NO: 12928 - protein, 8 aa, BK virus
LFSMYLKE

SEQ ID NO: 12929 - protein, 8 aa, BK virus
FSMYLKED

SEQ ID NO: 12930 - protein, 8 aa, BK virus
SMYLKEDT

SEQ ID NO: 12931 - protein, 8 aa, BK virus
MYLKEDTG

SEQ ID NO: 12932 - protein, 8 aa, BK virus
YLKEDTGY

SEQ ID NO: 12933 - protein, 8 aa, BK virus
LKEDTGYL

SEQ ID NO: 12934 - protein, 8 aa, BK virus
KEDTGYLK

SEQ ID NO: 12935 - protein, 8 aa, BK virus
EDTGYLKV

SEQ ID NO: 12936 - protein, 8 aa, BK virus
DTGYLKVP

SEQ ID NO: 12937 - protein, 8 aa, BK virus
TGYLKVPL

SEQ ID NO: 12938 - protein, 8 aa, BK virus
GYLKVPLI

SEQ ID NO: 12939 - protein, 8 aa, BK virus
YLKVPLIV

SEQ ID NO: 12940 - protein, 8 aa, BK virus
LKVPLIVE

SEQ ID NO: 12941 - protein, 8 aa, BK virus
KVPLIVEK

SEQ ID NO: 12942 - protein, 8 aa, BK virus
VPLIVEKQ

SEQ ID NO: 12943 - protein, 8 aa, BK virus
PLIVEKQH

SEQ ID NO: 12944 - protein, 8 aa, BK virus
ISTWLFLK

SEQ ID NO: 12945 - protein, 8 aa, BK virus
STWLFLKM

SEQ ID NO: 12946 - protein, 8 aa, BK virus
KGQELNQR

SEQ ID NO: 12947 - protein, 8 aa, BK virus
GQELNQRI

SEQ ID NO: 12948 - protein, 8 aa, BK virus
QELNQRIC

SEQ ID NO: 12949 - protein, 8 aa, BK virus
ELNQRICL

SEQ ID NO: 12950 - protein, 8 aa, BK virus
LNQRICLQ

SEQ ID NO: 12951 - protein, 8 aa, BK virus
NQRICLQD

SEQ ID NO: 12952 - protein, 8 aa, BK virus
QRICLQDM

SEQ ID NO: 12953 - protein, 8 aa, BK virus
RICLQDME

SEQ ID NO: 12954 - protein, 8 aa, BK virus
TKEPKYFH

SEQ ID NO: 12955 - protein, 8 aa, BK virus
KEPKYFHQ

SEQ ID NO: 12956 - protein, 8 aa, BK virus
EPKYFHQA

SEQ ID NO: 12957 - protein, 8 aa, BK virus
PKYFHQAW

SEQ ID NO: 12958 - protein, 8 aa, BK virus
KYFHQAWL

SEQ ID NO: 12959 - protein, 8 aa, BK virus
YFHQAWLQ

SEQ ID NO: 12960 - protein, 8 aa, BK virus
MSILSLKP

SEQ ID NO: 12961 - protein, 8 aa, BK virus
SILSLKPC

SEQ ID NO: 12962 - protein, 8 aa, BK virus
ILSLKPCK

SEQ ID NO: 12963 - protein, 8 aa, BK virus
LSLKPCKL

SEQ ID NO: 12964 - protein, 8 aa, BK virus
SLKPCKLD

SEQ ID NO: 12965 - protein, 8 aa, BK virus
LKPCKLDL

SEQ ID NO: 12966 - protein, 8 aa, BK virus
ENPYKTQS

SEQ ID NO: 12967 - protein, 8 aa, BK virus
NPYKTQSS

SEQ ID NO: 12968 - protein, 8 aa, BK virus
PYKTQSSY

SEQ ID NO: 12969 - protein, 8 aa, BK virus
YKTQSSYL

SEQ ID NO: 12970 - protein, 8 aa, BK virus
KTQSSYLK

SEQ ID NO: 12971 - protein, 8 aa, BK virus
TQSSYLKK

SEQ ID NO: 12972 - protein, 8 aa, BK virus
QSSYLKKE

SEQ ID NO: 12973 - protein, 8 aa, BK virus
SSYLKKEF

SEQ ID NO: 12974 - protein, 8 aa, BK virus
SYLKKEFY

SEQ ID NO: 12975 - protein, 8 aa, BK virus
YLKKEFYK

SEQ ID NO: 12976 - protein, 8 aa, BK virus
LKKEFYKV

SEQ ID NO: 12977 - protein, 8 aa, BK virus
KKEFYKVE

SEQ ID NO: 12978 - protein, 8 aa, BK virus
LILQLIYN

SEQ ID NO: 12979 - protein, 8 aa, BK virus
ILQLIYNL

SEQ ID NO: 12980 - protein, 8 aa, BK virus
LQLIYNLE

SEQ ID NO: 12981 - protein, 8 aa, BK virus
QLIYNLEL

SEQ ID NO: 12982 - protein, 8 aa, BK virus
LIYNLELL

SEQ ID NO: 12983 - protein, 8 aa, BK virus
IYNLELLN

SEQ ID NO: 12984 - protein, 8 aa, BK virus
YNLELLNG

SEQ ID NO: 12985 - protein, 8 aa, BK virus
NLELLNGR

SEQ ID NO: 12986 - protein, 8 aa, BK virus
LELLNGRK

SEQ ID NO: 12987 - protein, 8 aa, BK virus
ELLNGRKG

SEQ ID NO: 12988 - protein, 8 aa, BK virus
LLNGRKGW

SEQ ID NO: 12989 - protein, 8 aa, BK virus
LNGRKGWI

SEQ ID NO: 12990 - protein, 8 aa, BK virus
NGRKGWIL

SEQ ID NO: 12991 - protein, 8 aa, BK virus
GRKGWILR

SEQ ID NO: 12992 - protein, 8 aa, BK virus
NIIYAWGN

SEQ ID NO: 12993 - protein, 8 aa, BK virus
IIYAWGNV

SEQ ID NO: 12994 - protein, 8 aa, BK virus
IYAWGNVF

SEQ ID NO: 12995 - protein, 8 aa, BK virus
YAWGNVFL

SEQ ID NO: 12996 - protein, 8 aa, BK virus
AWGNVFLI

SEQ ID NO: 12997 - protein, 8 aa, BK virus
WGNVFLIL

SEQ ID NO: 12998 - protein, 8 aa, BK virus
GNVFLILQ

SEQ ID NO: 12999 - protein, 8 aa, BK virus
NVFLILQE

SEQ ID NO: 13000 - protein, 8 aa, BK virus
VFLILQEK

SEQ ID NO: 13001 - protein, 8 aa, BK virus
FLILQEKR

SEQ ID NO: 13002 - protein, 8 aa, BK virus
LILQEKRI

SEQ ID NO: 13003 - protein, 8 aa, BK virus
ILQEKRIQ

SEQ ID NO: 13004 - protein, 8 aa, BK virus
LQEKRIQK

SEQ ID NO: 13005 - protein, 8 aa, BK virus
QEKRIQKL

SEQ ID NO: 13006 - protein, 8 aa, BK virus
EKRIQKLK

SEQ ID NO: 13007 - protein, 8 aa, BK virus
KRIQKLKT

SEQ ID NO: 13008 - protein, 8 aa, BK virus
RIQKLKTL

SEQ ID NO: 13009 - protein, 8 aa, BK virus
IQKLKTLD

SEQ ID NO: 13010 - protein, 8 aa, BK virus
QKLKTLDM

SEQ ID NO: 13011 - protein, 8 aa, BK virus
KLKTLDMD

SEQ ID NO: 13012 - protein, 8 aa, BK virus
LKTLDMDQ

SEQ ID NO: 13013 - protein, 8 aa, BK virus
KTLDMDQA

SEQ ID NO: 13014 - protein, 8 aa, BK virus
TLDMDQAL

SEQ ID NO: 13015 - protein, 8 aa, BK virus
LDMDQALN

SEQ ID NO: 13016 - protein, 8 aa, BK virus
DMDQALNP

SEQ ID NO: 13017 - protein, 8 aa, BK virus
MDQALNPN

SEQ ID NO: 13018 - protein, 8 aa, BK virus
DQALNPNH

SEQ ID NO: 13019 - protein, 8 aa, BK virus
QALNPNHN

SEQ ID NO: 13020 - protein, 8 aa, BK virus
ALNPNHNA

SEQ ID NO: 13021 - protein, 8 aa, BK virus
LNPNHNAL

SEQ ID NO: 13022 - protein, 8 aa, BK virus
NPNHNALP

SEQ ID NO: 13023 - protein, 8 aa, BK virus
PNHNALPK

SEQ ID NO: 13024 - protein, 8 aa, BK virus
NHNALPKS

SEQ ID NO: 13025 - protein, 8 aa, BK virus
HNALPKSQ

SEQ ID NO: 13026 - protein, 8 aa, BK virus
NALPKSQI

SEQ ID NO: 13027 - protein, 8 aa, BK virus
ALPKSQIL

SEQ ID NO: 13028 - protein, 8 aa, BK virus
LPKSQILQ

SEQ ID NO: 13029 - protein, 8 aa, BK virus
PKSQILQP

SEQ ID NO: 13030 - protein, 8 aa, BK virus
KSQILQPL

SEQ ID NO: 13031 - protein, 8 aa, BK virus
SQILQPLL

SEQ ID NO: 13032 - protein, 8 aa, BK virus
QILQPLLK

SEQ ID NO: 13033 - protein, 8 aa, BK virus
ILQPLLKI

SEQ ID NO: 13034 - protein, 8 aa, BK virus
LQPLLKIP

SEQ ID NO: 13035 - protein, 8 aa, BK virus
QPLLKIPK

SEQ ID NO: 13036 - protein, 8 aa, BK virus
PLLKIPKG

SEQ ID NO: 13037 - protein, 8 aa, BK virus
LLKIPKGQ

SEQ ID NO: 13038 - protein, 8 aa, BK virus
LKIPKGQT

SEQ ID NO: 13039 - protein, 8 aa, BK virus
KIPKGQTP

SEQ ID NO: 13040 - protein, 8 aa, BK virus
IPKGQTPI

SEQ ID NO: 13041 - protein, 8 aa, BK virus
PKGQTPIV

SEQ ID NO: 13042 - protein, 8 aa, BK virus
KGQTPIVK

SEQ ID NO: 13043 - protein, 8 aa, BK virus
GQTPIVKS

SEQ ID NO: 13044 - protein, 8 aa, BK virus
QTPIVKSC

SEQ ID NO: 13045 - protein, 8 aa, BK virus
TPIVKSCI

SEQ ID NO: 13046 - protein, 8 aa, BK virus
PIVKSCIC

SEQ ID NO: 13047 - protein, 8 aa, BK virus
IVKSCICV

SEQ ID NO: 13048 - protein, 8 aa, BK virus
VKSCICVK

SEQ ID NO: 13049 - protein, 8 aa, BK virus
KSCICVKA

SEQ ID NO: 13050 - protein, 8 aa, BK virus
SCICVKAF

SEQ ID NO: 13051 - protein, 8 aa, BK virus
CICVKAFS

SEQ ID NO: 13052 - protein, 8 aa, BK virus
ICVKAFSV

SEQ ID NO: 13053 - protein, 8 aa, BK virus
CVKAFSVL

SEQ ID NO: 13054 - protein, 8 aa, BK virus
VKAFSVLK

SEQ ID NO: 13055 - protein, 8 aa, BK virus
KAFSVLKG

SEQ ID NO: 13056 - protein, 8 aa, BK virus
AFSVLKGL

SEQ ID NO: 13057 - protein, 8 aa, BK virus
FSVLKGLK

SEQ ID NO: 13058 - protein, 8 aa, BK virus
SVLKGLKH

SEQ ID NO: 13059 - protein, 8 aa, BK virus
VLKGLKHH

SEQ ID NO: 13060 - protein, 8 aa, BK virus
LKGLKHHP

SEQ ID NO: 13061 - protein, 8 aa, BK virus
KGLKHHPQ

SEQ ID NO: 13062 - protein, 8 aa, BK virus
GLKHHPQN

SEQ ID NO: 13063 - protein, 8 aa, BK virus
LKHHPQNN

SEQ ID NO: 13064 - protein, 8 aa, BK virus
KHHPQNNT

SEQ ID NO: 13065 - protein, 8 aa, BK virus
HHPQNNTS

SEQ ID NO: 13066 - protein, 8 aa, BK virus
HPQNNTSL

SEQ ID NO: 13067 - protein, 8 aa, BK virus
PQNNTSLK

SEQ ID NO: 13068 - protein, 8 aa, BK virus
QNNTSLKV

SEQ ID NO: 13069 - protein, 8 aa, BK virus
NNTSLKVA

SEQ ID NO: 13070 - protein, 8 aa, BK virus
NTSLKVAY

SEQ ID NO: 13071 - protein, 8 aa, BK virus
TSLKVAYT

SEQ ID NO: 13072 - protein, 8 aa, BK virus
SLKVAYTK

SEQ ID NO: 13073 - protein, 8 aa, BK virus
LKVAYTKA

SEQ ID NO: 13074 - protein, 8 aa, BK virus
KVAYTKAA

SEQ ID NO: 13075 - protein, 8 aa, BK virus
VAYTKAAF

SEQ ID NO: 13076 - protein, 8 aa, BK virus
AYTKAAFI

SEQ ID NO: 13077 - protein, 8 aa, BK virus
YTKAAFIK

SEQ ID NO: 13078 - protein, 8 aa, BK virus
TKAAFIKC

SEQ ID NO: 13079 - protein, 8 aa, BK virus
KAAFIKCI

SEQ ID NO: 13080 - protein, 8 aa, BK virus
AAFIKCIC

SEQ ID NO: 13081 - protein, 8 aa, BK virus
AFIKCICT

SEQ ID NO: 13082 - protein, 8 aa, BK virus
FIKCICTI

SEQ ID NO: 13083 - protein, 8 aa, BK virus
IKCICTIK

SEQ ID NO: 13084 - protein, 8 aa, BK virus
KCICTIKA

SEQ ID NO: 13085 - protein, 8 aa, BK virus
CICTIKAP

SEQ ID NO: 13086 - protein, 8 aa, BK virus
ICTIKAPV

SEQ ID NO: 13087 - protein, 8 aa, BK virus
SILVCNCP

SEQ ID NO: 13088 - protein, 8 aa, BK virus
ILVCNCPC

SEQ ID NO: 13089 - protein, 8 aa, BK virus
LVCNCPCL

SEQ ID NO: 13090 - protein, 8 aa, BK virus
VCNCPCLS

SEQ ID NO: 13091 - protein, 8 aa, BK virus
CNCPCLSI

SEQ ID NO: 13092 - protein, 8 aa, BK virus
NCPCLSIY

SEQ ID NO: 13093 - protein, 8 aa, BK virus
CPCLSIYL

SEQ ID NO: 13094 - protein, 8 aa, BK virus
PCLSIYLI

SEQ ID NO: 13095 - protein, 8 aa, BK virus
CLSIYLII

SEQ ID NO: 13096 - protein, 8 aa, BK virus
LSIYLIIS

SEQ ID NO: 13097 - protein, 8 aa, BK virus
SIYLIISG

SEQ ID NO: 13098 - protein, 8 aa, BK virus
IYLIISGS

SEQ ID NO: 13099 - protein, 8 aa, BK virus
YLIISGSP

SEQ ID NO: 13100 - protein, 8 aa, BK virus
LIISGSPG

SEQ ID NO: 13101 - protein, 8 aa, BK virus
IISGSPGS

SEQ ID NO: 13102 - protein, 8 aa, BK virus
ISGSPGSL

SEQ ID NO: 13103 - protein, 8 aa, BK virus
SGSPGSLS

SEQ ID NO: 13104 - protein, 8 aa, BK virus
GSPGSLSV

SEQ ID NO: 13105 - protein, 8 aa, BK virus
SPGSLSVP

SEQ ID NO: 13106 - protein, 8 aa, BK virus
PGSLSVPS

SEQ ID NO: 13107 - protein, 8 aa, BK virus
GSLSVPSN

SEQ ID NO: 13108 - protein, 8 aa, BK virus
SLSVPSNT

SEQ ID NO: 13109 - protein, 8 aa, BK virus
LSVPSNTL

SEQ ID NO: 13110 - protein, 8 aa, BK virus
SVPSNTLT

SEQ ID NO: 13111 - protein, 8 aa, BK virus
VPSNTLTS

SEQ ID NO: 13112 - protein, 8 aa, BK virus
PSNTLTSS

SEQ ID NO: 13113 - protein, 8 aa, BK virus
SNTLTSST

SEQ ID NO: 13114 - protein, 8 aa, BK virus
NTLTSSTW

SEQ ID NO: 13115 - protein, 8 aa, BK virus
TLTSSTWD

SEQ ID NO: 13116 - protein, 8 aa, BK virus
LTSSTWDS

SEQ ID NO: 13117 - protein, 8 aa, BK virus
TSSTWDSI

SEQ ID NO: 13118 - protein, 8 aa, BK virus
SSTWDSIP

SEQ ID NO: 13119 - protein, 8 aa, BK virus
STWDSIPY

SEQ ID NO: 13120 - protein, 8 aa, BK virus
TWDSIPYI

SEQ ID NO: 13121 - protein, 8 aa, BK virus
WDSIPYIG

SEQ ID NO: 13122 - protein, 8 aa, BK virus
DSIPYIGC

SEQ ID NO: 13123 - protein, 8 aa, BK virus
SIPYIGCP

SEQ ID NO: 13124 - protein, 8 aa, BK virus
IPYIGCPS

SEQ ID NO: 13125 - protein, 8 aa, BK virus
PYIGCPST

SEQ ID NO: 13126 - protein, 8 aa, BK virus
YIGCPSTL

SEQ ID NO: 13127 - protein, 8 aa, BK virus
IGCPSTLW

SEQ ID NO: 13128 - protein, 8 aa, BK virus
GCPSTLWV

SEQ ID NO: 13129 - protein, 8 aa, BK virus
CPSTLWVL

SEQ ID NO: 13130 - protein, 8 aa, BK virus
PSTLWVLL

SEQ ID NO: 13131 - protein, 8 aa, BK virus
STLWVLLF

SEQ ID NO: 13132 - protein, 8 aa, BK virus
TLWVLLFI

SEQ ID NO: 13133 - protein, 8 aa, BK virus
LWVLLFIR

SEQ ID NO: 13134 - protein, 8 aa, BK virus
WVLLFIRS

SEQ ID NO: 13135 - protein, 8 aa, BK virus
VLLFIRSL

SEQ ID NO: 13136 - protein, 8 aa, BK virus
LLFIRSLS

SEQ ID NO: 13137 - protein, 8 aa, BK virus
LFIRSLSK

SEQ ID NO: 13138 - protein, 8 aa, BK virus
FIRSLSKK

SEQ ID NO: 13139 - protein, 8 aa, BK virus
IRSLSKKE

SEQ ID NO: 13140 - protein, 8 aa, BK virus
RSLSKKEI

SEQ ID NO: 13141 - protein, 8 aa, BK virus
SLSKKEIG

SEQ ID NO: 13142 - protein, 8 aa, BK virus
GFFTDLFL

SEQ ID NO: 13143 - protein, 8 aa, BK virus
FFTDLFLR

SEQ ID NO: 13144 - protein, 8 aa, BK virus
FTDLFLRR

SEQ ID NO: 13145 - protein, 8 aa, BK virus
TDLFLRRI

SEQ ID NO: 13146 - protein, 8 aa, BK virus
DLFLRRIL

SEQ ID NO: 13147 - protein, 8 aa, BK virus
LFLRRILK

SEQ ID NO: 13148 - protein, 8 aa, BK virus
FLRRILKY

SEQ ID NO: 13149 - protein, 8 aa, BK virus
LRRILKYL

SEQ ID NO: 13150 - protein, 8 aa, BK virus
RRILKYLA

SEQ ID NO: 13151 - protein, 8 aa, BK virus
RILKYLAR

SEQ ID NO: 13152 - protein, 8 aa, BK virus
ILKYLARP

SEQ ID NO: 13153 - protein, 8 aa, BK virus
LKYLARPL

SEQ ID NO: 13154 - protein, 8 aa, BK virus
KYLARPLH

SEQ ID NO: 13155 - protein, 8 aa, BK virus
YLARPLHC

SEQ ID NO: 13156 - protein, 8 aa, BK virus
LARPLHCC

SEQ ID NO: 13157 - protein, 8 aa, BK virus
ARPLHCCV

SEQ ID NO: 13158 - protein, 8 aa, BK virus
RPLHCCVP

SEQ ID NO: 13159 - protein, 8 aa, BK virus
PLHCCVPE

SEQ ID NO: 13160 - protein, 8 aa, BK virus
LHCCVPEL

SEQ ID NO: 13161 - protein, 8 aa, BK virus
HCCVPELL

SEQ ID NO: 13162 - protein, 8 aa, BK virus
CCVPELLV

SEQ ID NO: 13163 - protein, 8 aa, BK virus
CVPELLVN

SEQ ID NO: 13164 - protein, 8 aa, BK virus
VPELLVNR

SEQ ID NO: 13165 - protein, 8 aa, BK virus
PELLVNRP

SEQ ID NO: 13166 - protein, 8 aa, BK virus
ELLVNRPQ

SEQ ID NO: 13167 - protein, 8 aa, BK virus
LLVNRPQI

SEQ ID NO: 13168 - protein, 8 aa, BK virus
LVNRPQIS

SEQ ID NO: 13169 - protein, 8 aa, BK virus
VNRPQISA

SEQ ID NO: 13170 - protein, 8 aa, BK virus
NRPQISAA

SEQ ID NO: 13171 - protein, 8 aa, BK virus
RPQISAAE

SEQ ID NO: 13172 - protein, 8 aa, BK virus
PQISAAET

SEQ ID NO: 13173 - protein, 8 aa, BK virus
QISAAETY

SEQ ID NO: 13174 - protein, 8 aa, BK virus
ISAAETYR

SEQ ID NO: 13175 - protein, 8 aa, BK virus
SAAETYRL

SEQ ID NO: 13176 - protein, 8 aa, BK virus
AAETYRLS

SEQ ID NO: 13177 - protein, 8 aa, BK virus
AETYRLSA

SEQ ID NO: 13178 - protein, 8 aa, BK virus
ETYRLSAL

SEQ ID NO: 13179 - protein, 8 aa, BK virus
TYRLSALQ

SEQ ID NO: 13180 - protein, 8 aa, BK virus
YRLSALQR

SEQ ID NO: 13181 - protein, 8 aa, BK virus
RLSALQRG

SEQ ID NO: 13182 - protein, 8 aa, BK virus
LSALQRGP

SEQ ID NO: 13183 - protein, 8 aa, BK virus
SALQRGPT

SEQ ID NO: 13184 - protein, 8 aa, BK virus
ALQRGPTP

SEQ ID NO: 13185 - protein, 8 aa, BK virus
LQRGPTPC

SEQ ID NO: 13186 - protein, 8 aa, BK virus
QRGPTPCS

SEQ ID NO: 13187 - protein, 8 aa, BK virus
RGPTPCSS

SEQ ID NO: 13188 - protein, 8 aa, BK virus
GPTPCSSS

SEQ ID NO: 13189 - protein, 8 aa, BK virus
PTPCSSSN

SEQ ID NO: 13190 - protein, 8 aa, BK virus
TPCSSSNT

SEQ ID NO: 13191 - protein, 8 aa, BK virus
PCSSSNTV

SEQ ID NO: 13192 - protein, 8 aa, BK virus
CSSSNTVV

SEQ ID NO: 13193 - protein, 8 aa, BK virus
SSSNTVVA

SEQ ID NO: 13194 - protein, 8 aa, BK virus
SSNTVVAV

SEQ ID NO: 13195 - protein, 8 aa, BK virus
SNTVVAVL

SEQ ID NO: 13196 - protein, 8 aa, BK virus
NTVVAVLV

SEQ ID NO: 13197 - protein, 8 aa, BK virus
TVVAVLVT

SEQ ID NO: 13198 - protein, 8 aa, BK virus
STGGTFSP

SEQ ID NO: 13199 - protein, 8 aa, BK virus
TGGTFSPP

SEQ ID NO: 13200 - protein, 8 aa, BK virus
GGTFSPPV

SEQ ID NO: 13201 - protein, 8 aa, BK virus
GTFSPPVK

SEQ ID NO: 13202 - protein, 8 aa, BK virus
TFSPPVKV

SEQ ID NO: 13203 - protein, 8 aa, BK virus
FSPPVKVP

SEQ ID NO: 13204 - protein, 8 aa, BK virus
SPPVKVPK

SEQ ID NO: 13205 - protein, 8 aa, BK virus
PPVKVPKY

SEQ ID NO: 13206 - protein, 8 aa, BK virus
PVKVPKYL

SEQ ID NO: 13207 - protein, 8 aa, BK virus
VKVPKYLA

SEQ ID NO: 13208 - protein, 8 aa, BK virus
KVPKYLAF

SEQ ID NO: 13209 - protein, 8 aa, BK virus
VPKYLAFS

SEQ ID NO: 13210 - protein, 8 aa, BK virus
PKYLAFSF

SEQ ID NO: 13211 - protein, 8 aa, BK virus
KYLAFSFL

SEQ ID NO: 13212 - protein, 8 aa, BK virus
YLAFSFLL

SEQ ID NO: 13213 - protein, 8 aa, BK virus
LAFSFLLG

SEQ ID NO: 13214 - protein, 8 aa, BK virus
AFSFLLGS

SEQ ID NO: 13215 - protein, 8 aa, BK virus
FSFLLGSG

SEQ ID NO: 13216 - protein, 8 aa, BK virus
SFLLGSGT

SEQ ID NO: 13217 - protein, 8 aa, BK virus
FLLGSGTQ

SEQ ID NO: 13218 - protein, 8 aa, BK virus
LLGSGTQH

SEQ ID NO: 13219 - protein, 8 aa, BK virus
LGSGTQHS

SEQ ID NO: 13220 - protein, 8 aa, BK virus
GSGTQHST

SEQ ID NO: 13221 - protein, 8 aa, BK virus
SGTQHSTG

SEQ ID NO: 13222 - protein, 8 aa, BK virus
ALWSVFIT

SEQ ID NO: 13223 - protein, 8 aa, BK virus
LWSVFITW

SEQ ID NO: 13224 - protein, 8 aa, BK virus
WSVFITWD

SEQ ID NO: 13225 - protein, 8 aa, BK virus
SVFITWDW

SEQ ID NO: 13226 - protein, 8 aa, BK virus
VFITWDWA

SEQ ID NO: 13227 - protein, 8 aa, BK virus
FITWDWAV

SEQ ID NO: 13228 - protein, 8 aa, BK virus
ITWDWAVG

SEQ ID NO: 13229 - protein, 8 aa, BK virus
TWDWAVGF

SEQ ID NO: 13230 - protein, 8 aa, BK virus
WDWAVGFL

SEQ ID NO: 13231 - protein, 8 aa, BK virus
DWAVGFLG

SEQ ID NO: 13232 - protein, 8 aa, BK virus
WAVGFLGV

SEQ ID NO: 13233 - protein, 8 aa, BK virus
AVGFLGVI

SEQ ID NO: 13234 - protein, 8 aa, BK virus
VGFLGVIV

SEQ ID NO: 13235 - protein, 8 aa, BK virus
GFLGVIVP

SEQ ID NO: 13236 - protein, 8 aa, BK virus
FLGVIVPS

SEQ ID NO: 13237 - protein, 8 aa, BK virus
LGVIVPSG

SEQ ID NO: 13238 - protein, 8 aa, BK virus
GVIVPSGY

SEQ ID NO: 13239 - protein, 8 aa, BK virus
VIVPSGYF

SEQ ID NO: 13240 - protein, 8 aa, BK virus
IVPSGYFD

SEQ ID NO: 13241 - protein, 8 aa, BK virus
VPSGYFDL

SEQ ID NO: 13242 - protein, 8 aa, BK virus
FISTPCIS

SEQ ID NO: 13243 - protein, 8 aa, BK virus
ISTPCISK

SEQ ID NO: 13244 - protein, 8 aa, BK virus
STPCISKG

SEQ ID NO: 13245 - protein, 8 aa, BK virus
TPCISKGS

SEQ ID NO: 13246 - protein, 8 aa, BK virus
PCISKGSP

SEQ ID NO: 13247 - protein, 8 aa, BK virus
CISKGSPP

SEQ ID NO: 13248 - protein, 8 aa, BK virus
ISKGSPPT

SEQ ID NO: 13249 - protein, 8 aa, BK virus
SKGSPPTA

SEQ ID NO: 13250 - protein, 8 aa, BK virus
KGSPPTAK

SEQ ID NO: 13251 - protein, 8 aa, BK virus
GSPPTAKK

SEQ ID NO: 13252 - protein, 8 aa, BK virus
SPPTAKKW

SEQ ID NO: 13253 - protein, 8 aa, BK virus
PPTAKKWK

SEQ ID NO: 13254 - protein, 8 aa, BK virus
PTAKKWKL

SEQ ID NO: 13255 - protein, 8 aa, BK virus
TAKKWKLL

SEQ ID NO: 13256 - protein, 8 aa, BK virus
AKKWKLLP

SEQ ID NO: 13257 - protein, 8 aa, BK virus
IGFPPPCS

SEQ ID NO: 13258 - protein, 8 aa, BK virus
GFPPPCSC

SEQ ID NO: 13259 - protein, 8 aa, BK virus
FPPPCSCT

SEQ ID NO: 13260 - protein, 8 aa, BK virus
PPPCSCTF

SEQ ID NO: 13261 - protein, 8 aa, BK virus
PPCSCTFC

SEQ ID NO: 13262 - protein, 8 aa, BK virus
PCSCTFCD

SEQ ID NO: 13263 - protein, 8 aa, BK virus
CSCTFCDP

SEQ ID NO: 13264 - protein, 8 aa, BK virus
SCTFCDPA

SEQ ID NO: 13265 - protein, 8 aa, BK virus
RLSMLVIP

SEQ ID NO: 13266 - protein, 8 aa, BK virus
LSMLVIPI

SEQ ID NO: 13267 - protein, 8 aa, BK virus
SMLVIPIT

SEQ ID NO: 13268 - protein, 8 aa, BK virus
MLVIPITS

SEQ ID NO: 13269 - protein, 8 aa, BK virus
LVIPITSV

SEQ ID NO: 13270 - protein, 8 aa, BK virus
VIPITSVC

SEQ ID NO: 13271 - protein, 8 aa, BK virus
IPITSVCT

SEQ ID NO: 13272 - protein, 8 aa, BK virus
PITSVCTV

SEQ ID NO: 13273 - protein, 8 aa, BK virus
ITSVCTVT

SEQ ID NO: 13274 - protein, 8 aa, BK virus
TSVCTVTA

SEQ ID NO: 13275 - protein, 8 aa, BK virus
SVCTVTAS

SEQ ID NO: 13276 - protein, 8 aa, BK virus
VCTVTASH

SEQ ID NO: 13277 - protein, 8 aa, BK virus
CTVTASHI

SEQ ID NO: 13278 - protein, 8 aa, BK virus
TVTASHIS

SEQ ID NO: 13279 - protein, 8 aa, BK virus
VTASHISR

SEQ ID NO: 13280 - protein, 8 aa, BK virus
TASHISRF

SEQ ID NO: 13281 - protein, 8 aa, BK virus
ASHISRFP

SEQ ID NO: 13282 - protein, 8 aa, BK virus
SHISRFPQ

SEQ ID NO: 13283 - protein, 8 aa, BK virus
HISRFPQV

SEQ ID NO: 13284 - protein, 8 aa, BK virus
ISRFPQVR

SEQ ID NO: 13285 - protein, 8 aa, BK virus
SRFPQVRS

SEQ ID NO: 13286 - protein, 8 aa, BK virus
RFPQVRSS

SEQ ID NO: 13287 - protein, 8 aa, BK virus
FPQVRSSF

SEQ ID NO: 13288 - protein, 8 aa, BK virus
PQVRSSFK

SEQ ID NO: 13289 - protein, 8 aa, BK virus
QVRSSFKL

SEQ ID NO: 13290 - protein, 8 aa, BK virus
VRSSFKLG

SEQ ID NO: 13291 - protein, 8 aa, BK virus
RSSFKLGR

SEQ ID NO: 13292 - protein, 8 aa, BK virus
SSFKLGRG

SEQ ID NO: 13293 - protein, 8 aa, BK virus
SFKLGRGI

SEQ ID NO: 13294 - protein, 8 aa, BK virus
FKLGRGIL

SEQ ID NO: 13295 - protein, 8 aa, BK virus
KLGRGILA

SEQ ID NO: 13296 - protein, 8 aa, BK virus
LGRGILAV

SEQ ID NO: 13297 - protein, 8 aa, BK virus
GRGILAVL

SEQ ID NO: 13298 - protein, 8 aa, BK virus
QGSIFLSG

SEQ ID NO: 13299 - protein, 8 aa, BK virus
GSIFLSGL

SEQ ID NO: 13300 - protein, 8 aa, BK virus
SIFLSGLS

SEQ ID NO: 13301 - protein, 8 aa, BK virus
IFLSGLSL

SEQ ID NO: 13302 - protein, 8 aa, BK virus
FLSGLSLL

SEQ ID NO: 13303 - protein, 8 aa, BK virus
LSGLSLLK

SEQ ID NO: 13304 - protein, 8 aa, BK virus
SGLSLLKS

SEQ ID NO: 13305 - protein, 8 aa, BK virus
GLSLLKSF

SEQ ID NO: 13306 - protein, 8 aa, BK virus
LSLLKSFS

SEQ ID NO: 13307 - protein, 8 aa, BK virus
SLLKSFSA

SEQ ID NO: 13308 - protein, 8 aa, BK virus
LLKSFSAL

SEQ ID NO: 13309 - protein, 8 aa, BK virus
LKSFSALS

SEQ ID NO: 13310 - protein, 8 aa, BK virus
KSFSALSF

SEQ ID NO: 13311 - protein, 8 aa, BK virus
SFSALSFR

SEQ ID NO: 13312 - protein, 8 aa, BK virus
FSALSFRL

SEQ ID NO: 13313 - protein, 8 aa, BK virus
SALSFRLK

SEQ ID NO: 13314 - protein, 8 aa, BK virus
ALSFRLKP

SEQ ID NO: 13315 - protein, 8 aa, BK virus
LSFRLKPL

SEQ ID NO: 13316 - protein, 8 aa, BK virus
SFRLKPLR

SEQ ID NO: 13317 - protein, 8 aa, BK virus
FRLKPLRF

SEQ ID NO: 13318 - protein, 8 aa, BK virus
RLKPLRFS

SEQ ID NO: 13319 - protein, 8 aa, BK virus
LKPLRFSS

SEQ ID NO: 13320 - protein, 8 aa, BK virus
KPLRFSSG

SEQ ID NO: 13321 - protein, 8 aa, BK virus
PLRFSSGS

SEQ ID NO: 13322 - protein, 8 aa, BK virus
LRFSSGSP

SEQ ID NO: 13323 - protein, 8 aa, BK virus
RFSSGSPI

SEQ ID NO: 13324 - protein, 8 aa, BK virus
FSSGSPIS

SEQ ID NO: 13325 - protein, 8 aa, BK virus
SSGSPISG

SEQ ID NO: 13326 - protein, 8 aa, BK virus
SGSPISGF

SEQ ID NO: 13327 - protein, 8 aa, BK virus
GSPISGFR

SEQ ID NO: 13328 - protein, 8 aa, BK virus
SPISGFRK

SEQ ID NO: 13329 - protein, 8 aa, BK virus
PISGFRKH

SEQ ID NO: 13330 - protein, 8 aa, BK virus
ISGFRKHS

SEQ ID NO: 13331 - protein, 8 aa, BK virus
SGFRKHST

SEQ ID NO: 13332 - protein, 8 aa, BK virus
GFRKHSTS

SEQ ID NO: 13333 - protein, 8 aa, BK virus
FRKHSTSV

SEQ ID NO: 13334 - protein, 8 aa, BK virus
RKHSTSVI

SEQ ID NO: 13335 - protein, 8 aa, BK virus
KHSTSVIA

SEQ ID NO: 13336 - protein, 8 aa, BK virus
HSTSVIAS

SEQ ID NO: 13337 - protein, 8 aa, BK virus
STSVIAST

SEQ ID NO: 13338 - protein, 8 aa, BK virus
TSVIASTP

SEQ ID NO: 13339 - protein, 8 aa, BK virus
SVIASTPV

SEQ ID NO: 13340 - protein, 8 aa, BK virus
VIASTPVL

SEQ ID NO: 13341 - protein, 8 aa, BK virus
IASTPVLT

SEQ ID NO: 13342 - protein, 8 aa, BK virus
ASTPVLTS

SEQ ID NO: 13343 - protein, 8 aa, BK virus
STPVLTSR

SEQ ID NO: 13344 - protein, 8 aa, BK virus
TPVLTSRT

SEQ ID NO: 13345 - protein, 8 aa, BK virus
PVLTSRTS

SEQ ID NO: 13346 - protein, 8 aa, BK virus
VLTSRTST

SEQ ID NO: 13347 - protein, 8 aa, BK virus
LTSRTSTP

SEQ ID NO: 13348 - protein, 8 aa, BK virus
TSRTSTPP

SEQ ID NO: 13349 - protein, 8 aa, BK virus
SRTSTPPF

SEQ ID NO: 13350 - protein, 8 aa, BK virus
RTSTPPFI

SEQ ID NO: 13351 - protein, 8 aa, BK virus
TSTPPFIS

SEQ ID NO: 13352 - protein, 8 aa, BK virus
STPPFISS

SEQ ID NO: 13353 - protein, 8 aa, BK virus
TPPFISSF

SEQ ID NO: 13354 - protein, 8 aa, BK virus
PPFISSFG

SEQ ID NO: 13355 - protein, 8 aa, BK virus
PFISSFGT

SEQ ID NO: 13356 - protein, 8 aa, BK virus
FISSFGTC

SEQ ID NO: 13357 - protein, 8 aa, BK virus
ISSFGTCT

SEQ ID NO: 13358 - protein, 8 aa, BK virus
SSFGTCTG

SEQ ID NO: 13359 - protein, 8 aa, BK virus
SFGTCTGS

SEQ ID NO: 13360 - protein, 8 aa, BK virus
FGTCTGSF

SEQ ID NO: 13361 - protein, 8 aa, BK virus
GTCTGSFG

SEQ ID NO: 13362 - protein, 8 aa, BK virus
TCTGSFGF

SEQ ID NO: 13363 - protein, 8 aa, BK virus
CTGSFGFL

SEQ ID NO: 13364 - protein, 8 aa, BK virus
TGSFGFLG

SEQ ID NO: 13365 - protein, 8 aa, BK virus
GSFGFLGA

SEQ ID NO: 13366 - protein, 8 aa, BK virus
SFGFLGAA

SEQ ID NO: 13367 - protein, 8 aa, BK virus
FGFLGAAP

SEQ ID NO: 13368 - protein, 8 aa, BK virus
GFLGAAPG

SEQ ID NO: 13369 - protein, 8 aa, BK virus
FLGAAPGH

SEQ ID NO: 13370 - protein, 8 aa, BK virus
LGAAPGHS

SEQ ID NO: 13371 - protein, 8 aa, BK virus
GAAPGHSP

SEQ ID NO: 13372 - protein, 8 aa, BK virus
AAPGHSPF

SEQ ID NO: 13373 - protein, 8 aa, BK virus
APGHSPFL

SEQ ID NO: 13374 - protein, 8 aa, BK virus
PGHSPFLL

SEQ ID NO: 13375 - protein, 8 aa, BK virus
GHSPFLLV

SEQ ID NO: 13376 - protein, 8 aa, BK virus
HSPFLLVG

SEQ ID NO: 13377 - protein, 8 aa, BK virus
SPFLLVGA

SEQ ID NO: 13378 - protein, 8 aa, BK virus
PFLLVGAI

SEQ ID NO: 13379 - protein, 8 aa, BK virus
FLLVGAIF

SEQ ID NO: 13380 - protein, 8 aa, BK virus
LLVGAIFI

SEQ ID NO: 13381 - protein, 8 aa, BK virus
LVGAIFIC

SEQ ID NO: 13382 - protein, 8 aa, BK virus
VGAIFICF

SEQ ID NO: 13383 - protein, 8 aa, BK virus
GAIFICFK

SEQ ID NO: 13384 - protein, 8 aa, BK virus
AIFICFKS

SEQ ID NO: 13385 - protein, 8 aa, BK virus
IFICFKSR

SEQ ID NO: 13386 - protein, 8 aa, BK virus
FICFKSRC

SEQ ID NO: 13387 - protein, 8 aa, BK virus
ICFKSRCY

SEQ ID NO: 13388 - protein, 8 aa, BK virus
CFKSRCYS

SEQ ID NO: 13389 - protein, 8 aa, BK virus
FKSRCYSP

SEQ ID NO: 13390 - protein, 8 aa, BK virus
KSRCYSPV

SEQ ID NO: 13391 - protein, 8 aa, BK virus
SRCYSPVQ

SEQ ID NO: 13392 - protein, 8 aa, BK virus
RCYSPVQA

SEQ ID NO: 13393 - protein, 8 aa, BK virus
RQHPLRSS

SEQ ID NO: 13394 - protein, 8 aa, BK virus
QHPLRSSS

SEQ ID NO: 13395 - protein, 8 aa, BK virus
HPLRSSSL

SEQ ID NO: 13396 - protein, 8 aa, BK virus
PLRSSSLI

SEQ ID NO: 13397 - protein, 8 aa, BK virus
LRSSSLIS

SEQ ID NO: 13398 - protein, 8 aa, BK virus
RSSSLIST

SEQ ID NO: 13399 - protein, 8 aa, BK virus
SSSLISTS

SEQ ID NO: 13400 - protein, 8 aa, BK virus
SSLISTSW

SEQ ID NO: 13401 - protein, 8 aa, BK virus
SLISTSWG

SEQ ID NO: 13402 - protein, 8 aa, BK virus
LISTSWGN

SEQ ID NO: 13403 - protein, 8 aa, BK virus
ISTSWGNS

SEQ ID NO: 13404 - protein, 8 aa, BK virus
STSWGNSF

SEQ ID NO: 13405 - protein, 8 aa, BK virus
TSWGNSFF

SEQ ID NO: 13406 - protein, 8 aa, BK virus
SWGNSFFY

SEQ ID NO: 13407 - protein, 8 aa, BK virus
WGNSFFYK

SEQ ID NO: 13408 - protein, 8 aa, BK virus
GNSFFYKL

SEQ ID NO: 13409 - protein, 8 aa, BK virus
NSFFYKLS

SEQ ID NO: 13410 - protein, 8 aa, BK virus
VHSLCNFF

SEQ ID NO: 13411 - protein, 8 aa, BK virus
HSLCNFFY

SEQ ID NO: 13412 - protein, 8 aa, BK virus
SLCNFFYT

SEQ ID NO: 13413 - protein, 8 aa, BK virus
LCNFFYTV

SEQ ID NO: 13414 - protein, 8 aa, BK virus
CNFFYTVS

SEQ ID NO: 13415 - protein, 8 aa, BK virus
NFFYTVSI

SEQ ID NO: 13416 - protein, 8 aa, BK virus
FFYTVSII

SEQ ID NO: 13417 - protein, 8 aa, BK virus
FYTVSIIY

SEQ ID NO: 13418 - protein, 8 aa, BK virus
YTVSIIYT

SEQ ID NO: 13419 - protein, 8 aa, BK virus
TVSIIYTI

SEQ ID NO: 13420 - protein, 8 aa, BK virus
VSIIYTIS

SEQ ID NO: 13421 - protein, 8 aa, BK virus
SIIYTISM

SEQ ID NO: 13422 - protein, 8 aa, BK virus
IIYTISMA

SEQ ID NO: 13423 - protein, 8 aa, BK virus
IYTISMAK

SEQ ID NO: 13424 - protein, 8 aa, BK virus
YTISMAKM

SEQ ID NO: 13425 - protein, 8 aa, BK virus
TISMAKMY

SEQ ID NO: 13426 - protein, 8 aa, BK virus
ISMAKMYT

SEQ ID NO: 13427 - protein, 8 aa, BK virus
SMAKMYTG

SEQ ID NO: 13428 - protein, 8 aa, BK virus
MAKMYTGT

SEQ ID NO: 13429 - protein, 8 aa, BK virus
AKMYTGTF

SEQ ID NO: 13430 - protein, 8 aa, BK virus
KMYTGTFP

SEQ ID NO: 13431 - protein, 8 aa, BK virus
MYTGTFPF

SEQ ID NO: 13432 - protein, 8 aa, BK virus
YTGTFPFS

SEQ ID NO: 13433 - protein, 8 aa, BK virus
TGTFPFSY

SEQ ID NO: 13434 - protein, 8 aa, BK virus
GTFPFSYL

SEQ ID NO: 13435 - protein, 8 aa, BK virus
TFPFSYLS

SEQ ID NO: 13436 - protein, 8 aa, BK virus
FPFSYLSN

SEQ ID NO: 13437 - protein, 8 aa, BK virus
PFSYLSNH

SEQ ID NO: 13438 - protein, 8 aa, BK virus
GPNRGKIR

SEQ ID NO: 13439 - protein, 8 aa, BK virus
PNRGKIRI

SEQ ID NO: 13440 - protein, 8 aa, BK virus
NRGKIRII

SEQ ID NO: 13441 - protein, 8 aa, BK virus
RGKIRIIL

SEQ ID NO: 13442 - protein, 8 aa, BK virus
GKIRIILL

SEQ ID NO: 13443 - protein, 8 aa, BK virus
KIRIILLN

SEQ ID NO: 13444 - protein, 8 aa, BK virus
IRIILLNI

SEQ ID NO: 13445 - protein, 8 aa, BK virus
RIILLNII

SEQ ID NO: 13446 - protein, 8 aa, BK virus
IILLNIII

SEQ ID NO: 13447 - protein, 8 aa, BK virus
ILLNIIIK

SEQ ID NO: 13448 - protein, 8 aa, BK virus
LLNIIIKV

SEQ ID NO: 13449 - protein, 8 aa, BK virus
LNIIIKVY

SEQ ID NO: 13450 - protein, 8 aa, BK virus
NIIIKVYR

SEQ ID NO: 13451 - protein, 8 aa, BK virus
IIIKVYRG

SEQ ID NO: 13452 - protein, 8 aa, BK virus
IIKVYRGI

SEQ ID NO: 13453 - protein, 8 aa, BK virus
IKVYRGIY

SEQ ID NO: 13454 - protein, 8 aa, BK virus
KVYRGIYN

SEQ ID NO: 13455 - protein, 8 aa, BK virus
VYRGIYNC

SEQ ID NO: 13456 - protein, 8 aa, BK virus
YRGIYNCP

SEQ ID NO: 13457 - protein, 8 aa, BK virus
RGIYNCPG

SEQ ID NO: 13458 - protein, 8 aa, BK virus
GIYNCPGS

SEQ ID NO: 13459 - protein, 8 aa, BK virus
IYNCPGSF

SEQ ID NO: 13460 - protein, 8 aa, BK virus
YNCPGSFL

SEQ ID NO: 13461 - protein, 8 aa, BK virus
NCPGSFLQ

SEQ ID NO: 13462 - protein, 8 aa, BK virus
CPGSFLQK

SEQ ID NO: 13463 - protein, 8 aa, BK virus
PGSFLQKS

SEQ ID NO: 13464 - protein, 8 aa, BK virus
GSFLQKSS

SEQ ID NO: 13465 - protein, 8 aa, BK virus
SFLQKSSQ

SEQ ID NO: 13466 - protein, 8 aa, BK virus
FLQKSSQG

SEQ ID NO: 13467 - protein, 8 aa, BK virus
LQKSSQGV

SEQ ID NO: 13468 - protein, 8 aa, BK virus
QKSSQGVS

SEQ ID NO: 13469 - protein, 8 aa, BK virus
KSSQGVSK

SEQ ID NO: 13470 - protein, 8 aa, BK virus
SSQGVSKK

SEQ ID NO: 13471 - protein, 8 aa, BK virus
SQGVSKKS

SEQ ID NO: 13472 - protein, 8 aa, BK virus
QGVSKKSF

SEQ ID NO: 13473 - protein, 8 aa, BK virus
GVSKKSFC

SEQ ID NO: 13474 - protein, 8 aa, BK virus
VSKKSFCS

SEQ ID NO: 13475 - protein, 8 aa, BK virus
SKKSFCSS

SEQ ID NO: 13476 - protein, 8 aa, BK virus
KKSFCSSL

SEQ ID NO: 13477 - protein, 8 aa, BK virus
KSFCSSLQ

SEQ ID NO: 13478 - protein, 8 aa, BK virus
SFCSSLQF

SEQ ID NO: 13479 - protein, 8 aa, BK virus
FCSSLQFL

SEQ ID NO: 13480 - protein, 8 aa, BK virus
GYRRYIIP

SEQ ID NO: 13481 - protein, 8 aa, BK virus
YRRYIIPN

SEQ ID NO: 13482 - protein, 8 aa, BK virus
RRYIIPNN

SEQ ID NO: 13483 - protein, 8 aa, BK virus
RYIIPNNM

SEQ ID NO: 13484 - protein, 8 aa, BK virus
YIIPNNMP

SEQ ID NO: 13485 - protein, 8 aa, BK virus
IIPNNMPQ

SEQ ID NO: 13486 - protein, 8 aa, BK virus
IPNNMPQS

SEQ ID NO: 13487 - protein, 8 aa, BK virus
PNNMPQSL

SEQ ID NO: 13488 - protein, 8 aa, BK virus
NNMPQSLG

SEQ ID NO: 13489 - protein, 8 aa, BK virus
NMPQSLGN

SEQ ID NO: 13490 - protein, 8 aa, BK virus
MPQSLGNS

SEQ ID NO: 13491 - protein, 8 aa, BK virus
PQSLGNSS

SEQ ID NO: 13492 - protein, 8 aa, BK virus
QSLGNSSK

SEQ ID NO: 13493 - protein, 8 aa, BK virus
SLGNSSKQ

SEQ ID NO: 13494 - protein, 8 aa, BK virus
LGNSSKQR

SEQ ID NO: 13495 - protein, 8 aa, BK virus
GNSSKQRR

SEQ ID NO: 13496 - protein, 8 aa, BK virus
NSSKQRRT

SEQ ID NO: 13497 - protein, 8 aa, BK virus
SSKQRRTP

SEQ ID NO: 13498 - protein, 8 aa, BK virus
SKQRRTPM

SEQ ID NO: 13499 - protein, 8 aa, BK virus
KQRRTPMP

SEQ ID NO: 13500 - protein, 8 aa, BK virus
QRRTPMPR

SEQ ID NO: 13501 - protein, 8 aa, BK virus
RRTPMPRI

SEQ ID NO: 13502 - protein, 8 aa, BK virus
RTPMPRIK

SEQ ID NO: 13503 - protein, 8 aa, BK virus
TPMPRIKV

SEQ ID NO: 13504 - protein, 8 aa, BK virus
PMPRIKVL

SEQ ID NO: 13505 - protein, 8 aa, BK virus
MPRIKVLN

SEQ ID NO: 13506 - protein, 8 aa, BK virus
PRIKVLNI

SEQ ID NO: 13507 - protein, 8 aa, BK virus
RIKVLNII

SEQ ID NO: 13508 - protein, 8 aa, BK virus
IKVLNIIN

SEQ ID NO: 13509 - protein, 8 aa, BK virus
KVLNIINK

SEQ ID NO: 13510 - protein, 8 aa, BK virus
VLNIINKS

SEQ ID NO: 13511 - protein, 8 aa, BK virus
LNIINKSI

SEQ ID NO: 13512 - protein, 8 aa, BK virus
NIINKSIY

SEQ ID NO: 13513 - protein, 8 aa, BK virus
IINKSIYT

SEQ ID NO: 13514 - protein, 8 aa, BK virus
INKSIYTR

SEQ ID NO: 13515 - protein, 8 aa, BK virus
NKSIYTRK

SEQ ID NO: 13516 - protein, 8 aa, BK virus
KSIYTRKQ

SEQ ID NO: 13517 - protein, 8 aa, BK virus
SIYTRKQN

SEQ ID NO: 13518 - protein, 8 aa, BK virus
IYTRKQNI

SEQ ID NO: 13519 - protein, 8 aa, BK virus
YTRKQNII

SEQ ID NO: 13520 - protein, 8 aa, BK virus
TRKQNIIV

SEQ ID NO: 13521 - protein, 8 aa, BK virus
RKQNIIVL

SEQ ID NO: 13522 - protein, 8 aa, BK virus
KQNIIVLI

SEQ ID NO: 13523 - protein, 8 aa, BK virus
QNIIVLIW

SEQ ID NO: 13524 - protein, 8 aa, BK virus
NIIVLIWV

SEQ ID NO: 13525 - protein, 8 aa, BK virus
IIVLIWVK

SEQ ID NO: 13526 - protein, 8 aa, BK virus
IVLIWVKQ

SEQ ID NO: 13527 - protein, 8 aa, BK virus
VLIWVKQF

SEQ ID NO: 13528 - protein, 8 aa, BK virus
LIWVKQFQ

SEQ ID NO: 13529 - protein, 8 aa, BK virus
IWVKQFQS

SEQ ID NO: 13530 - protein, 8 aa, BK virus
WVKQFQSH

SEQ ID NO: 13531 - protein, 8 aa, BK virus
VKQFQSHA

SEQ ID NO: 13532 - protein, 8 aa, BK virus
LLIEAYSG

SEQ ID NO: 13533 - protein, 8 aa, BK virus
LIEAYSGN

SEQ ID NO: 13534 - protein, 8 aa, BK virus
IEAYSGNF

SEQ ID NO: 13535 - protein, 8 aa, BK virus
EAYSGNFV

SEQ ID NO: 13536 - protein, 8 aa, BK virus
AYSGNFVI

SEQ ID NO: 13537 - protein, 8 aa, BK virus
YSGNFVIP

SEQ ID NO: 13538 - protein, 8 aa, BK virus
SGNFVIPI

SEQ ID NO: 13539 - protein, 8 aa, BK virus
GNFVIPII

SEQ ID NO: 13540 - protein, 8 aa, BK virus
NFVIPIIK

SEQ ID NO: 13541 - protein, 8 aa, BK virus
FVIPIIKE

SEQ ID NO: 13542 - protein, 8 aa, BK virus
VIPIIKEL

SEQ ID NO: 13543 - protein, 8 aa, BK virus
IPIIKELI

SEQ ID NO: 13544 - protein, 8 aa, BK virus
PIIKELIP

SEQ ID NO: 13545 - protein, 8 aa, BK virus
IIKELIPY

SEQ ID NO: 13546 - protein, 8 aa, BK virus
IKELIPYL

SEQ ID NO: 13547 - protein, 8 aa, BK virus
KELIPYLS

SEQ ID NO: 13548 - protein, 8 aa, BK virus
GTNTTNSL

SEQ ID NO: 13549 - protein, 8 aa, BK virus
TNTTNSLN

SEQ ID NO: 13550 - protein, 8 aa, BK virus
SSKPSNSP

SEQ ID NO: 13551 - protein, 8 aa, BK virus
SKPSNSPR

SEQ ID NO: 13552 - protein, 8 aa, BK virus
KPSNSPRS

SEQ ID NO: 13553 - protein, 8 aa, BK virus
PSNSPRST

SEQ ID NO: 13554 - protein, 8 aa, BK virus
SNSPRSTS

SEQ ID NO: 13555 - protein, 8 aa, BK virus
NSPRSTSN

SEQ ID NO: 13556 - protein, 8 aa, BK virus
SPRSTSNY

SEQ ID NO: 13557 - protein, 8 aa, BK virus
PRSTSNYS

SEQ ID NO: 13558 - protein, 8 aa, BK virus
RSTSNYSI

SEQ ID NO: 13559 - protein, 8 aa, BK virus
STSNYSIC

SEQ ID NO: 13560 - protein, 8 aa, BK virus
TSNYSICL

SEQ ID NO: 13561 - protein, 8 aa, BK virus
SNYSICLR

SEQ ID NO: 13562 - protein, 8 aa, BK virus
NYSICLRS

SEQ ID NO: 13563 - protein, 8 aa, BK virus
GTCYALYS

SEQ ID NO: 13564 - protein, 8 aa, BK virus
TCYALYSS

SEQ ID NO: 13565 - protein, 8 aa, BK virus
CYALYSSK

SEQ ID NO: 13566 - protein, 8 aa, BK virus
YALYSSKG

SEQ ID NO: 13567 - protein, 8 aa, BK virus
ALYSSKGC

SEQ ID NO: 13568 - protein, 8 aa, BK virus
LYSSKGCN

SEQ ID NO: 13569 - protein, 8 aa, BK virus
YSSKGCNL

SEQ ID NO: 13570 - protein, 8 aa, BK virus
SSKGCNLN

SEQ ID NO: 13571 - protein, 8 aa, BK virus
SKGCNLNF

SEQ ID NO: 13572 - protein, 8 aa, BK virus
KGCNLNFY

SEQ ID NO: 13573 - protein, 8 aa, BK virus
GCNLNFYS

SEQ ID NO: 13574 - protein, 8 aa, BK virus
CNLNFYSS

SEQ ID NO: 13575 - protein, 8 aa, BK virus
NLNFYSSS

SEQ ID NO: 13576 - protein, 8 aa, BK virus
LNFYSSSS

SEQ ID NO: 13577 - protein, 8 aa, BK virus
NFYSSSSL

SEQ ID NO: 13578 - protein, 8 aa, BK virus
FYSSSSLP

SEQ ID NO: 13579 - protein, 8 aa, BK virus
YSSSSLPS

SEQ ID NO: 13580 - protein, 8 aa, BK virus
SSSSLPSS

SEQ ID NO: 13581 - protein, 8 aa, BK virus
SSSLPSSN

SEQ ID NO: 13582 - protein, 8 aa, BK virus
SSLPSSNF

SEQ ID NO: 13583 - protein, 8 aa, BK virus
SLPSSNFS

SEQ ID NO: 13584 - protein, 8 aa, BK virus
LPSSNFSH

SEQ ID NO: 13585 - protein, 8 aa, BK virus
KSCGSSSL

SEQ ID NO: 13586 - protein, 8 aa, BK virus
SCGSSSLR

SEQ ID NO: 13587 - protein, 8 aa, BK virus
CGSSSLRY

SEQ ID NO: 13588 - protein, 8 aa, BK virus
GSSSLRYT

SEQ ID NO: 13589 - protein, 8 aa, BK virus
SSSLRYTG

SEQ ID NO: 13590 - protein, 8 aa, BK virus
SSLRYTGN

SEQ ID NO: 13591 - protein, 8 aa, BK virus
SSTHEPGN

SEQ ID NO: 13592 - protein, 8 aa, BK virus
STHEPGNT

SEQ ID NO: 13593 - protein, 8 aa, BK virus
THEPGNTK

SEQ ID NO: 13594 - protein, 8 aa, BK virus
HEPGNTKK

SEQ ID NO: 13595 - protein, 8 aa, BK virus
EPGNTKKK

SEQ ID NO: 13596 - protein, 8 aa, BK virus
PGNTKKKG

SEQ ID NO: 13597 - protein, 8 aa, BK virus
GNTKKKGL

SEQ ID NO: 13598 - protein, 8 aa, BK virus
NTKKKGLL

SEQ ID NO: 13599 - protein, 8 aa, BK virus
TKKKGLLT

SEQ ID NO: 13600 - protein, 8 aa, BK virus
ESFTESFT

SEQ ID NO: 13601 - protein, 8 aa, BK virus
SFTESFTA

SEQ ID NO: 13602 - protein, 8 aa, BK virus
FTESFTAG

SEQ ID NO: 13603 - protein, 8 aa, BK virus
TESFTAGK

SEQ ID NO: 13604 - protein, 8 aa, BK virus
ESFTAGKA

SEQ ID NO: 13605 - protein, 8 aa, BK virus
SFTAGKAV

SEQ ID NO: 13606 - protein, 8 aa, BK virus
FTAGKAVV

SEQ ID NO: 13607 - protein, 8 aa, BK virus
TAGKAVVL

SEQ ID NO: 13608 - protein, 8 aa, BK virus
AGKAVVLL

SEQ ID NO: 13609 - protein, 8 aa, BK virus
GKAVVLLF

SEQ ID NO: 13610 - protein, 8 aa, BK virus
KAVVLLFF

SEQ ID NO: 13611 - protein, 8 aa, BK virus
AVVLLFFP

SEQ ID NO: 13612 - protein, 8 aa, BK virus
VVLLFFPS

SEQ ID NO: 13613 - protein, 8 aa, BK virus
VLLFFPST

SEQ ID NO: 13614 - protein, 8 aa, BK virus
LLFFPSTL

SEQ ID NO: 13615 - protein, 8 aa, BK virus
LFFPSTLS

SEQ ID NO: 13616 - protein, 8 aa, BK virus
FFPSTLSS

SEQ ID NO: 13617 - protein, 8 aa, BK virus
FPSTLSSP

SEQ ID NO: 13618 - protein, 8 aa, BK virus
PSTLSSPL

SEQ ID NO: 13619 - protein, 8 aa, BK virus
STLSSPLQ

SEQ ID NO: 13620 - protein, 8 aa, BK virus
TLSSPLQN

SEQ ID NO: 13621 - protein, 8 aa, BK virus
LSSPLQNS

SEQ ID NO: 13622 - protein, 8 aa, BK virus
SSPLQNSS

SEQ ID NO: 13623 - protein, 8 aa, BK virus
SPLQNSSK

SEQ ID NO: 13624 - protein, 8 aa, BK virus
PLQNSSKS

SEQ ID NO: 13625 - protein, 8 aa, BK virus
LQNSSKSS

SEQ ID NO: 13626 - protein, 8 aa, BK virus
QNSSKSSK

SEQ ID NO: 13627 - protein, 8 aa, BK virus
NSSKSSKI

SEQ ID NO: 13628 - protein, 8 aa, BK virus
SSKSSKIK

SEQ ID NO: 13629 - protein, 8 aa, BK virus
SKSSKIKI

SEQ ID NO: 13630 - protein, 8 aa, BK virus
KSSKIKIK

SEQ ID NO: 13631 - protein, 8 aa, BK virus
SSKIKIKI

SEQ ID NO: 13632 - protein, 8 aa, BK virus
SKIKIKIL

SEQ ID NO: 13633 - protein, 8 aa, BK virus
ALFFVPVQ

SEQ ID NO: 13634 - protein, 8 aa, BK virus
LFFVPVQV

SEQ ID NO: 13635 - protein, 8 aa, BK virus
FFVPVQVL

SEQ ID NO: 13636 - protein, 8 aa, BK virus
FVPVQVLP

SEQ ID NO: 13637 - protein, 8 aa, BK virus
VPVQVLPT

SEQ ID NO: 13638 - protein, 8 aa, BK virus
PVQVLPTF

SEQ ID NO: 13639 - protein, 8 aa, BK virus
VQVLPTFT

SEQ ID NO: 13640 - protein, 8 aa, BK virus
QVLPTFTE

SEQ ID NO: 13641 - protein, 8 aa, BK virus
VLPTFTEA

SEQ ID NO: 13642 - protein, 8 aa, BK virus
LPTFTEAC

SEQ ID NO: 13643 - protein, 8 aa, BK virus
PTFTEACR

SEQ ID NO: 13644 - protein, 8 aa, BK virus
TFTEACRD

SEQ ID NO: 13645 - protein, 8 aa, BK virus
FTEACRDS

SEQ ID NO: 13646 - protein, 8 aa, BK virus
TEACRDSW

SEQ ID NO: 13647 - protein, 8 aa, BK virus
EACRDSWR

SEQ ID NO: 13648 - protein, 8 aa, BK virus
ACRDSWRR

SEQ ID NO: 13649 - protein, 8 aa, BK virus
CRDSWRRT

SEQ ID NO: 13650 - protein, 8 aa, BK virus
RDSWRRTM

SEQ ID NO: 13651 - protein, 8 aa, BK virus
DSWRRTMA

SEQ ID NO: 13652 - protein, 8 aa, BK virus
SWRRTMAF

SEQ ID NO: 13653 - protein, 8 aa, BK virus
WRRTMAFV

SEQ ID NO: 13654 - protein, 8 aa, BK virus
RRTMAFVQ

SEQ ID NO: 13655 - protein, 8 aa, BK virus
RTMAFVQF

SEQ ID NO: 13656 - protein, 8 aa, BK virus
TMAFVQFN

SEQ ID NO: 13657 - protein, 8 aa, BK virus
MAFVQFNW

SEQ ID NO: 13658 - protein, 8 aa, BK virus
AFVQFNWG

SEQ ID NO: 13659 - protein, 8 aa, BK virus
FVQFNWGQ

SEQ ID NO: 13660 - protein, 8 aa, BK virus
VQFNWGQG

SEQ ID NO: 13661 - protein, 8 aa, BK virus
QFNWGQGQ

SEQ ID NO: 13662 - protein, 8 aa, BK virus
FNWGQGQD

SEQ ID NO: 13663 - protein, 8 aa, BK virus
NWGQGQDS

SEQ ID NO: 13664 - protein, 8 aa, BK virus
ARKTCLSC

SEQ ID NO: 13665 - protein, 8 aa, BK virus
RKTCLSCT

SEQ ID NO: 13666 - protein, 8 aa, BK virus
KTCLSCTF

SEQ ID NO: 13667 - protein, 8 aa, BK virus
TCLSCTFL

SEQ ID NO: 13668 - protein, 8 aa, BK virus
CLSCTFLP

SEQ ID NO: 13669 - protein, 8 aa, BK virus
LSCTFLPE

SEQ ID NO: 13670 - protein, 8 aa, BK virus
SCTFLPEV

SEQ ID NO: 13671 - protein, 8 aa, BK virus
CTFLPEVM

SEQ ID NO: 13672 - protein, 8 aa, BK virus
TFLPEVMV

SEQ ID NO: 13673 - protein, 8 aa, BK virus
FLPEVMVW

SEQ ID NO: 13674 - protein, 8 aa, BK virus
LPEVMVWL

SEQ ID NO: 13675 - protein, 8 aa, BK virus
PEVMVWLH

SEQ ID NO: 13676 - protein, 8 aa, BK virus
EVMVWLHS

SEQ ID NO: 13677 - protein, 8 aa, BK virus
VMVWLHSM

SEQ ID NO: 13678 - protein, 8 aa, BK virus
MVWLHSMG

SEQ ID NO: 13679 - protein, 8 aa, BK virus
VWLHSMGK

SEQ ID NO: 13680 - protein, 8 aa, BK virus
WLHSMGKQ

SEQ ID NO: 13681 - protein, 8 aa, BK virus
LHSMGKQL

SEQ ID NO: 13682 - protein, 8 aa, BK virus
HSMGKQLL

SEQ ID NO: 13683 - protein, 8 aa, BK virus
SMGKQLLP

SEQ ID NO: 13684 - protein, 8 aa, BK virus
MGKQLLPV

SEQ ID NO: 13685 - protein, 8 aa, BK virus
GKQLLPVS

SEQ ID NO: 13686 - protein, 8 aa, BK virus
KQLLPVSH

SEQ ID NO: 13687 - protein, 8 aa, BK virus
QLLPVSHA

SEQ ID NO: 13688 - protein, 8 aa, BK virus
LLPVSHAL

SEQ ID NO: 13689 - protein, 8 aa, BK virus
LPVSHALS

SEQ ID NO: 13690 - protein, 8 aa, BK virus
PVSHALSF

SEQ ID NO: 13691 - protein, 8 aa, BK virus
VSHALSFL

SEQ ID NO: 13692 - protein, 8 aa, BK virus
SHALSFLR

SEQ ID NO: 13693 - protein, 8 aa, BK virus
HALSFLRS

SEQ ID NO: 13694 - protein, 8 aa, BK virus
ALSFLRSW

SEQ ID NO: 13695 - protein, 8 aa, BK virus
LSFLRSWF

SEQ ID NO: 13696 - protein, 8 aa, BK virus
SFLRSWFG

SEQ ID NO: 13697 - protein, 8 aa, BK virus
FLRSWFGC

SEQ ID NO: 13698 - protein, 8 aa, BK virus
LRSWFGCI

SEQ ID NO: 13699 - protein, 8 aa, BK virus
RSWFGCIP

SEQ ID NO: 13700 - protein, 8 aa, BK virus
SWFGCIPL

SEQ ID NO: 13701 - protein, 8 aa, BK virus
GHGLAAFH

SEQ ID NO: 13702 - protein, 8 aa, BK virus
HGLAAFHG

SEQ ID NO: 13703 - protein, 8 aa, BK virus
AAPPCGLF

SEQ ID NO: 13704 - protein, 8 aa, BK virus
APPCGLFF

SEQ ID NO: 13705 - protein, 8 aa, BK virus
PPCGLFFY

SEQ ID NO: 13706 - protein, 8 aa, BK virus
PCGLFFYN

SEQ ID NO: 13707 - protein, 8 aa, BK virus
CGLFFYNI

SEQ ID NO: 13708 - protein, 8 aa, BK virus
EAEAASAS

SEQ ID NO: 13709 - protein, 8 aa, BK virus
AEAASAST

SEQ ID NO: 13710 - protein, 8 aa, BK virus
EAASASTL

SEQ ID NO: 13711 - protein, 8 aa, BK virus
AASASTLS

SEQ ID NO: 13712 - protein, 8 aa, BK virus
ASASTLSL

SEQ ID NO: 13713 - protein, 8 aa, BK virus
SASTLSLK

SEQ ID NO: 13714 - protein, 8 aa, BK virus
GLAKLFGE

SEQ ID NO: 13715 - protein, 8 aa, BK virus
LAKLFGEI

SEQ ID NO: 13716 - protein, 8 aa, BK virus
AKLFGEIP

SEQ ID NO: 13717 - protein, 8 aa, BK virus
KLFGEIPI

SEQ ID NO: 13718 - protein, 8 aa, BK virus
LFGEIPIL

SEQ ID NO: 13719 - protein, 8 aa, BK virus
FGEIPILL

SEQ ID NO: 13720 - protein, 8 aa, BK virus
GEIPILLQ

SEQ ID NO: 13721 - protein, 8 aa, BK virus
EIPILLQF

SEQ ID NO: 13722 - protein, 8 aa, BK virus
IPILLQFL

SEQ ID NO: 13723 - protein, 8 aa, BK virus
PILLQFLQ

SEQ ID NO: 13724 - protein, 9 aa, BK virus
MDKVLNREE

SEQ ID NO: 13725 - protein, 9 aa, BK virus
DKVLNREES

SEQ ID NO: 13726 - protein, 9 aa, BK virus
KVLNREESM

SEQ ID NO: 13727 - protein, 9 aa, BK virus
VLNREESME

SEQ ID NO: 13728 - protein, 9 aa, BK virus
LNREESMEL

SEQ ID NO: 13729 - protein, 9 aa, BK virus
NREESMELM

SEQ ID NO: 13730 - protein, 9 aa, BK virus
REESMELMD

SEQ ID NO: 13731 - protein, 9 aa, BK virus
EESMELMDL

SEQ ID NO: 13732 - protein, 9 aa, BK virus
ESMELMDLL

SEQ ID NO: 13733 - protein, 9 aa, BK virus
SMELMDLLG

SEQ ID NO: 13734 - protein, 9 aa, BK virus
MELMDLLGL

SEQ ID NO: 13735 - protein, 9 aa, BK virus
ELMDLLGLE

SEQ ID NO: 13736 - protein, 9 aa, BK virus
LMDLLGLER

SEQ ID NO: 13737 - protein, 9 aa, BK virus
MDLLGLERA

SEQ ID NO: 13738 - protein, 9 aa, BK virus
DLLGLERAA

SEQ ID NO: 13739 - protein, 9 aa, BK virus
LLGLERAAW

SEQ ID NO: 13740 - protein, 9 aa, BK virus
LGLERAAWG

SEQ ID NO: 13741 - protein, 9 aa, BK virus
GLERAAWGN

SEQ ID NO: 13742 - protein, 9 aa, BK virus
LERAAWGNL

SEQ ID NO: 13743 - protein, 9 aa, BK virus
ERAAWGNLP

SEQ ID NO: 13744 - protein, 9 aa, BK virus
RAAWGNLPL

SEQ ID NO: 13745 - protein, 9 aa, BK virus
AAWGNLPLM

SEQ ID NO: 13746 - protein, 9 aa, BK virus
AWGNLPLMR

SEQ ID NO: 13747 - protein, 9 aa, BK virus
WGNLPLMRK

SEQ ID NO: 13748 - protein, 9 aa, BK virus
GNLPLMRKA

SEQ ID NO: 13749 - protein, 9 aa, BK virus
NLPLMRKAY

SEQ ID NO: 13750 - protein, 9 aa, BK virus
LPLMRKAYL

SEQ ID NO: 13751 - protein, 9 aa, BK virus
PLMRKAYLR

SEQ ID NO: 13752 - protein, 9 aa, BK virus
LMRKAYLRK

SEQ ID NO: 13753 - protein, 9 aa, BK virus
MRKAYLRKC

SEQ ID NO: 13754 - protein, 9 aa, BK virus
RKAYLRKCK

SEQ ID NO: 13755 - protein, 9 aa, BK virus
KAYLRKCKE

SEQ ID NO: 13756 - protein, 9 aa, BK virus
AYLRKCKEF

SEQ ID NO: 13757 - protein, 9 aa, BK virus
YLRKCKEFH

SEQ ID NO: 13758 - protein, 9 aa, BK virus
LRKCKEFHP

SEQ ID NO: 13759 - protein, 9 aa, BK virus
RKCKEFHPD

SEQ ID NO: 13760 - protein, 9 aa, BK virus
KCKEFHPDK

SEQ ID NO: 13761 - protein, 9 aa, BK virus
CKEFHPDKG

SEQ ID NO: 13762 - protein, 9 aa, BK virus
KEFHPDKGG

SEQ ID NO: 13763 - protein, 9 aa, BK virus
EFHPDKGGD

SEQ ID NO: 13764 - protein, 9 aa, BK virus
FHPDKGGDE

SEQ ID NO: 13765 - protein, 9 aa, BK virus
HPDKGGDED

SEQ ID NO: 13766 - protein, 9 aa, BK virus
PDKGGDEDK

SEQ ID NO: 13767 - protein, 9 aa, BK virus
DKGGDEDKM

SEQ ID NO: 13768 - protein, 9 aa, BK virus
KGGDEDKMK

SEQ ID NO: 13769 - protein, 9 aa, BK virus
GGDEDKMKR

SEQ ID NO: 13770 - protein, 9 aa, BK virus
GDEDKMKRM

SEQ ID NO: 13771 - protein, 9 aa, BK virus
DEDKMKRMN

SEQ ID NO: 13772 - protein, 9 aa, BK virus
EDKMKRMNT

SEQ ID NO: 13773 - protein, 9 aa, BK virus
DKMKRMNTL

SEQ ID NO: 13774 - protein, 9 aa, BK virus
KMKRMNTLY

SEQ ID NO: 13775 - protein, 9 aa, BK virus
MKRMNTLYK

SEQ ID NO: 13776 - protein, 9 aa, BK virus
KRMNTLYKK

SEQ ID NO: 13777 - protein, 9 aa, BK virus
RMNTLYKKM

SEQ ID NO: 13778 - protein, 9 aa, BK virus
MNTLYKKME

SEQ ID NO: 13779 - protein, 9 aa, BK virus
NTLYKKMEQ

SEQ ID NO: 13780 - protein, 9 aa, BK virus
TLYKKMEQD

SEQ ID NO: 13781 - protein, 9 aa, BK virus
LYKKMEQDV

SEQ ID NO: 13782 - protein, 9 aa, BK virus
YKKMEQDVK

SEQ ID NO: 13783 - protein, 9 aa, BK virus
KKMEQDVKV

SEQ ID NO: 13784 - protein, 9 aa, BK virus
KMEQDVKVA

SEQ ID NO: 13785 - protein, 9 aa, BK virus
MEQDVKVAH

SEQ ID NO: 13786 - protein, 9 aa, BK virus
EQDVKVAHQ

SEQ ID NO: 13787 - protein, 9 aa, BK virus
QDVKVAHQP

SEQ ID NO: 13788 - protein, 9 aa, BK virus
DVKVAHQPD

SEQ ID NO: 13789 - protein, 9 aa, BK virus
VKVAHQPDF

SEQ ID NO: 13790 - protein, 9 aa, BK virus
KVAHQPDFG

SEQ ID NO: 13791 - protein, 9 aa, BK virus
VAHQPDFGT

SEQ ID NO: 13792 - protein, 9 aa, BK virus
AHQPDFGTW

SEQ ID NO: 13793 - protein, 9 aa, BK virus
HQPDFGTWS

SEQ ID NO: 13794 - protein, 9 aa, BK virus
QPDFGTWSS

SEQ ID NO: 13795 - protein, 9 aa, BK virus
PDFGTWSSS

SEQ ID NO: 13796 - protein, 9 aa, BK virus
DFGTWSSSE

SEQ ID NO: 13797 - protein, 9 aa, BK virus
FGTWSSSEV

SEQ ID NO: 13798 - protein, 9 aa, BK virus
GTWSSSEVC

SEQ ID NO: 13799 - protein, 9 aa, BK virus
TWSSSEVCA

SEQ ID NO: 13800 - protein, 9 aa, BK virus
WSSSEVCAD

SEQ ID NO: 13801 - protein, 9 aa, BK virus
SSSEVCADF

SEQ ID NO: 13802 - protein, 9 aa, BK virus
SSEVCADFP

SEQ ID NO: 13803 - protein, 9 aa, BK virus
SEVCADFPL

SEQ ID NO: 13804 - protein, 9 aa, BK virus
EVCADFPLC

SEQ ID NO: 13805 - protein, 9 aa, BK virus
VCADFPLCP

SEQ ID NO: 13806 - protein, 9 aa, BK virus
CADFPLCPD

SEQ ID NO: 13807 - protein, 9 aa, BK virus
ADFPLCPDT

SEQ ID NO: 13808 - protein, 9 aa, BK virus
DFPLCPDTL

SEQ ID NO: 13809 - protein, 9 aa, BK virus
FPLCPDTLY

SEQ ID NO: 13810 - protein, 9 aa, BK virus
PLCPDTLYC

SEQ ID NO: 13811 - protein, 9 aa, BK virus
LCPDTLYCK

SEQ ID NO: 13812 - protein, 9 aa, BK virus
CPDTLYCKE

SEQ ID NO: 13813 - protein, 9 aa, BK virus
PDTLYCKEW

SEQ ID NO: 13814 - protein, 9 aa, BK virus
DTLYCKEWP

SEQ ID NO: 13815 - protein, 9 aa, BK virus
TLYCKEWPI

SEQ ID NO: 13816 - protein, 9 aa, BK virus
LYCKEWPIC

SEQ ID NO: 13817 - protein, 9 aa, BK virus
YCKEWPICS

SEQ ID NO: 13818 - protein, 9 aa, BK virus
CKEWPICSK

SEQ ID NO: 13819 - protein, 9 aa, BK virus
KEWPICSKK

SEQ ID NO: 13820 - protein, 9 aa, BK virus
EWPICSKKP

SEQ ID NO: 13821 - protein, 9 aa, BK virus
WPICSKKPS

SEQ ID NO: 13822 - protein, 9 aa, BK virus
PICSKKPSV

SEQ ID NO: 13823 - protein, 9 aa, BK virus
ICSKKPSVH

SEQ ID NO: 13824 - protein, 9 aa, BK virus
CSKKPSVHC

SEQ ID NO: 13825 - protein, 9 aa, BK virus
SKKPSVHCP

SEQ ID NO: 13826 - protein, 9 aa, BK virus
KKPSVHCPC

SEQ ID NO: 13827 - protein, 9 aa, BK virus
KPSVHCPCM

SEQ ID NO: 13828 - protein, 9 aa, BK virus
PSVHCPCML

SEQ ID NO: 13829 - protein, 9 aa, BK virus
SVHCPCMLC

SEQ ID NO: 13830 - protein, 9 aa, BK virus
VHCPCMLCQ

SEQ ID NO: 13831 - protein, 9 aa, BK virus
HCPCMLCQL

SEQ ID NO: 13832 - protein, 9 aa, BK virus
CPCMLCQLR

SEQ ID NO: 13833 - protein, 9 aa, BK virus
PCMLCQLRL

SEQ ID NO: 13834 - protein, 9 aa, BK virus
CMLCQLRLR

SEQ ID NO: 13835 - protein, 9 aa, BK virus
MLCQLRLRH

SEQ ID NO: 13836 - protein, 9 aa, BK virus
LCQLRLRHL

SEQ ID NO: 13837 - protein, 9 aa, BK virus
CQLRLRHLN

SEQ ID NO: 13838 - protein, 9 aa, BK virus
QLRLRHLNR

SEQ ID NO: 13839 - protein, 9 aa, BK virus
LRLRHLNRK

SEQ ID NO: 13840 - protein, 9 aa, BK virus
RLRHLNRKF

SEQ ID NO: 13841 - protein, 9 aa, BK virus
LRHLNRKFL

SEQ ID NO: 13842 - protein, 9 aa, BK virus
RHLNRKFLR

SEQ ID NO: 13843 - protein, 9 aa, BK virus
HLNRKFLRK

SEQ ID NO: 13844 - protein, 9 aa, BK virus
LNRKFLRKE

SEQ ID NO: 13845 - protein, 9 aa, BK virus
NRKFLRKEP

SEQ ID NO: 13846 - protein, 9 aa, BK virus
RKFLRKEPL

SEQ ID NO: 13847 - protein, 9 aa, BK virus
KFLRKEPLV

SEQ ID NO: 13848 - protein, 9 aa, BK virus
FLRKEPLVW

SEQ ID NO: 13849 - protein, 9 aa, BK virus
LRKEPLVWI

SEQ ID NO: 13850 - protein, 9 aa, BK virus
RKEPLVWID

SEQ ID NO: 13851 - protein, 9 aa, BK virus
KEPLVWIDC

SEQ ID NO: 13852 - protein, 9 aa, BK virus
EPLVWIDCY

SEQ ID NO: 13853 - protein, 9 aa, BK virus
PLVWIDCYC

SEQ ID NO: 13854 - protein, 9 aa, BK virus
LVWIDCYCI

SEQ ID NO: 13855 - protein, 9 aa, BK virus
VWIDCYCID

SEQ ID NO: 13856 - protein, 9 aa, BK virus
WIDCYCIDC

SEQ ID NO: 13857 - protein, 9 aa, BK virus
IDCYCIDCF

SEQ ID NO: 13858 - protein, 9 aa, BK virus
DCYCIDCFT

SEQ ID NO: 13859 - protein, 9 aa, BK virus
CYCIDCFTQ

SEQ ID NO: 13860 - protein, 9 aa, BK virus
YCIDCFTQW

SEQ ID NO: 13861 - protein, 9 aa, BK virus
CIDCFTQWF

SEQ ID NO: 13862 - protein, 9 aa, BK virus
IDCFTQWFG

SEQ ID NO: 13863 - protein, 9 aa, BK virus
DCFTQWFGL

SEQ ID NO: 13864 - protein, 9 aa, BK virus
CFTQWFGLD

SEQ ID NO: 13865 - protein, 9 aa, BK virus
FTQWFGLDL

SEQ ID NO: 13866 - protein, 9 aa, BK virus
TQWFGLDLT

SEQ ID NO: 13867 - protein, 9 aa, BK virus
QWFGLDLTE

SEQ ID NO: 13868 - protein, 9 aa, BK virus
WFGLDLTEE

SEQ ID NO: 13869 - protein, 9 aa, BK virus
FGLDLTEET

SEQ ID NO: 13870 - protein, 9 aa, BK virus
GLDLTEETL

SEQ ID NO: 13871 - protein, 9 aa, BK virus
LDLTEETLQ

SEQ ID NO: 13872 - protein, 9 aa, BK virus
DLTEETLQW

SEQ ID NO: 13873 - protein, 9 aa, BK virus
LTEETLQWW

SEQ ID NO: 13874 - protein, 9 aa, BK virus
TEETLQWWV

SEQ ID NO: 13875 - protein, 9 aa, BK virus
EETLQWWVQ

SEQ ID NO: 13876 - protein, 9 aa, BK virus
ETLQWWVQI

SEQ ID NO: 13877 - protein, 9 aa, BK virus
TLQWWVQII

SEQ ID NO: 13878 - protein, 9 aa, BK virus
LQWWVQIIG

SEQ ID NO: 13879 - protein, 9 aa, BK virus
QWWVQIIGE

SEQ ID NO: 13880 - protein, 9 aa, BK virus
WWVQIIGET

SEQ ID NO: 13881 - protein, 9 aa, BK virus
WVQIIGETP

SEQ ID NO: 13882 - protein, 9 aa, BK virus
VQIIGETPF

SEQ ID NO: 13883 - protein, 9 aa, BK virus
QIIGETPFR

SEQ ID NO: 13884 - protein, 9 aa, BK virus
IIGETPFRD

SEQ ID NO: 13885 - protein, 9 aa, BK virus
IGETPFRDL

SEQ ID NO: 13886 - protein, 9 aa, BK virus
GETPFRDLK

SEQ ID NO: 13887 - protein, 9 aa, BK virus
ETPFRDLKL

SEQ ID NO: 13888 - protein, 9 aa, BK virus
KALSNYFFY

SEQ ID NO: 13889 - protein, 9 aa, BK virus
ALSNYFFYR

SEQ ID NO: 13890 - protein, 9 aa, BK virus
LSNYFFYRC

SEQ ID NO: 13891 - protein, 9 aa, BK virus
SNYFFYRCQ

SEQ ID NO: 13892 - protein, 9 aa, BK virus
NYFFYRCQP

SEQ ID NO: 13893 - protein, 9 aa, BK virus
YFFYRCQPM

SEQ ID NO: 13894 - protein, 9 aa, BK virus
FFYRCQPME

SEQ ID NO: 13895 - protein, 9 aa, BK virus
FYRCQPMEQ

SEQ ID NO: 13896 - protein, 9 aa, BK virus
YRCQPMEQK

SEQ ID NO: 13897 - protein, 9 aa, BK virus
RCQPMEQKS

SEQ ID NO: 13898 - protein, 9 aa, BK virus
CQPMEQKSG

SEQ ID NO: 13899 - protein, 9 aa, BK virus
QPMEQKSGS

SEQ ID NO: 13900 - protein, 9 aa, BK virus
PMEQKSGSP

SEQ ID NO: 13901 - protein, 9 aa, BK virus
MEQKSGSPG

SEQ ID NO: 13902 - protein, 9 aa, BK virus
EQKSGSPGG

SEQ ID NO: 13903 - protein, 9 aa, BK virus
QKSGSPGGV

SEQ ID NO: 13904 - protein, 9 aa, BK virus
KSGSPGGVP

SEQ ID NO: 13905 - protein, 9 aa, BK virus
SGSPGGVPL

SEQ ID NO: 13906 - protein, 9 aa, BK virus
GSPGGVPLM

SEQ ID NO: 13907 - protein, 9 aa, BK virus
SPGGVPLMK

SEQ ID NO: 13908 - protein, 9 aa, BK virus
PGGVPLMKN

SEQ ID NO: 13909 - protein, 9 aa, BK virus
GGVPLMKNG

SEQ ID NO: 13910 - protein, 9 aa, BK virus
GVPLMKNGM

SEQ ID NO: 13911 - protein, 9 aa, BK virus
VPLMKNGMK

SEQ ID NO: 13912 - protein, 9 aa, BK virus
PLMKNGMKI

SEQ ID NO: 13913 - protein, 9 aa, BK virus
LMKNGMKIY

SEQ ID NO: 13914 - protein, 9 aa, BK virus
MKNGMKIYF

SEQ ID NO: 13915 - protein, 9 aa, BK virus
KNGMKIYFA

SEQ ID NO: 13916 - protein, 9 aa, BK virus
NGMKIYFAM

SEQ ID NO: 13917 - protein, 9 aa, BK virus
GMKIYFAMK

SEQ ID NO: 13918 - protein, 9 aa, BK virus
MKIYFAMKI

SEQ ID NO: 13919 - protein, 9 aa, BK virus
KIYFAMKIC

SEQ ID NO: 13920 - protein, 9 aa, BK virus
IYFAMKICL

SEQ ID NO: 13921 - protein, 9 aa, BK virus
YFAMKICLP

SEQ ID NO: 13922 - protein, 9 aa, BK virus
FAMKICLPV

SEQ ID NO: 13923 - protein, 9 aa, BK virus
AMKICLPVM

SEQ ID NO: 13924 - protein, 9 aa, BK virus
MKICLPVMK

SEQ ID NO: 13925 - protein, 9 aa, BK virus
KICLPVMKK

SEQ ID NO: 13926 - protein, 9 aa, BK virus
ICLPVMKKQ

SEQ ID NO: 13927 - protein, 9 aa, BK virus
CLPVMKKQQ

SEQ ID NO: 13928 - protein, 9 aa, BK virus
LPVMKKQQQ

SEQ ID NO: 13929 - protein, 9 aa, BK virus
PVMKKQQQI

SEQ ID NO: 13930 - protein, 9 aa, BK virus
VMKKQQQIL

SEQ ID NO: 13931 - protein, 9 aa, BK virus
MKKQQQILN

SEQ ID NO: 13932 - protein, 9 aa, BK virus
KKQQQILNT

SEQ ID NO: 13933 - protein, 9 aa, BK virus
KQQQILNTQ

SEQ ID NO: 13934 - protein, 9 aa, BK virus
QQQILNTQH

SEQ ID NO: 13935 - protein, 9 aa, BK virus
QQILNTQHH

SEQ ID NO: 13936 - protein, 9 aa, BK virus
QILNTQHHP

SEQ ID NO: 13937 - protein, 9 aa, BK virus
ILNTQHHPK

SEQ ID NO: 13938 - protein, 9 aa, BK virus
LNTQHHPKK

SEQ ID NO: 13939 - protein, 9 aa, BK virus
NTQHHPKKK

SEQ ID NO: 13940 - protein, 9 aa, BK virus
TQHHPKKKE

SEQ ID NO: 13941 - protein, 9 aa, BK virus
QHHPKKKER

SEQ ID NO: 13942 - protein, 9 aa, BK virus
KTLKTFPLI

SEQ ID NO: 13943 - protein, 9 aa, BK virus
TLKTFPLIY

SEQ ID NO: 13944 - protein, 9 aa, BK virus
LKTFPLIYT

SEQ ID NO: 13945 - protein, 9 aa, BK virus
KTFPLIYTS

SEQ ID NO: 13946 - protein, 9 aa, BK virus
TFPLIYTSF

SEQ ID NO: 13947 - protein, 9 aa, BK virus
FPLIYTSFL

SEQ ID NO: 13948 - protein, 9 aa, BK virus
PLIYTSFLV

SEQ ID NO: 13949 - protein, 9 aa, BK virus
LIYTSFLVK

SEQ ID NO: 13950 - protein, 9 aa, BK virus
IYTSFLVKL

SEQ ID NO: 13951 - protein, 9 aa, BK virus
YTSFLVKLY

SEQ ID NO: 13952 - protein, 9 aa, BK virus
TSFLVKLYL

SEQ ID NO: 13953 - protein, 9 aa, BK virus
SFLVKLYLV

SEQ ID NO: 13954 - protein, 9 aa, BK virus
FLVKLYLVI

SEQ ID NO: 13955 - protein, 9 aa, BK virus
LVKLYLVIE

SEQ ID NO: 13956 - protein, 9 aa, BK virus
VKLYLVIEP

SEQ ID NO: 13957 - protein, 9 aa, BK virus
KLYLVIEPL

SEQ ID NO: 13958 - protein, 9 aa, BK virus
LYLVIEPLP

SEQ ID NO: 13959 - protein, 9 aa, BK virus
YLVIEPLPA

SEQ ID NO: 13960 - protein, 9 aa, BK virus
LVIEPLPAL

SEQ ID NO: 13961 - protein, 9 aa, BK virus
VIEPLPALL

SEQ ID NO: 13962 - protein, 9 aa, BK virus
IEPLPALLC

SEQ ID NO: 13963 - protein, 9 aa, BK virus
EPLPALLCI

SEQ ID NO: 13964 - protein, 9 aa, BK virus
PLPALLCIL

SEQ ID NO: 13965 - protein, 9 aa, BK virus
LPALLCILL

SEQ ID NO: 13966 - protein, 9 aa, BK virus
PALLCILLK

SEQ ID NO: 13967 - protein, 9 aa, BK virus
ALLCILLKK

SEQ ID NO: 13968 - protein, 9 aa, BK virus
LLCILLKKK

SEQ ID NO: 13969 - protein, 9 aa, BK virus
LCILLKKKL

SEQ ID NO: 13970 - protein, 9 aa, BK virus
CILLKKKLK

SEQ ID NO: 13971 - protein, 9 aa, BK virus
ILLKKKLKF

SEQ ID NO: 13972 - protein, 9 aa, BK virus
LLKKKLKFC

SEQ ID NO: 13973 - protein, 9 aa, BK virus
LKKKLKFCI

SEQ ID NO: 13974 - protein, 9 aa, BK virus
KKKLKFCIK

SEQ ID NO: 13975 - protein, 9 aa, BK virus
KKLKFCIKN

SEQ ID NO: 13976 - protein, 9 aa, BK virus
KLKFCIKNL

SEQ ID NO: 13977 - protein, 9 aa, BK virus
LKFCIKNLW

SEQ ID NO: 13978 - protein, 9 aa, BK virus
KFCIKNLWK

SEQ ID NO: 13979 - protein, 9 aa, BK virus
FCIKNLWKN

SEQ ID NO: 13980 - protein, 9 aa, BK virus
CIKNLWKNI

SEQ ID NO: 13981 - protein, 9 aa, BK virus
IKNLWKNIL

SEQ ID NO: 13982 - protein, 9 aa, BK virus
LLLVDTCVL

SEQ ID NO: 13983 - protein, 9 aa, BK virus
LLVDTCVLG

SEQ ID NO: 13984 - protein, 9 aa, BK virus
LVDTCVLGI

SEQ ID NO: 13985 - protein, 9 aa, BK virus
VDTCVLGII

SEQ ID NO: 13986 - protein, 9 aa, BK virus
DTCVLGIIL

SEQ ID NO: 13987 - protein, 9 aa, BK virus
TCVLGIILY

SEQ ID NO: 13988 - protein, 9 aa, BK virus
CVLGIILYS

SEQ ID NO: 13989 - protein, 9 aa, BK virus
VLGIILYSF

SEQ ID NO: 13990 - protein, 9 aa, BK virus
LHIDIEFLQ

SEQ ID NO: 13991 - protein, 9 aa, BK virus
HIDIEFLQL

SEQ ID NO: 13992 - protein, 9 aa, BK virus
IDIEFLQLI

SEQ ID NO: 13993 - protein, 9 aa, BK virus
DIEFLQLII

SEQ ID NO: 13994 - protein, 9 aa, BK virus
IEFLQLIIS

SEQ ID NO: 13995 - protein, 9 aa, BK virus
EFLQLIISV

SEQ ID NO: 13996 - protein, 9 aa, BK virus
FLQLIISVK

SEQ ID NO: 13997 - protein, 9 aa, BK virus
LQLIISVKS

SEQ ID NO: 13998 - protein, 9 aa, BK virus
QLIISVKSC

SEQ ID NO: 13999 - protein, 9 aa, BK virus
LIISVKSCV

SEQ ID NO: 14000 - protein, 9 aa, BK virus
IISVKSCVP

SEQ ID NO: 14001 - protein, 9 aa, BK virus
ISVKSCVPL

SEQ ID NO: 14002 - protein, 9 aa, BK virus
SVKSCVPLV

SEQ ID NO: 14003 - protein, 9 aa, BK virus
VKSCVPLVF

SEQ ID NO: 14004 - protein, 9 aa, BK virus
FVRVLIRNT

SEQ ID NO: 14005 - protein, 9 aa, BK virus
VRVLIRNTY

SEQ ID NO: 14006 - protein, 9 aa, BK virus
RVLIRNTYY

SEQ ID NO: 14007 - protein, 9 aa, BK virus
VLIRNTYYI

SEQ ID NO: 14008 - protein, 9 aa, BK virus
LIRNTYYIV

SEQ ID NO: 14009 - protein, 9 aa, BK virus
IRNTYYIVP

SEQ ID NO: 14010 - protein, 9 aa, BK virus
RSMILAQKS

SEQ ID NO: 14011 - protein, 9 aa, BK virus
SMILAQKSL

SEQ ID NO: 14012 - protein, 9 aa, BK virus
MILAQKSLK

SEQ ID NO: 14013 - protein, 9 aa, BK virus
ILAQKSLKK

SEQ ID NO: 14014 - protein, 9 aa, BK virus
LAQKSLKKQ

SEQ ID NO: 14015 - protein, 9 aa, BK virus
AQKSLKKQS

SEQ ID NO: 14016 - protein, 9 aa, BK virus
QKSLKKQSR

SEQ ID NO: 14017 - protein, 9 aa, BK virus
KSLKKQSRC

SEQ ID NO: 14018 - protein, 9 aa, BK virus
SLKKQSRCL

SEQ ID NO: 14019 - protein, 9 aa, BK virus
LKKQSRCLG

SEQ ID NO: 14020 - protein, 9 aa, BK virus
KKQSRCLGN

SEQ ID NO: 14021 - protein, 9 aa, BK virus
RQSVRMCFY

SEQ ID NO: 14022 - protein, 9 aa, BK virus
QSVRMCFYY

SEQ ID NO: 14023 - protein, 9 aa, BK virus
RSVKSVRKK

SEQ ID NO: 14024 - protein, 9 aa, BK virus
SVKSVRKKT

SEQ ID NO: 14025 - protein, 9 aa, BK virus
VKSVRKKTS

SEQ ID NO: 14026 - protein, 9 aa, BK virus
KSVRKKTSL

SEQ ID NO: 14027 - protein, 9 aa, BK virus
SVRKKTSLI

SEQ ID NO: 14028 - protein, 9 aa, BK virus
VRKKTSLIT

SEQ ID NO: 14029 - protein, 9 aa, BK virus
RKKTSLITL

SEQ ID NO: 14030 - protein, 9 aa, BK virus
KKTSLITLS

SEQ ID NO: 14031 - protein, 9 aa, BK virus
KTSLITLSI

SEQ ID NO: 14032 - protein, 9 aa, BK virus
TSLITLSIM

SEQ ID NO: 14033 - protein, 9 aa, BK virus
SLITLSIMK

SEQ ID NO: 14034 - protein, 9 aa, BK virus
LITLSIMKS

SEQ ID NO: 14035 - protein, 9 aa, BK virus
ITLSIMKST

SEQ ID NO: 14036 - protein, 9 aa, BK virus
TLSIMKSTL

SEQ ID NO: 14037 - protein, 9 aa, BK virus
LSIMKSTLQ

SEQ ID NO: 14038 - protein, 9 aa, BK virus
SIMKSTLQM

SEQ ID NO: 14039 - protein, 9 aa, BK virus
IMKSTLQML

SEQ ID NO: 14040 - protein, 9 aa, BK virus
MKSTLQMLL

SEQ ID NO: 14041 - protein, 9 aa, BK virus
KSTLQMLLF

SEQ ID NO: 14042 - protein, 9 aa, BK virus
STLQMLLFL

SEQ ID NO: 14043 - protein, 9 aa, BK virus
TLQMLLFLQ

SEQ ID NO: 14044 - protein, 9 aa, BK virus
LQMLLFLQK

SEQ ID NO: 14045 - protein, 9 aa, BK virus
QMLLFLQKV

SEQ ID NO: 14046 - protein, 9 aa, BK virus
MLLFLQKVK

SEQ ID NO: 14047 - protein, 9 aa, BK virus
LLFLQKVKI

SEQ ID NO: 14048 - protein, 9 aa, BK virus
LFLQKVKIK

SEQ ID NO: 14049 - protein, 9 aa, BK virus
FLQKVKIKK

SEQ ID NO: 14050 - protein, 9 aa, BK virus
LQKVKIKKV

SEQ ID NO: 14051 - protein, 9 aa, BK virus
QKVKIKKVF

SEQ ID NO: 14052 - protein, 9 aa, BK virus
KVKIKKVFV

SEQ ID NO: 14053 - protein, 9 aa, BK virus
VKIKKVFVS

SEQ ID NO: 14054 - protein, 9 aa, BK virus
KIKKVFVSK

SEQ ID NO: 14055 - protein, 9 aa, BK virus
IKKVFVSKQ

SEQ ID NO: 14056 - protein, 9 aa, BK virus
YLELMEMLY

SEQ ID NO: 14057 - protein, 9 aa, BK virus
NNIWQVLLG

SEQ ID NO: 14058 - protein, 9 aa, BK virus
NIWQVLLGC

SEQ ID NO: 14059 - protein, 9 aa, BK virus
IWQVLLGCT

SEQ ID NO: 14060 - protein, 9 aa, BK virus
WQVLLGCTV

SEQ ID NO: 14061 - protein, 9 aa, BK virus
QVLLGCTVC

SEQ ID NO: 14062 - protein, 9 aa, BK virus
VLLGCTVCY

SEQ ID NO: 14063 - protein, 9 aa, BK virus
LLGCTVCYL

SEQ ID NO: 14064 - protein, 9 aa, BK virus
LGCTVCYLK

SEQ ID NO: 14065 - protein, 9 aa, BK virus
GCTVCYLKW

SEQ ID NO: 14066 - protein, 9 aa, BK virus
CTVCYLKWI

SEQ ID NO: 14067 - protein, 9 aa, BK virus
TVCYLKWIL

SEQ ID NO: 14068 - protein, 9 aa, BK virus
YLIFCTVLF

SEQ ID NO: 14069 - protein, 9 aa, BK virus
LIFCTVLFS

SEQ ID NO: 14070 - protein, 9 aa, BK virus
IFCTVLFSM

SEQ ID NO: 14071 - protein, 9 aa, BK virus
FCTVLFSMY

SEQ ID NO: 14072 - protein, 9 aa, BK virus
CTVLFSMYL

SEQ ID NO: 14073 - protein, 9 aa, BK virus
TVLFSMYLK

SEQ ID NO: 14074 - protein, 9 aa, BK virus
VLFSMYLKE

SEQ ID NO: 14075 - protein, 9 aa, BK virus
LFSMYLKED

SEQ ID NO: 14076 - protein, 9 aa, BK virus
FSMYLKEDT

SEQ ID NO: 14077 - protein, 9 aa, BK virus
SMYLKEDTG

SEQ ID NO: 14078 - protein, 9 aa, BK virus
MYLKEDTGY

SEQ ID NO: 14079 - protein, 9 aa, BK virus
YLKEDTGYL

SEQ ID NO: 14080 - protein, 9 aa, BK virus
LKEDTGYLK

SEQ ID NO: 14081 - protein, 9 aa, BK virus
KEDTGYLKV

SEQ ID NO: 14082 - protein, 9 aa, BK virus
EDTGYLKVP

SEQ ID NO: 14083 - protein, 9 aa, BK virus
DTGYLKVPL

SEQ ID NO: 14084 - protein, 9 aa, BK virus
TGYLKVPLI

SEQ ID NO: 14085 - protein, 9 aa, BK virus
GYLKVPLIV

SEQ ID NO: 14086 - protein, 9 aa, BK virus
YLKVPLIVE

SEQ ID NO: 14087 - protein, 9 aa, BK virus
LKVPLIVEK

SEQ ID NO: 14088 - protein, 9 aa, BK virus
KVPLIVEKQ

SEQ ID NO: 14089 - protein, 9 aa, BK virus
VPLIVEKQH

SEQ ID NO: 14090 - protein, 9 aa, BK virus
ISTWLFLKM

SEQ ID NO: 14091 - protein, 9 aa, BK virus
KGQELNQRI

SEQ ID NO: 14092 - protein, 9 aa, BK virus
GQELNQRIC

SEQ ID NO: 14093 - protein, 9 aa, BK virus
QELNQRICL

SEQ ID NO: 14094 - protein, 9 aa, BK virus
ELNQRICLQ

SEQ ID NO: 14095 - protein, 9 aa, BK virus
LNQRICLQD

SEQ ID NO: 14096 - protein, 9 aa, BK virus
NQRICLQDM

SEQ ID NO: 14097 - protein, 9 aa, BK virus
QRICLQDME

SEQ ID NO: 14098 - protein, 9 aa, BK virus
TKEPKYFHQ

SEQ ID NO: 14099 - protein, 9 aa, BK virus
KEPKYFHQA

SEQ ID NO: 14100 - protein, 9 aa, BK virus
EPKYFHQAW

SEQ ID NO: 14101 - protein, 9 aa, BK virus
PKYFHQAWL

SEQ ID NO: 14102 - protein, 9 aa, BK virus
KYFHQAWLQ

SEQ ID NO: 14103 - protein, 9 aa, BK virus
MSILSLKPC

SEQ ID NO: 14104 - protein, 9 aa, BK virus
SILSLKPCK

SEQ ID NO: 14105 - protein, 9 aa, BK virus
ILSLKPCKL

SEQ ID NO: 14106 - protein, 9 aa, BK virus
LSLKPCKLD

SEQ ID NO: 14107 - protein, 9 aa, BK virus
SLKPCKLDL

SEQ ID NO: 14108 - protein, 9 aa, BK virus
ENPYKTQSS

SEQ ID NO: 14109 - protein, 9 aa, BK virus
NPYKTQSSY

SEQ ID NO: 14110 - protein, 9 aa, BK virus
PYKTQSSYL

SEQ ID NO: 14111 - protein, 9 aa, BK virus
YKTQSSYLK

SEQ ID NO: 14112 - protein, 9 aa, BK virus
KTQSSYLKK

SEQ ID NO: 14113 - protein, 9 aa, BK virus
TQSSYLKKE

SEQ ID NO: 14114 - protein, 9 aa, BK virus
QSSYLKKEF

SEQ ID NO: 14115 - protein, 9 aa, BK virus
SSYLKKEFY

SEQ ID NO: 14116 - protein, 9 aa, BK virus
SYLKKEFYK

SEQ ID NO: 14117 - protein, 9 aa, BK virus
YLKKEFYKV

SEQ ID NO: 14118 - protein, 9 aa, BK virus
LKKEFYKVE

SEQ ID NO: 14119 - protein, 9 aa, BK virus
LILQLIYNL

SEQ ID NO: 14120 - protein, 9 aa, BK virus
ILQLIYNLE

SEQ ID NO: 14121 - protein, 9 aa, BK virus
LQLIYNLEL

SEQ ID NO: 14122 - protein, 9 aa, BK virus
QLIYNLELL

SEQ ID NO: 14123 - protein, 9 aa, BK virus
LIYNLELLN

SEQ ID NO: 14124 - protein, 9 aa, BK virus
IYNLELLNG

SEQ ID NO: 14125 - protein, 9 aa, BK virus
YNLELLNGR

SEQ ID NO: 14126 - protein, 9 aa, BK virus
NLELLNGRK

SEQ ID NO: 14127 - protein, 9 aa, BK virus
LELLNGRKG

SEQ ID NO: 14128 - protein, 9 aa, BK virus
ELLNGRKGW

SEQ ID NO: 14129 - protein, 9 aa, BK virus
LLNGRKGWI

SEQ ID NO: 14130 - protein, 9 aa, BK virus
LNGRKGWIL

SEQ ID NO: 14131 - protein, 9 aa, BK virus
NGRKGWILR

SEQ ID NO: 14132 - protein, 9 aa, BK virus
NIIYAWGNV

SEQ ID NO: 14133 - protein, 9 aa, BK virus
IIYAWGNVF

SEQ ID NO: 14134 - protein, 9 aa, BK virus
IYAWGNVFL

SEQ ID NO: 14135 - protein, 9 aa, BK virus
YAWGNVFLI

SEQ ID NO: 14136 - protein, 9 aa, BK virus
AWGNVFLIL

SEQ ID NO: 14137 - protein, 9 aa, BK virus
WGNVFLILQ

SEQ ID NO: 14138 - protein, 9 aa, BK virus
GNVFLILQE

SEQ ID NO: 14139 - protein, 9 aa, BK virus
NVFLILQEK

SEQ ID NO: 14140 - protein, 9 aa, BK virus
VFLILQEKR

SEQ ID NO: 14141 - protein, 9 aa, BK virus
FLILQEKRI

SEQ ID NO: 14142 - protein, 9 aa, BK virus
LILQEKRIQ

SEQ ID NO: 14143 - protein, 9 aa, BK virus
ILQEKRIQK

SEQ ID NO: 14144 - protein, 9 aa, BK virus
LQEKRIQKL

SEQ ID NO: 14145 - protein, 9 aa, BK virus
QEKRIQKLK

SEQ ID NO: 14146 - protein, 9 aa, BK virus
EKRIQKLKT

SEQ ID NO: 14147 - protein, 9 aa, BK virus
KRIQKLKTL

SEQ ID NO: 14148 - protein, 9 aa, BK virus
RIQKLKTLD

SEQ ID NO: 14149 - protein, 9 aa, BK virus
IQKLKTLDM

SEQ ID NO: 14150 - protein, 9 aa, BK virus
QKLKTLDMD

SEQ ID NO: 14151 - protein, 9 aa, BK virus
KLKTLDMDQ

SEQ ID NO: 14152 - protein, 9 aa, BK virus
LKTLDMDQA

SEQ ID NO: 14153 - protein, 9 aa, BK virus
KTLDMDQAL

SEQ ID NO: 14154 - protein, 9 aa, BK virus
TLDMDQALN

SEQ ID NO: 14155 - protein, 9 aa, BK virus
LDMDQALNP

SEQ ID NO: 14156 - protein, 9 aa, BK virus
DMDQALNPN

SEQ ID NO: 14157 - protein, 9 aa, BK virus
MDQALNPNH

SEQ ID NO: 14158 - protein, 9 aa, BK virus
DQALNPNHN

SEQ ID NO: 14159 - protein, 9 aa, BK virus
QALNPNHNA

SEQ ID NO: 14160 - protein, 9 aa, BK virus
ALNPNHNAL

SEQ ID NO: 14161 - protein, 9 aa, BK virus
LNPNHNALP

SEQ ID NO: 14162 - protein, 9 aa, BK virus
NPNHNALPK

SEQ ID NO: 14163 - protein, 9 aa, BK virus
PNHNALPKS

SEQ ID NO: 14164 - protein, 9 aa, BK virus
NHNALPKSQ

SEQ ID NO: 14165 - protein, 9 aa, BK virus
HNALPKSQI

SEQ ID NO: 14166 - protein, 9 aa, BK virus
NALPKSQIL

SEQ ID NO: 14167 - protein, 9 aa, BK virus
ALPKSQILQ

SEQ ID NO: 14168 - protein, 9 aa, BK virus
LPKSQILQP

SEQ ID NO: 14169 - protein, 9 aa, BK virus
PKSQILQPL

SEQ ID NO: 14170 - protein, 9 aa, BK virus
KSQILQPLL

SEQ ID NO: 14171 - protein, 9 aa, BK virus
SQILQPLLK

SEQ ID NO: 14172 - protein, 9 aa, BK virus
QILQPLLKI

SEQ ID NO: 14173 - protein, 9 aa, BK virus
ILQPLLKIP

SEQ ID NO: 14174 - protein, 9 aa, BK virus
LQPLLKIPK

SEQ ID NO: 14175 - protein, 9 aa, BK virus
QPLLKIPKG

SEQ ID NO: 14176 - protein, 9 aa, BK virus
PLLKIPKGQ

SEQ ID NO: 14177 - protein, 9 aa, BK virus
LLKIPKGQT

SEQ ID NO: 14178 - protein, 9 aa, BK virus
LKIPKGQTP

SEQ ID NO: 14179 - protein, 9 aa, BK virus
KIPKGQTPI

SEQ ID NO: 14180 - protein, 9 aa, BK virus
IPKGQTPIV

SEQ ID NO: 14181 - protein, 9 aa, BK virus
PKGQTPIVK

SEQ ID NO: 14182 - protein, 9 aa, BK virus
KGQTPIVKS

SEQ ID NO: 14183 - protein, 9 aa, BK virus
GQTPIVKSC

SEQ ID NO: 14184 - protein, 9 aa, BK virus
QTPIVKSCI

SEQ ID NO: 14185 - protein, 9 aa, BK virus
TPIVKSCIC

SEQ ID NO: 14186 - protein, 9 aa, BK virus
PIVKSCICV

SEQ ID NO: 14187 - protein, 9 aa, BK virus
IVKSCICVK

SEQ ID NO: 14188 - protein, 9 aa, BK virus
VKSCICVKA

SEQ ID NO: 14189 - protein, 9 aa, BK virus
KSCICVKAF

SEQ ID NO: 14190 - protein, 9 aa, BK virus
SCICVKAFS

SEQ ID NO: 14191 - protein, 9 aa, BK virus
CICVKAFSV

SEQ ID NO: 14192 - protein, 9 aa, BK virus
ICVKAFSVL

SEQ ID NO: 14193 - protein, 9 aa, BK virus
CVKAFSVLK

SEQ ID NO: 14194 - protein, 9 aa, BK virus
VKAFSVLKG

SEQ ID NO: 14195 - protein, 9 aa, BK virus
KAFSVLKGL

SEQ ID NO: 14196 - protein, 9 aa, BK virus
AFSVLKGLK

SEQ ID NO: 14197 - protein, 9 aa, BK virus
FSVLKGLKH

SEQ ID NO: 14198 - protein, 9 aa, BK virus
SVLKGLKHH

SEQ ID NO: 14199 - protein, 9 aa, BK virus
VLKGLKHHP

SEQ ID NO: 14200 - protein, 9 aa, BK virus
LKGLKHHPQ

SEQ ID NO: 14201 - protein, 9 aa, BK virus
KGLKHHPQN

SEQ ID NO: 14202 - protein, 9 aa, BK virus
GLKHHPQNN

SEQ ID NO: 14203 - protein, 9 aa, BK virus
LKHHPQNNT

SEQ ID NO: 14204 - protein, 9 aa, BK virus
KHHPQNNTS

SEQ ID NO: 14205 - protein, 9 aa, BK virus
HHPQNNTSL

SEQ ID NO: 14206 - protein, 9 aa, BK virus
HPQNNTSLK

SEQ ID NO: 14207 - protein, 9 aa, BK virus
PQNNTSLKV

SEQ ID NO: 14208 - protein, 9 aa, BK virus
QNNTSLKVA

SEQ ID NO: 14209 - protein, 9 aa, BK virus
NNTSLKVAY

SEQ ID NO: 14210 - protein, 9 aa, BK virus
NTSLKVAYT

SEQ ID NO: 14211 - protein, 9 aa, BK virus
TSLKVAYTK

SEQ ID NO: 14212 - protein, 9 aa, BK virus
SLKVAYTKA

SEQ ID NO: 14213 - protein, 9 aa, BK virus
LKVAYTKAA

SEQ ID NO: 14214 - protein, 9 aa, BK virus
KVAYTKAAF

SEQ ID NO: 14215 - protein, 9 aa, BK virus
VAYTKAAFI

SEQ ID NO: 14216 - protein, 9 aa, BK virus
AYTKAAFIK

SEQ ID NO: 14217 - protein, 9 aa, BK virus
YTKAAFIKC

(The sequence listing continues in the following parts.)

The invention claimed is:

1. An isolated MHC multimer comprising $(a-b-P)_n$,
wherein n>1,
wherein a and b together form a functional MHC protein which is bound to the peptide P,
wherein (a-b-P) is the MHC peptide complex formed when the peptide P is bound to the functional MHC protein,
wherein each MHC peptide complex of the MHC multimer is associated with one or more multimerization domains selected from the group consisting of scaffolds, carriers, optionally substituted organic molecules, membranes, liposomes or micelles, polymers, polysaccharides, dextran moieties, IgG domains, coiled-coil polypeptide structures, DNA duplexes, nucleic acid duplexes, PNA-PNA, PNA-DNA, DNA-RNA, avidins, streptavidins, antibodies, small organic molecules, proteins, a solid support, and biological polymers, with the proviso that the one or more multimerization domains is not a cell,
wherein each MHC protein is an MHC class I molecule encoded by an HLA-A*02 allele, and
wherein in at least one MHC peptide complex, the sequence of P originates from a *Borrelia* OspC antigen, is capable of binding said MHC class I molecule encoded by an HLA-A*02 allele, and is selected from the group consisting of SEQ ID NOS:49735, 49739, 49779, 49795, 49921, and 49937.

2. The isolated MHC multimer according to claim 1, wherein n is in the range from 8 to 25.

3. The isolated MHC multimer according to claim 1, wherein n>10.

4. The isolated MHC multimer according to claim 1, wherein the MHC multimer comprises one or more covalently or non-covalently attached labels, and wherein said one or more labels can be selected from the group consisting of fluorescent labels, fluorophores, enzymes, radioisotopes, chemiluminescent labels, dyes, bioluminescent labels, metal particles, haptens, polymers, and antibodies.

5. A composition comprising a plurality of MHC multimers according to claim 1 and a carrier, wherein the MHC multimers are identical.

6. A composition comprising a plurality of MHC multimers according to claim 1 and a carrier, wherein the MHC multimers are different.

7. A kit comprising a MHC multimer according to claim 1, a positive control, and/or instructions for use.

8. The isolated MHC multimer according to claim 1, wherein the HLA*02 allele is selected from the group consisting of HLA-A*0201, HLA-A*0202, HLA-A*0203, HLA-A*0206, HLA-A*0211, HLA-A*0212, HLA-A*0216, HLA-A*0217, HLA-A*0219, and HLA-A*0250.

* * * * *